United States Patent 9,487,797 (GENOMIC PLANT SEQUENCES AND USES THEREOF) - sequence listing, part 59

SEQ ID NO: 69971 - DNA, 18455 bp, Oryza sativa
ttacattagcatttttgtttgcaggcaccgcgtggcaaacattcttgggaagccaccttaaactatgctcgtcaatgtcaagagaccaagaccatgctttcaccttcagacttcagatgtaatcaacacttgccaaactgctgctaatgatgctttgatagtacaaagattctgtctgaataatttacaacaggtactgtatactaattaccaatgctacaacattctaggttagagtaaactaacaacaaaacaaatctttaggtgcttcctgtctgttgctctctcttaagcttatcttacaattgtttcattctagattgttcagataaactaatgtcaatgctacaagaatccatgcaaagaaataagtgaccccaaaagaaaaataaatcaaatgcttcatttcatcaggatggcatggcatctgagtgcacattggcatcttgtgttctctgcatcttgcattgcccgaggcttcacttaaactctttattaaaggcgatggatgcagagatggatatagatggatggcttggacatgtcaggtccgtgacttaaattccaagcgtattctgataacatctccccatctaacaacatttaaggcacatgatttggagatttttgtcaaacatttttggcaccaaatctgataatagctcacaactttcttgctgactttaggtgatatcataagcccttttctctgattgacttgagatatataattgtcctattacgtccatctttttggctactaatttgtagattcatcttgagcagcaatgcaaatgcaaccaccctaagccttcctagcccagtggttagcggttgcccggccaatctgaagctgatttgtacagcaaaagcatgcgagatggtacgttccatgtctgatgaggtgaagtgctgccttgctcgcttcttcagataatgacctcgtttaatgaggcgatctgacagtgactcgcgtagggagggcactaaatagcatgacggtgcactaccgctccttcagaaaatgactttgtttagattcatgaacattcttctattatttctattctgttccaatcttatgttttttctttgctgcaaccaaacactaatttcttttctttgggggaaattgggaatccatatcgcttccattgtgttttttctattcttgtctttcaaaaacgcccatgattcagaaagaactctactttctgaaaagaattctgttgcaaccctgtttttcctatgttacaaccgaacatctgtttgtgatttttttttctttaagaaaattcggaatccatataactattcctgtattattcatgtgttgtggccaagcatctcttttgaggttttcctatgtttttctcttttgaagattcatgtggcagtcttgtcattggcaggactagaaactggccggcggaggggcgtcggtcggatgtggcggaagccatgtgccgccgatgtttagatggtggacttagattgggcgacgaaccacggcggtaggggttccgagtgaaagcttagcccaatcctttgggctaacagtgactacgccttcgggcgtggtaaccctcctgaaggcattgttgaggtacccctccctcggcgaggagcactgggtgaaaactagtccagttctttggacggatgacgattgcgtctttcgccgttgcgaccctcgtgagggcgttgtttttgtgttttcgtgtcgtggtgatgttgttggctcggtggcgatcggtctcgcatagcgatggccggttcggtgcttggcttcctctctgtagcgtgtgtttggacggttggcacatggttcaaccgttcagggcgtgtgttctagtgcacatccttgtaaaacttttcttgtaaccttttttcttctatcttaattatattgaatgatctccttcagtcattccggcaaaagaaagatttctactttacggaggaggtttaagatacgatttttaggcggcaattaatctgctgttgcgtcctgtagcgatgatgctgctgcactggtttcccctttgattgtttggcattgattaagtttagctgcttggtcgtgtgactcatcacattgtgcaaccgtggcccgaaaggacgacagaaagcgatggcttgtcttggcttcatccactttttccattgaactaactatagtaccagcgatctccacagtaataatatcatacgaccaaactgacttgcctgtattatactactaacatttggttgacttggggcttggaaccgcggtaagatcgttgacattaaagattagcaaaagctaagctacaaactgtaacaactttccatcttttgatacacaaaagaaatactgaaaacttaacttatctgtaagtttacatttttaaatcgaaataaatacccccatatgttttatttaaccacaaaaatctgaaatagtttaattagcaggcaggcagcttagttcaggccccatttttgtccgattgagatgcatattttacattagtttcattagcacgtttgtcatcaaacagtaaaatggtcacatttcatgcaaaaaaaaattcctatatagaagttgatctaaactatcagataaatttattttttaagtttgctataagtaaaactcaactaattttatgctaatgactttcttattttatttttctaactttattttttatttttaagtagaatcgaataccacctcagcctgattaatcggagataatgagtctacgaatttgccaaacccaggagaagagaagaaaagaagagggagaagaaaagaaaagaagagaaaacgcagcagagtcacgtacgaaaacgaagagcggccaccgcaaatcccggcgggattaattcgcccttttacctacccaccccaacccaacccatcttcttcttcctcctctcctcctccacctcttctctcccttcctccacttcacccatctctccccacctccacctccatatctatccacttctcactctctcacactctcactagctaggagcactccactccaatttactactagtatctctctctctccaactaccgccattgccttcttggcaagctcggttttcttgcggagatgaaggggctcagtgggccgaagctgctggtggtccacccgtcgtcgaacaagccgctgggtggcgccgcgtcaccggcgatggcggtccttggctcccgccgccggatgtgggtggtgctgttcttggccgggttcgcctgcgtgtcgctcggcacgatgctgtgcgccgcgcgcgaccacccgccgccgcccgtcgccgcgaggaggctggcggcggcggaggcgcaggcggcgacgctcgcagtgtcggcgcggggtggcggtgcgggtggaggtgggggtgggttgccggggtacgtgttcgacgcgctggtgcagtacgcgtcggcgggggggaactcgacggcgagcatgccgggcggcgacgtgcgcgccatcgcggcggtggtgaagcggcgggcgccgtgcaacttcctggtgttcgggctcggcggggagacgccgctgtggcgggcgctcaaccacggcggccgcaccgtgttcctcgacgagaaccagtactacgtgtcccacctggagggacggcacccgggcctcgaggcctacgacgtcgtctacaccaccaccgtccgcgagttccccgacctcctcgacgccgcccgcgccgcccgctccgccgagtgccgccccgtccagaacctcctttactccgactgccgcctcgctatcaacgacctccccaaccagctctacgacgtcgcctgggacatcatcctcgtcgacggccctcgcgggtaacaaccaaacagatctaatccttcttcttcttcttgcaatcgattctcctcaccgataatgatgcaggtacacggcggcgtcgccggggaggatgtcggcgatattcacggcgggggtgatggcgaggtcgagggcggagaagggggcggagacggacgtgctggtgcacgactacgagagggaggtggagagggcgtgctcgagggagttcctctgcgaggagaatcgcgtggaggaaaccagcaccaggtcgctcgcccacttcgtcgtccccggcggccgcgacctccgccgggaaaccttctgcgccggcggcggcggcagcggcgcctcgacatagatttttctccctttttttactcacttggtagtttttttttttactcccatcttttgatggctaatgatgatgtcggtggccatggcccaatgagtgagagtgaacataagaacaagagaaagctgaaagcctgtaaaaaaatcggcgagatgcgaagcagcacataaaaatgtgtccatggcgttcatcttcgcttctctttctgtctcttttcttcacgttgagccacaaaaatacaaggtccagctgaaaacacaaagggccacaaaaacatttggtacacaacacaagaaaacataaactccgatttatcgacatctgctgcaactagtgggatgatagtaaaggtgagtgcgagagtggcgatatgaatggcgctgcatgcagctgctgccatatttggtgagggcgctggggcctcgctgccgtgccgtccatggtggccatgactggctgtggctggctggatggatggatgactggccagccacagtgccactcctcccaactgacgccctgtgttgggtgggagcagcgagacagcatggtgacacactgccacagtgccacgccccgtcggctgttgcctcgtcgcctctgctgctgctgcagcagcggttgcagcctgacgcgacgcgcacgttgccgggcgccgctgcggctgcggcgagggtcgcaactggctcggtggatgggactgcgtggatttggctgcaacgaggcaacgacgagggggatgttgttaacttgtttggcctgtgtgattaaccttgtcataatccataactgagttctgattgattgtcgtgttctgttctgtgtaacaaagttaggcagaaagctgtgttgcatgtctgaaatttttaggcttcaaaacaagatagcatttattatactgtgtgatgtgttggcattggatgctgcctcccaatgccaagtacccatatcctcgattgctctgagctcgagtcgatggttccacacttccacatgtactactgtaccgctcgatggcatactggtggcacccatggcgccaatgatacggtacaaaggtatgcgcactgttttgatggcttcacgccctgctttatttcttgttttgtacccctagaaccgtagaaaagcctagtagatgcatgatctcataaattgcccggcactaccttatatccatactttgtgtgtgcataattatgtttaactactacgaacattatacacaaaatagcggtgtcaacctgcacgccgccgcaggtgttagtcctgcctctgagaataccacgtgaatttccaaatgcaagttatgcaaaggtggtgaggatcaagaagaatacccattgattgaaacagtcaacatgtgaagttacaaaagctagtaggcaaccatcacaaaaatatttgccatgttttcacgaatctgacaagcacaattggaaatacatcgagcagggcatgcatgtagcgtcacgaaaaacttcgataaagagcagactgcaaataacctactcctaaatttaaaccacacgagcgacgaagctaaacaaacgtggcgtagattgattaccgcctcctcatgccccttccaccacggccccgcatcgctcctccgccacggccagccatcgcgctagcagccgcatcaccttgcgcactttcagactacagcaaagaagataacccggtcagacgaagtgatgcctattgtagcagcgatatgcatacggcaacttgcaccaaattgtgaggatggaaatgaatgactggctgaaacatctttttcactgtggcatcacaaaaggtgaataataccacaaattgtaagttcattaactagaagagattcaggtatttaaatttgtcattcgcttacagagcatactttacagtattgcctaaaaccatatgtacacaccctgaggtatgattcacttagacgtctaaaatgacgttactaaacaattattagtgaaaaagtagaagaatgaaccccatcacaaaaggatggcatggctatctttttttccttgttcaagttacaagcggaaacaatgtcatgttcctagaacaagcacacggtgtggcgcaattggcaaaggggaaaatagataatactggccaacggagaatttagatgcatttggcagagaagcgaaggatggtcaggttttattatgacagatgagaagaatcgatagtactttctttaccttgggatttttaactgtctcatccacgctgagaataaggcaagcagcttcagttgcagcatttatagcattgatctggaaatatttattttataccatcaacataacaatagggatatttaaagagttactgaaaaggagaagcaccattaccttcacaacagcaggttcccagacaaagttagcaaaggaatcagcaattccaccagtgttgatgtccacaccaaaattagcaccttcacctgttaacagtgaaccgagaataagagaagttcaccatatgagttcatataatgttacagttccacattggcttgaatgaattgaaacttttcaacagaaactaactattgaacctaagatacaggtaactaaccagatgcatgtttctgtcggagcttattgagtacatcagttgcatcaaatccagcattgtcacaaagttgtcttggaataacctgtagaagagttaatttcaactgagcaaatttgtatacttgcaaagctttgatctataagatttgaaacaacattgagcaaaagtgtaaaaccaacataagcttagtgccgttttagtgctagtcaaaaactgcagtgcttgatgaacataacctcaaaagacacaatagaacttcccattgaaaccaacggtagctcaccacaaggactggctgaacattaatgtttgttttaatgctacaagctactagagattatgccttgtcgatcacatcagggctgaaaactgaacctaatatttattaatccaacactctccaaaagaagaggacatattctatagtgaactcagggtctggttagcaacgccaaatacccaacattaacataacaacataagtgcaatttagttacagttacagttacagcatggaaggcattattcatagttaaattccccaacaatcacatcacacaaacaaagctcaattgttattctgattgcacaagtgataacaaagccttaaggaaccagcaattgcaaaaaaataaaaaaagttggattaaacaaagtactccatactatgaataaacaatggggaagaatgaagccaaggatgtacctcgagggctttagcaaatgagtttacgaagaattgagacttcccagctatggtacgtgcatgctgtctgaggtacttgcttatttccatctaatacccaaaaaaaattacagattagtacattaatatacgtggaaaattgcactgcttagtttaagctggtcatgcatacatcaatagcaccaccaccaggtacaactgttgagttcttaagagctcttctaacaatcatgatggcatcgtggaggctcctttctgcttcctcgatgaactgataacattaacagcagcattagtatatcatgattagttggaaaacttagcaaatcatatatagctgtagagcacctgatctgcaccaccacgaaggactatggttgctgtttgaccagaagggcaaccactaaatatattgaaccgttcattgcccacttgcctttcctcgaaaacttcgcaagtaccaagtaccttttcagcagaaaggaccatcatacattagtgtgcttatttgttgccaaaatagctaaccgatgcaaacatgtgtactatgactcaaaacatgaaaatttgaaaacatgattacctcatcaatgacattattcactgatgtctgaacggtaccacctgttgctgctgcaacacgttgtaaatcctcttctgcaacacggccagcacagaaaatgtcccggtctgcaaaatactggataaaagaaagtttttgagcttaggctacagtgctacacaaaaactaattgagagaacaggatgagttgcaacgagaatgcatacctgtgttgcaagatcaccaattgccaaccgagaaaggactatctttgccccacttttgacacatttatccaacttgtcataaatgatattccattcagcatcgacgattgattggtattgtaaagggtcagacaatctaaataaatgagactacagtaagaaataggggaagaacagagagtgcatgcaaatatgaatacagatcaagataacactacaagtgcttggattgtgctagtacctgatttctgcattttctttctcagatttcaattctagttctatgttcagcaaaagaatctttggactcaagaacttctttggctgttgctcaaatccagcataggaaaatgtcttcttgaaggcaacaccgttaacaaggaaggaatctctcatggtgcctccaggaacctaataagtacaaaatttagacatcctgattcataatgaaatttagatgctaaacatctattgaatggaaactggtttttgatcagtacaaatgtactatagtcatcatgcactcgatgatttaacacaaagctgtgtaccaatatcttgagaaattaccttttttattccaagaaggttaagtctgtcatcattgctaatggcaagaacagcatccacaaccatagatgcaaaaaattctttctcgccacctatcaactttgatgagagtgttgttgcagcacacttggctagcaattccttcttttcctcaaggcttttcccttcaatgctagtggccaagtctttgaccttttcaattgcctgatgattatttcatgtgagttagaaaggaatggagcaagtgggagggtgtatagagaggagaagaaaggcaagcatcctaaccaaatggccagcagtcctataactgcgaattagactatgcggatgtactccgtcctcaatgtaaggttttgcttctttcaggaactcagcagcaagaagcaccactgtggtagttccatcaccaacctgaaggaaacaagaggggtaagatacagcttactttcaagtgtatgttacaggctgcaagtatacaactaaaactggtggcagatgataaaacaagattaaattgataatcactatgaatacacaagcatcagcctaaacactaattatgccacacagcagcttatgaaagagcatcatcttgatccaatgcaacacgagcaaatcacaagcctttcatgacctaattaacagaattgtcttttttcccgtgggtcaggtcattgtatgaaatgagatgcgaaatttgaacataagtaatctgtttgatctaaaaacactaaggctatccaaacacatttttcatgaatccaaacatcacatatcagtaaaccacgggtaacaggggcaaagcaacgtgatccggaaggaacaagcagcacatccacggatcaccagataacttcatttcactcgtttaagtacttaacaaatcactcacacacacacacaaaaaaataacagatcatcgattcagatctctaccctatgcatcttgtggcacggcatattcactgaagcattgttccaaatcgcgcaaaacagtcttatgtagtaggacagctgcacactccaacgaggttctactgccaagcgcgcgcgcgccgccggggggggggggggggggctcgccagggttttacctcggagtcctgggacttggcgatgtccacgaggatcttggcggcggggtggatgatttcgaggaggcgcatgatggtggcgccgtcgttggagatggtggtgccgcccttgtcgtggtggatgagcttgtccatgccgcgtggccccagcgtggtgcgcaccgtgtccgccaccaccgtgcacgcgttgatgttgctcaccacctgccgcgcccctgcgacgtgtccgtcccctccttcagcaggatgatctgcggttgctgcaaaatccccccacaaaaaaccccaaaccacaaatcacgccagtgattcaaaacctcgcggggaggggagcagaggtcgcgtcaatggagactgggatagtggtgcttaccatcatggacgccatggcgaggagctcgcggtttcggggggatttggtggcggggagatggagatctgaggtggcggcggagggggagggggagggggaggagagcagcgagggtttttctcgatcgctcgttttgagagggcggcggcggcgcggggaaggcgagagttctaggaggccccccgggtgccgaatgaccttgcccttggaatgtttgcttgcatcctagccgtccatccttggaacgctataaagtagtacggagtagcagcttggacagtttctacaaaaccccttgataggctcggttattttctgttcaccgtttgccttgtttgtttttttaactggaacatgaataccccgtcgtgttgctgctggaaactaagttgtatagtatgtacaataagctatattatattttgtaagccaaaataaaatgacttcctatgttttatataattaacacatgactgcaaatataatgcaaggtgaacatatttttgatacttatgaattttgaataaaaacagctgaggttgtatggttttatgagagaagaatgaagagattatttgtaccatagatttattatttaaagactacaaataattggaattatgtggcttcatgagagaatagagaaattagcattaactatacttagtggggatgaacaatacaaatatagacaaaaaactgggattgtatggtttcacgagagaataaagaagagactagttgtagcatagatctatcatccaaaggctaaaaataattgggatgatgtggtttcataagagaagagagaaatagcattaactacacacttagtggggatgaactatataaatatacaagattaagtattagcctttttgttgaaaaatagattaatatgattttttaaatcaacttttgtgtagattttttttgcaaaaaatgcactgtttaataatttggtaaacgtgcacgcggaaaacgagggaagtgagttgggaacctgcaggaacgaacgcatccttagtcagatgtgtcctatatgagagaaaattctatttatgggcggataaaaaaaatgaggagctgaacaaactatataaaattataaccctcttctaaaagcatgtttaataggctaacatggaccggcgatagcgtgaccacgtcgatctcattgctatgttggaggagacaatggtagagagagaacgcgagctgacaatagaattatcgcccggttgcagcacactgtacaatgaaaaaagagaaacgagtcttatggagatcatagagattgattcatgcttggaacaactataaaggatgcaataattagtaggatctatatcaattaaaaaatatatcagttttcatatttacaacaccagcatagttttataaatctataattgaataagttttcataatatatttatatgaggttaaaaatattactaatttttttcaataaaattagtcaatcttaggagtagtttaactttaaccaaagttaaaacatcttataacctgaaacggagggagtaccattgttatatggacaatctatactaacaagctataaatgacgtagatgtgttacaactagcaagttgacaacatttataaatccgctctaatggatgtatgaaaaataaaattaataaggtgtaatggggacacccgtagttaccacgtcggcaatagaggctcagagacccattcgtatggcagatccacgtagttacccgtagttaccacgtcgtcccatggcagatccaacaccattcgtatgaatggctaccatatttttttctttcacaattcgaaaagataatccacgtattcacgaacccgtccaatccacgctcgccgcgcccggcaatcgcgtggcgcgtgtgacgagttcggagttcggttaatgtcaacgacgagttgggcagccacgcagcagcgagagcagcgtcgcgtggattccagccaaacccctcctcctctggtctccagtggcgtaacgacgagattcgtcctcctctcctccgagtaaaagaaggagaccccctttgcttcgctgttaccgcacagtgaggccacgtcgtagggtttttgcttgcttctcccggctgcaaagcggagccgcggcgcggcccggggacgaggagggaggggagccatggagatcgggcagcatccggcgagcggctactccaaggagcaccagaagacctaccaggagtggttcgccttcgccgactcaggtccgatcccaatcccaatcaccctggctgcttcgccccctttgatccctgttccccttccgctgtttggtggtatctgatgattgatggtttgttcgtgattcgttcggttaatcggcggcgcgcgcagatggcgacgggcgcatcacggggcccgacgccatcaagttcttcgccatgtccaagctcccccgcgccgacctcaagcaggtgccaagtctactgtttccccaatcctcttatttattactgtagagttgtgtgtactgacttcgtgaaatccgcgtcgcctctcaaggtttgggcaatcgcggactccaagcggcaggggtacttaggtttcagcgaattcgtcacggcaatgcaggttttcctccccttttcgatgccttggttgtactccgtgctgccatcagaagtgtatggctttattaattagtgatgggtttgtcgcaattgatagcttgtctctctggcgcaagcgggggatgagatcactcaagacagccttaagcgcgatggttgttattactagccaccaagtactaagcttctttgatgagtttgtatttactagtactaattatagtttacactgatttctgacagacttgggcagcctgaatcctccaacgatggatggtttggatgctctacttgtggtaagtctactatgcgtctatgcctcagtcagattcattaagttgtgctgcacaacacaaccggataatagtgtgatgattaattgctttacagaaatcaaagcatcatgctaagagagttgatccagatatcgatggtaaggaatgcacccttcaataggaaatcatgctgggaaaattagctatgtcataggacaaacaatttatatttgtgcaatcatgcaggatttcctcaggctcaatctcctgcaacgagccaatggttcagctcaaagtcctcaaagaaggtaatgttcgtgttatttatttttctttccttttgtgttctgaacaatagatacctacatgaaccttgaagctcttgcaaaattttggtgagttcaatttgcattacattcatattttgataacatgttgcaattttaaaaaggaaagtaaggcaagtaaggagtttgctgctgagttatttgagcggtgaagacatcaagttaagctttgacatgcaatttattgaactacgaagcaacagtacagaaaccttgattcaatgtcttaagatgaagtcgtgttgtttaaagatttaccccttatgtttttttttcacaggactgcgtcctctaaaactttgtctttaataatgttcacaaagaggcaattattaaggcctttgccctatacaaaccattgatgccagatgataaactgataaagaagttcctttctttaatgagacacatatcacttatgctgactttgtttgtggtgttctatatgtgcagatacccctgaatgctgttacttctgtcattgatgggttaaaaaaactatacatcgaaaaattaaagcctttggaagttacatacaaattcaatgattttgtatctccattactggtacatacttatatattctcattatctggtttcttattagctataaacatctaatttcttttgtttctctgttccttgttgttttccctgcttatggtatggtttaaagtaaattacttgcatgaataacaatatctatttcttcccttttgcagacaaatagtgattttgatgcaaagccaatggttatgcttttaggtcaatattctacagggaaaacaacttttataaaacatctgctcagaacaagctatccaggtttttatttagtattttctatatttatttttctgtagttttccagattaatttaggtagcatgtgcttgacagttgatatgcacttgcaggtgcccatattggaccagagccaacaactgacagatttgttgttgtcatggtaaactctagtctgcgcaattcttgcaaatgatttgttaaggaagtttgctacaacaactattggaagagctatcttgcatttttaaaatgaataagacgctatttcaatttctatatttcaatgctgataattggtttcacatgctttacgtttgaggctttgagccagtccaaagtggtagaatatttgtcagtcttttactttcctttttctttttagtttccatggctaataagagttagaacaagtagctcagtctttgccttcttttacttcaataatggtatttttatgtcggatgtatggattttgccattcattgaccctttgttaatgatagcttctaaaaaatgtcggctatctactctattgaatgctagcatggtgacactgttcaggcaccatcttatcaaaatttcctctgaattggttagctgaccatttgttcagtttctgttgtggttactacttttagggtttgttggctagtatagaagaagcataacacacccatcactatttagcataattttttcttagcttttgaacaaattcatttttagcttttactacaatggattgatgtgagcgagtgcaatgtaaacaatttgaatttccacttgcctagctggtgtgttgatgggtatattctatctgtacttctctattactacttactccagttaactttcttctccctatactagtcaggaccagatgaaaggactattcctgggaataccatagctgtgcaagcagacatgcctttcagtggtcttacaacatttggaactgcttttttatccaagttcgaatgctctcagatgccacatccagtaagatttaattttgatgcatgtagagggcatgtggtaatctagagactaattcctaatttggatgttgaagctactagagcatatcacctttgtcgacacacctggtgttctctcaggcgagaagcaacggacgcaacgtagctatgatttcactggtgtcacatcatggtttgcggccaagtgtgatcttattcttcttctgtttgatccacataagcttgatatcagtgatgagttcaaacgtgtcattggatctttacgcggacatgatgacaaaatacgtgtagtgctaaacaaggcagaccaagttgacactcagcaggtagagtatttcatagccatctcttctcacgacgcttgtttttgcatattgctttgttttgacataaatctgttttccttattggcgtgcagcttatgagagtctatggtgcattgatgtggtctcttgggaaagtattgaatacccctgaggttgcacgtgtttatattgggtaatttctcatgcccctgtcctcactgcttcgctcctacattatttttgcacagagtactttacaaactacaacttacaataccataaaaccataggttgaacattgctagaaatactgtagataaatttcatttaccttaggttagcacagaaattcacagcagtattagtgggttctcaaataattgcgtaatttggatctggtgcttgtactgatctttgaggccgcctcggcatattaaagcactaaactagtttcctgttttactcacagatcatttaatgacaaaccagtaaatgaatcagctgttggtccaattggaaaggaactatttgagagagagcaagatgatctactttctgatctgaaagatataccgaagaaagcttgtgaccgtcgagtaagttgttacagtaccttctattgtttggcttatttgagtcctggatttcacaaattaatctcattccatatttgcagatcaatgaatttgttaaacgtgcaagagcagccaagattcatgcccatataattggtcatttgaagaaggagatgcctgcgatgatgggcaaagccaaagctcagcagcgacttatagacaatttggagaatgagttcgcaaaggtatcttagctctgtaagcctgtaatttctactacatccgtttcaggttataagactttctagcattacccacatttagatatatattaatgaatctagatatatatgtgtgcctagattcattaacatctatatgaatgtgggcaatgctagaaaatcctataatctgaaacggaggaagtagtcattttggggccgttgtagtcttgtagactttacaaatggtagatttgtagtgagtatccaccctttgttcgtttagaacacgtggtagattctctgcctatcttgtcctcgtgctgtaatacttgcctaaccagttaattagtagttgtagtaatagctaattctggtttgtcgacgtatcgcattatgaagtattcatgcagttcacctgcatggttcatttcagttatgtaattccatgcttgattactatccgtggtctggtggaacaggtccaaagggaacaacatcttccagctggagatttcccttatgtggagcatttcagagatgtcctgggtgggtatagcattgacaagtttgagaaaatcaagcccaagatggtgcaggcggtggatgatatgcttgggatacgacattccagaactcctcaagaacttcaggaaacccatacgagtgaatgaacacctttaaattatgaccatggttttcaactttttatcatgatgagagactagtcatattcggagggaatagggatgcgctgcattccatagttttgcaactgtcagaaatctgggattgctgaggtttaggtcttgtaactcttgtagggcgtttattgtggcatactttaccttgttgtataactgcatgcataagaatctgagagccattgctcaattcttttcaacgaagatgtgaactgttggaaggcaatgtaaaacgggaagcgctgtatgaaagaatatgacgcacatcgtcttttgttttttaagaattgagtatatattcgttgtggggaacagcctgatgatgggccccgggaattaacgctcgagcaacgttggaccattctgacatcgcgtttcctgattagcacaatgtttcgttttatttggaaattgaattgaatgtttctactgttattaattgcagacagtacaccaaacgaccaaatctatctgcaaacaattaaccaagaccaactggagaatttacagatgaatcactgtgttacacctgtaaactgtggctcctttgagaattgagttacaacaagagtttggagatgaacttgtagttcatctatatcatcttaattaaacaataatatttattcaggaatgcagttcagagactgcttaacacacacacacacaaaaaaaaaacctaaacctgaggcttgtactggaacaaggtcattagcaaggtgtcctctagactcccggaccgacactacccttggaagtcaaacgcagctggcacaaacaaacggagcctcggtgacgccggtaaaccgcaccaatcattgttaaaccaaaaaacgtgaacaacaaaccaaaaagaaactaaaaaaccgctaaaaagacgcaaaagagagagaaaaaaaatgaaagaagaaaagaaacgacgcggactcgctgacgacccgcggcccggtccaacccaacccccaccgcctctctcgccgaccccgtccactccgccgaattcccccccaaacccaaacccaacgcgacctcacctcacccgcacgacgacggcacgacgcgacgcgttgcccgagctgacggcttgacgacgcctccgtccccgtccggcaccaacccatcccaacccaacgctccccttttccactgaccaattgatagcccaacctcacctctcctctcctcctcccccctcctctcctcctcgcctccgcaccagcagtttcgtgcaccgcacttcacccacctacctcccccaacctccccatcaaaaactagt

SEQ ID NO: 69972 - DNA, 6829 bp, Oryza sativa
tctcaaaacagctaaagactgccaacacctttttggggctggctttctgctttctcgaacaaaaccaaaaacttgattgtaactggtattgctgctgtaatctgggctgtctagaaaactagaaataaagcttgttttgataaaaaaaattgcctaatgatcccactgatgtagttttcctggtttgccactggatggaatcctaggctcttttgcagaagcgggaggcagatcaaagaaagctgctcttgggggccaagctcataaggcaaattgcaagtgatgtgtacaattctaggtttggatggaggccgacggggagactgcagtgttgatcttttggcgggggtagagtatgctttgttgattgtgtggatgctgggttcatggctcctgttagtcctggaagtcttgttatgcagttgttgattctgtgccttctggatagtccatgtatggtcaaagcagccggtgtgctggcttctgtcctttcttttctgttcttcagtttgtaagactttgatcttgtaatctctttcatttctagtaatggaaatgggggcgtaatgcccttggtcaaaaaaaaaactcaactaaagattaattatctctaattggatttatagtttaattgattaaaacataccgctcgtaatggtaccatccacgattgaaatataccgcttatagtttaattatatcaatagtctttcatgtgggaataaaaaaataaagactattgaaagaagagaccatctagaacacaacacgagattaattaaaattcagaaaaaaaaatccaaaaatataaaaataattgtaggagttaaagtatgaatacaatttataaataacaaaatattgaaatgaaaaatatattttttttaaaaaaaatagtccatctagaacacaacgatgacaagtgacataaagaggagagaagcaacaaacctgtaagaagtagtgttgtgggggttgatgggacctctaaaaactataagcaaaactattgacagtcattaagtaccaaatgcgatagtcaactatgataataaataaagagagaactagcatttcttacatgtattccaataataaatagtgtagtactactatgcttgaagaattaacatgaatgcagagaataaacacacttctggctaatcacgtgcgagcacacggattgagtcacccacaagtcagctcaaactgactcaaagtggggccaaaccaccgggaaccgaccaagaggcccacttgtcaaccacacaccaaaggaggtggctaatggcggttactctggttcagctgaaccagccttggagcgcccaacactcccttccacttggcaactcctcattcactcctgatggcagttatgcttgattcccggcccacaactgccttaagcaaccaccatttaaagctataaatagtgataaggacataactagcttggatatgtccatgactaacttgtgtatttatcaaccaaaggtacatatgttttatattagatttacttattactccgtatatatttgaataaacgttactacaccatgagttttgtatcttctcgtttgcagatctacttgcgtggatgatggaacagagaccgggcgtaaggaatgcatggatgatcaaaaaagttgattgggaccaaaccaagaccttctcctagtctacttttacctaaccacgtcacgtttggtccaaagaagataagagataaagttctacacgttttggattcggattcgggccttctgacagcattaacttcaaacagacctagccgctcgtataaaaggaatttcggggcccatgagtacttgttggaaagcttatggagtatactttcagatggttttggtcatacattaaaattcccaccgagttgtcggaaatctgcaaaacaagcctcataccttatccagtccaaatctgatttgggttttagaccttgtaattatgtcgtcgcttagaccaaaggggcgtgcgccattgggcaaccctaggacgtccctaattatatatatttagtagtcgtcatcgtttagagtcgagttttgcttagattatttctgccattgcagtttcgccgctaggtcggtttgtggaaccctaaatttgagtgcttaatcattcgtatgcaattgtgttgcaatctatcttattcttgcttgtgttcttcgattcgcatgcagggattagccttctcggcgtggtcaaccggacgatgcacggttgataaccagaggagacgtggtgctgcgatttgcatggttcggatcgtgttgatcggaagccggattgtgtgtgtcaagtttccgccaaatcgagagttatcaatacctatcgaaagatcgagacctagcatcctcatcatagaggagatcttttcacttcccaacacacacctcaaggagcaattctctctatctatattgtgttctctacagttttagtagaaataggcttggagtatctccggtcctatagtcttcttagagattccgatgtgtgtttagttctttactattttggtaagactatatttgaattaaggaacaattgcttacttgaccctagtttgaagcccaactactaaattgaccctattttttcaagtttgctcatttgaccccattttttaaaactgaacatcagagctgaccctattccgtgaagaccaaataacagtgttaactgtgaagcaattatcatttttgcccttgctcatttaccaatgttatatcaaagatttttttttctttcattcagtcctttttaatatttgtagttcatctcattgtcattggagctcaggacagtgttcagctgctcgctctccaacaccgggcaggagaactcggccgtcgagatgacgatggtggcgccagtggctgcctgttgctgttgacctgttgctgccgtcgatctgcaggccggggatgagaggctgtgccatgggcatgtgctctgttggctggatgaccatccggccaccgccgacgtcaatggcattggagttcgccggaactgacagaagagagagagcacaatcggattcgagcacttgtgtcagcccgcgcgcagtcgccgccacccctcagcgcgctggcgccggcgccactgccaatcgccgtccctctctccctccgcacggcagcaaccgctgccgctactccgtgcgcccgcgccgaccgccttcgctcgctggcgccgctcctcctccctccacacggcagcagcccgtgccgccactcctccgcctgcaggcgccgccggttctcctgcctccgcgtgccgacgccgcccctccctccgcgcggcagcagccgacgccgctgctcctccacacacaggcgccgcctcccctctgcgcgccagcgctggcagtcctcctccctgcgcggaccgccgcccctccctggctccctccctccgcttggcagcagtcgctgctgctactccaagcgcgcgcgcccatcgccgtccctcccttcgctcgctgacgccgccgcccgccgctcctccttcctccatgcgcccagccgtgccaccgagatgtgtgggtgaagactcttgatttgtaacttggataaggttattatttataatcaggggtatattggtcagttcatactagcaattttattttttttcattttgctaactaagacactaacggactattaaaaagaggctcagatggtggctttgattttaaaaagcggggtcaaatgagcaaagttaaaaaaaaaggggcaattgtatccatgcccccacttttaaaaccaattgctgttttaccccatattttagagtttgtatttttacccccactttttgaatctgaagcagctgtgtaccctcatttctaaccgccacaactaacggtgtcagttgtagagaaaaagacatatatacccttggtggttattgtagttttgcctccattttttttagctttgtgtgattttgccctcattttttttcagcttgtgtgagtgttataatgtgaggctttgaacggcctatgcattcactctgaaccctctaaactacacatcaacgccacatttagttgtacatggataatacaacagagttgtgaattgttccaaaaaaaaatacaacagcccatgtaccctagatttttttgttaattgttgatcgctctgtgtccagttcttcattgcatagagcaacaaaccgcaattaacgaagcagaatgtaagcaggaaataacagaacggaggagcatcatgcatttctatagctccatctctgacgacaaatgcagatagcaaccgcaaaatgagagctgcagatcgatggatcgatctctcctttatcattgtcgcatcacttgacgactttgatccactcagtgcaccctgcatgcgaatgcacaacacataggcaaattaacaaaagctgcagctaataacacagatcaaaaccgttattgatggcaaatgaattacctggagcagtcggtggaagggctgatggcgtaggggatgttgacgccgcacttggaggggatgccggcgacgaggtcgggcctcaggccgcccatgccgctcgtctgctgcttgatgcaggcgcaggtggtctggtggtcggcggcggcggagttgagggtcctgaccccgtcgcagcagccgccggtgggggcggacaccctccccgtcgcgtacatgatgcacggcgcaagcatgcggccaacaactttcccttttctgccttgtcttgccctcggctgtgagaggccgcctccacgtggaagagcagcggctgccggctgtggacctcctgcgagcgggcgccggcgcacgcccgcgtggccgcggcctcctcgcgcggccgcagccgccgccgccgccgcctccgtgccgcgccgccgcccccgcgctagctagctaggatttcgacccgactcacggagacgcacgggaagaaccctatccattccctttccctcaggggtacaaatgtcattacataatttctaaaacctttttttattttgtttttatttctttaacacaaaatgtgggacccaccaaacagttgtcacaagtgggggtagaaggctacttcagatttaaaaagtgggggtaaaaatgcaaaccctaaaagtgggggcaaaacagcaattggctttcaaagtaggggcacagatgcaattgccccttaaaaaaaatagggtcaatttaatagttgggcaaaatttaactatttgccattcttgtgacatggcaattaacgatttaccatactctatcaattacatgtgggctctcatgtgtatatgacatgtgggcctagtggcaaatcgttaagcaacatttgtaagagtggcaaatagttaaaagctccttagggtcaaatagcatttgccccttgaattaatggaattatcttattatttatttatttatttatgctcatagtatgtgtattcatttattggatatgtgttctatgagtagtatatatttcgcatatctcctacagcctaggctagtcgatccatgtaacaattgttcatttagaactaactgaaattcaaaattaaaaaaataagaaaacaaagagtagagcttagagtccacgtagaaatactatttagaaatatctaaaatcaaaatttttaaaaaaggatattggaagaagatgctagaaaccttatagtaatactcctgcaataaaggaattagaaaaggaatactgtaagaagagtctatagtccatatagggatacaatttagaaataacgaaaatttagaattaaaacataacgaatattaaaaaaaattctagattccatataggaatataatttataaataaatgaaactagaaataaaaaaaagagaaatattaaaagaagagtgtagtccatatagcaatacaaataacggaaattcaaattttttttaaaaggagtgttgaaagagaagtctagagtttatatagaaatacaatttttaaataactgaaatttgaaatttaaaaataagaaatatggaaagaagggtttagagaccatataggaacaaaatttataaataaagaaaatttgaaattataaaaataagaactgttgaaagataagtaatttagagtccatacagaaatataataaaaaataattaaaattagaaatcaaaaaataattattaattatcgcctatatacaatacactataaatatcacgtatcgaatagtttggccaggccagaacagtaattgaaaattatgttgtcattttaatatattttaataatacaaaaataaaaatatatatgctattatgtgagaaaaaatataatgattctagccgcgcaatatacaagaccataatgctacttgaaataaaaaagaaacagatagagcattaattttgtttgcgagcttcattgacaagcataacctttgcctagtggtgtgtttggatggagggatataggtggataggacatggcggcccattttttgtgggtgtttggttcctgggcaggggtgggatggagcggcccggggaggaatattccccccagatgccggatgaggggatccggccgaattggccggatgcagccgcccgagcgcggggcgagcgaccaaggcagtcgcatcactcctctccaagaaagagcgacggcgagggcggcgaccagcgggagctcggcggcggctgttgcgagcggcggcggcggctggtgcgagtggcggtggcggcgccagatgcgcgctcggccgcggcgccggatgcgagctcgttcggcggcggcggcgggaggcgcgctc

SEQ ID NO: 69973 - DNA, 4224 bp, Oryza sativa
tgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgcaaccccctcgctccgttctatcgttttagccccctcccgcgatctcccgtggtccctagccctctccccgccgtcctcctctctctcccgtgccgccggccgcctccagccgcctctccctccttgccggagcgccgtccggtcgcgccgtcgcctcctccagcatcgcagtggcctccccttccccggcttgccctccgtttcccgcggagacccccggagctgcgttcccgccgtcgcccttccctttcctccgcgccggccgcctccagccgcctctgtctccctgcctgagcgccggttgacgtcgccagcacctcccttggctccgcgacgccgccctcatccccggcatcacctcctcctcgcacgaatttcgccggaacaccgtcgcccgcgccagcctctccttcctcctcatcgacgtctcctccggcagccccttccgccgcgcccgtgcatcagccggcgctgccgtcccctccctcggcgtcgccgcatcgccctccaccccggctgctcctcggtttcgccggaacgccgtcgccgcgccggcctctccatcctcttcgtcgccagcgtcctttcggccgccccttcctcctccccggctcgtcggcttgctgcacctctaccatcttcggcatcgcagccgcgacgtcgtcctcggcctcgcctcccctccgaccgaacaccgccggtgtccgtcgtcgtcttcaccgttcatcctcgccggctcgccgtctggcggcgccgcctccgtcgtcggcatcgcagcggtgtgttccacgccatcctcgcctccgtgcagccgctgccggctgccctcgtcgtctcctcgccggccccggtcgtcgtcgtcgtcctctcgtcgttcccggtcgttgtggcgttcgtccctccgtcaagccgttctcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgagcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcattaaacttcggatgaacatatcttggtcatacgaactctgaatcgacccgttcaagtctcctaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgttttatttagccatgcctatttatcattgttaagacattattattgctattgttattattaccttgttcaccctaggaaaataaaaccccaactagtgggtactctatttatggttccactagtgtgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggtcgggttgccagttcagtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctgccggtgtggcttgctgagtactgtggttgtactcattcttgctctatctttctccccccccttcagtaagagaagcttcggagaagatgtcttaggtggagtcctggcttataccccagttgagcgcctgtgaagatggagccgtaggcccgctagtccgctgctgtttatttttgtttgtcaggcctgaagtgcctttgtaataatgtatttattatcgatataataaagatgtgccttttatatcatgtttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctgtttcctcctttccctaatgctatgtcacgtcctgataaattcatcccgaaataaaaatcattttttaaaaggaataatagaattaattaaaattcagaaagaaattggcaaacactaaaatgcgtacaagaaaaattcgaatgtggcccggagaatttttgttaaattctccttggtttaaaaggagccctcaaattttacttgaattttcagagcaccggaaataattattaagcaacaaaaacaattatcaaagtttagtaaaaagaaaaacctaaaaataaccttccttcctcctttgggccaagtttggctcaaagtccactctctctctctcggcccgcggccgaagtccctctctcctccctctttttctctccctctccctccccctcccctctctctcccgggccgttcctccctcccctcccggcctgcccggtcccgggccgccctgccccctcccgcctgggccgtgtcccggcccagccgagcctccccaagccgcgccgcacgcgcctgtcacgcgcacgccgcgcgtgcgctgaccgcgcgcctgaccggtgggtcccacgcgccgggtcatcgtcctcctcccgcccggccgtcctctctccctctcccgtgaaccctagcgccattcctccctcaaatccgcgc

SEQ ID NO: 69974 - DNA, 2776 bp, Oryza sativa
actgtttaattttgattgccaggcctgaagcgcctctgtaataatgtaaatactatcgatataataagagatgtgtcttttatatcatgtttgtgtggtgtaccccgacttttcctgggacggggattaatacactagcgttcgggaaaacgtatttttctcggtcgtgacaagctggtatcagagccatctcgactgtaggataagccaagtggataaaacctaaggacatattttataaataaaactatttgcgaaagttcctctttttcttcttcccctagtgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtccattctttccttgtctgcttcccctctcaacctctaccttgtgacagatggataacactggtaacaaaggctatgggaatgatggatccgatgactcaagaacccaagccagtgggaatgagaaaagcatcaacaaaacctcaccagagctaatccaaattgtggttaaccaaaccaacatgttggcaacagcctttcaactattacagtattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcacaactcatcagttggttggaccggcttcagagtggtgggatagctacgaagcatcacggccagaaggacataccatcacctggaacgagttttcatctgtattcaagagatcacatgttcccgcaagaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgtcaacatcccagtatttccatgtggtaaccaaagacagcgcactgagccacttcagatcaccggatcttctgttgcgcatcaagagttactaccccaagaagatggacacaacgcagacaacaacattagcaatactaatgctgatgataccaccaacaaccatggttcttgccccattcatgaccacttagatcaagcgtgcaatgtcaacagcattcaccaagatatcgacgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacggacaactcagtaaagaagacattgatttgttacaactgcaaagaaccaggtcatttctccaaagattgtccacagccgaagcgtaacctgcgtcatcactccggccattatgcaagaagaagacaagtcactcgccttgtggtcactggagcaaacgccatacctgtgaggcctcgagttaatcataacccatagtagaaacaatgtaccgatgttaagcatcttccctttttgtttaaggtagtgccttgtattcgtgtaataagggagaaatgtgtaatacggacaagatttatgaggattcttttggaagatgctgatatgggattatgtgtataattggttactgtcaaaggagacctagggtctcatttcagaggaactatgttctaacctcgagttaatacccaacctgatgatggaaaagaaaatcaagtgattaaccaaagagacatttgtttggactaagtgtttcagatgtgtcttctttggatcaaaggcaacaaccgtcagtctagcttttgatgaaccacttcaaggtttcactgaaaggcagcaagccaaaggacctcattgtcaccagaagcatccacaactctcggagtgaagagtacttggttgacaaagtttaaaaggtgattgatagaagatatcagcaaaggtgtttattatcgggcaaagaagtaggtcgaaaggtgattgataagagaaatctaaaaaaaagaatacgtcagggttgaatgtgtaaaggcatactttgaatgctaaataataacaacatgaagagaatagtggaaagtgaatccgagttgcttgttcgtgagagctattcccagttatgaaccaagtgatatgttcgaagatagtttacagaggtcagattaaaatcacatgtaacagcg

SEQ ID NO: 69975 - DNA, 1162 bp, Oryza sativa
tgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatggccttattattattgctattgttattattaccttgttcaccctaggataaacaaaccccccccccccaactagtgggtactctatttatggttccactagtgtgaacttaggtagatgcttcgctggttaattaggcaacattaggtggttttataactttagacattgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaatgaaggctacacgagctgcggcccggtagtcga

SEQ ID NO: 69976 - DNA, 8986 bp, Oryza sativa
taactactgaccaaggagcttctttcatgtcacatcaatttagtgagtttgtcgaatcttttagaattaaattgctgaatttgtcgccttattatgctcaagctaatggacaggccgaatctagcaacaaaattttgattaagcttataaaaaagaaggtagaggagcatccaagaaggtggcatgaggtgttgtcagaggctttatgggctcatcggatatctaagcatggtgcgactcaagtaacaccgtatgagctagtctatgggcaggaggccgtgttaactgtggaggttaatttacaagctcttagaatagccagacaaaatggtttgtcggctgtagattataggaatttaatgatggacaggatagatgacgtcccagaggaaagattgaaggccttgagacatattgagaaagaaaaattaagagtagctagggcttataataagaaggtgagagaaaaatcgtttcagataggtgagttggtatggaaaacgattttgcccattggaactaggagtagcaaatttggcaagtggtcaccgagctgggaaggtccttataaagttgtagagattgttcctggaaattcatattttgtgtagtctttgcagggggataagttgcctaaagctttgaatggaagatatttgaaaaagtattatcccagtgtatggcagggagcttgatatggttatggccggtgtattgtttgaaacatcgtcctcagaaaaatattagttatagtgtttttggtgaaatttataatatattaccaaaaacaggggggcatgtgttaataatgtaatttggccgattaggtagttcaaatggccagattatttttaatgagtagttagatgatttgaatatattctttaggactttggttttgttttctaagtgcaggtatgatgctatattatctggagagcagcagcagcagattgatggcttggaagattcatgcatgatggtctgcttcacaaggctgtgcgtgtgctgtctatctgcatggaggtgcatatacgttatgcgggtctttttgccgtatgattccatatacgtatgctgcagttgagtgggcctattggatcatgcacagaacaacatgggtttgggctatatcaagaccaatggatcatgcagagatgaggctggttgttttgacgccgaagcttatacggaagggaatacaaggtggcacgcatgtcagctgagataaggcattgtttgatttggtttgttttgtattcggcttagagaattgatcgctacttggtactttctatatacgtgggctaaatacatctactaaagaccggagcacgcctgtacatatatcaggtgcatggccgattggaagaaaaagaatcgaacaaaatcaatctacttatttagattttcatctatttctgttttctctttcccgtgctttttctctctactgccaagctctagggtttggtggatctttgccattttgcgcaggaaaacggtcggttttcctccacgaaagcgaggaatctttgttgctttgctcggaaagcatccggtgatcgtcacgtaagcacggtcagtatcgtgttgttgcgcggatcaatttcgcgtgccaacaggatctaaccatggcatccaagtgactttgaaagtacttagcccacttccggactgtgatcagaactccatgtaatagcttctggtcctatgcatagcgtgtcttggagccagccaaaacatcactgatgaaataaatgggcctctgaaccttttggatgtgtccttctcatttaatatccaacactgcactgacaacatgcgaagttgctgacacataaagtggcaagggctcttgtggatatggtgaagctagcatgtgcggtgtcataagaaaattcttgaagtcttcaaaggttttggctttaggtgtccattgaaaaagggcatgcctcattctccaagcctagagacaaaccgactaagagctgacaggcatctggtgtgtttttggatgtccttctaggtacttggcggcttcatattctgcataccattcatttcctctgggatggcttcgatgccacagtgtgacaccatgaaatcaaacagcttccctgatgctacttcaaaggagcaattctccgggtttaatttcattctgaagacccggatgttttgaaaggtttcctccaagtcagcgattaagttatccttctccttcatcttgatgacaacatcatcgacataggcctccacattgcgcccaagctatgattgcaagcatttctgaatcatgtgctggtacgtggctattgactgtcggtatcaagccatttcgtctgttaatatatccaaaataaaggagaactagctatgcttgcatgcatattttgtttaagaataatctatctccacttgtaattggaattttatttcgttgcagagaactttacataattggaggagaatcgatggagaataaccgaacaatcgattgaactccgtcgagaggtagacttatgggtggatgggattacaaatcaagtaaaataatatcaaatgggcccaaccaccacactactagaccaaagagtcatcacacgacacggctacaaaattctgggctgattgggccaggccagggttcggcgcaccgttgatctccccctttcacatggatgtctaggattgctccccaacgacggttgtagggtatttcggataattccaaccgtcacaaccgtcattggcagcctacagatggaggatagctcactccactccaacacatactcaagaagaagatcaagaagctctctcaattttagtttattgttctagtgctagtggagtaggaatggagtagttctcttagttctcgagtcttcatgtgatttcgggtatggctctagtagctcttccttcttttttaagacttataatgttaataaaatattctcctttatatactttcggtcttttacttaattcatattattcgagtaccgactttagttcttacttgtcttgatataattgtgtaactagcttaccagagatatgctatggtgtgggtttaatgttcatttcaatgatttctctatgtctgctgcagcgatatgaagtagtatttagtaatgtaagcgtggtgcttagattattagataccattaattggggttatatgctgcgggtcagtagaggtgagccgctgatggtgacagctcagtacgagtattcctcaatgttagtatataatcctaagagacttttctagcatgggaactcctccgtattcattaccggtcggatcgccatgacgggttgtcgtaaggaacttggcaatcaggggtgatctctcgaaacaccaggttgacattgtaaggaggtattggttgcatgattgtatactagcaagtgtaaactaaagatgtttatatactagaagtgcaggaatgattatttccttattctttctccactcagcctagattatatctaaataagtgaaaggagagtcatttctcacaaaattactgtgccacttcattcgaataagcatagtcgtccgatttccaatacaaaagatgtgagccgttagattctctaatcatcaaaatatcttcacaattcttcaataatcttcttttcacaaagaagtccttccacaatccacatcccaaacttatataaaaagaagcgaaaaaatgcatgctcttgcgtttgctgcttttcatgctgcatccggtcagcgccgcctcttcttctctttcttggcacaagcggctatcgctggcttccgtacctctgcctgctccaccttttctcccaagtcaccgccttccccaccacaggcgcctcccatctcttttccccactgctgccgctgccgccgcatcctcctcttcctcactgtcgctgccttctgttctcctcctcaacaccgtctcctccccgtcccggcaaggatcaggcagcagggctgcggcggtggccgtacctcctgcgaagacaagatttgaacttctctggtactgctcctttctgtcctctcacaccctagcaccaaatcgggagtatgcaccatagtccgtagatactgattcattgtgaaagtttattttactgtgttattaatttgtatccatgctgtttgtaattggtaatacctgcactaaatcaaatggtggatgtgatttagaacgcctaaatcatatgcccataccaaattctaaccacaccaatctttcgttggagttgtcaatcaggacactaggtcaacacggtcttgctaaatgttcagtcatgtaattgaatttttagcatatataattttgattgtaattgttcagtcatgttagtacaaccatattgttaataagcatttagttcataaacttttaagaatgctaaaatatcaggtccttatgtttttttctcgcttccaatttgtcataataatagaagttcaaattttattttatcaagcttccaatctgtcgtaaatagtagaggttcaattttcttctgtccatgcttttaagttactattgcaatgttggtttaaagaatttttaacacgtctttgtgctttgaatcaatggtacggagcttttctaaccacaagtgtcgctttgcatgttctctacaattatttgacaggagtaaactagagaagatttttgaggatgcatgcagggttcactggaatgattttgtattctcagctgaacattcttgagttattgagtttagcatccgtaaaatctgtaattttttcatcaatgaacaatgcaataccatgagccctctaatgtcccttttgtttccatcaaaattttcctttcaatgtactatcttttcatcaaaatttacgctcatgcacgtctctttcagcacaacccttatttaaatgtatgtgctgccgtgtcctgtgattttggaaaaaaaacaaaaataaaaatagaatatattatcatatattacggcatagatataaagggctttatagctacactttatgtaaaatgaagtatgtcgtgcacacacttatttacattgttaattattattataaatttaaacttattgctataaacaatatgtaaatatatttaagagaggttaaggttatagtcgtacgaatgcacgacttaataagatagttttagtgagagtatcttggttctttcttgtgtgtgtcaactttatcctacctatgaattgattaacccctacctacactttggtttatgcaagtaatatataaattattagcatggtactctcttgtcatatcttggattaaataaatacgatacattggattacttctgggtgaaatgctacaatgctatatccatgcgcttgcggattatatctgtaaccataaatataccgagaatacttcagcgccattgctgggaattatatttctagtaatgtcattaagaaatattaacagtggctctaacattcttcagactgaaaggcattgtgatgtaacaatactctccgaacggggtgataaacgaggtctccaagcggtcagactctttcatgctgatttgatgatatcccaaatagcagtcgtgaaagctgagaaggtcgctgatggccgtcgaatcgacgacttgatcaatgtgaggtaatccaaagggatcttggaggcaatacttgttgagatccgtgtagttcatgcatatacaccattgtcccatcttcttcagaactagaacagggttagctagccagttgggatggtaaacatccttgatgaatctagctgccagaagcttactctgttctttcttcatagcgtctctttgatcttgtgcgaataggtggagtcgttgtttgatatgctttgcgtcagtcttcacatttaatgagtgctcaatcacctctctaggaataccaagtatatcagaaggtttccaagcaaatatatctttactatcttaaagaaagatgatgagtgtgttttcctatttacaatttagctcggcaccaattatggtagtcttggagggattggcttgatcaagtgggatcttctttgtcttggcatcactttctcttgacttcagtatcttcttggcaggcaattcaccttcatgtgatgttgatgcaacgagtcagacctcttgctggtcgagtgccctcccatgagattgggtcatctcgcagctctccttgtcggaggtgacggcttgtttgacgtcgctacgcaatgagataactcgttgtgacttggcatcttcaacatcaagtaggtgtagtaggggacgacaacgaacttagctagagctggccttcccagtatggcataataagctgcctcaaaatcagcaacttcaaagcagatattctgtctggaaattattccgagtccgaaggtgactggaaggctgatctggccgagtagcattgaggatatcatagggacaaccctatgaaacggagcagaactcgacttcatcttggatcttggaatctgcatcttatccagtgtcttggtgaacaggatattgagcgcgctgccaccgtcgatgaggacacgcttcaacttaacattatgaaccactagatcttgtaccaggatgtaccactccgggtgagccactcggccaagatgatccgagcggtcgaacatcattgctacctcggaccaccataaatattggggtacttctggctagatggtgttgatctccctatcggtcgacttctgcttccttttggattcgtaggcgggtgggcctccgaagatgtggtttcactcggtcctgggatcttggaaggcccttctccgttgtttttattttgcccagaagttccttcgccattggtgatcttgagttgcgctttttgtgcttgtcgcagtcattggccacctgtgctttgagttcgggtgatttaggcattgcccattcataaccttatcgcagtggttgggacgacgttgtgattgctaattagatgttgtggccaccaagtcttcaggtttgtgcttgcgatccttctggttgttgagttattattcttctaggggcgccaatagctacccgactacttttcctcctatgatgcattgacagtgtccactgccttggcgtaggagttggtagtctcaaatagcttcatgactattcacgaaggcttgcgattgaacttgccaataagtaacttgtctcgaatgcctttttggaaagtagcggtgataacatcgtcagtgaccttcgggatcttgttgcgggcctccgagaaatgtcagatgtagtccaaaagagacatattggaacaacatggtataggtcaaagtgagtactgcgtctctcgtaggtgccttggaagttgacgatgaactagcttcaaagctctcttcaggaatcaatggatcgccttggaagccccattagccagctccttgttgaatcagcgagtgccataggtaggtaattcgccagtgccttgttgtctcctcctactgcacaaatggccagggtttagacggtcttgccatcgtacttttcaatccctcttgatttgaaaccagtcggccaatccactcgatacagatctcaagtaaaagctaggattcctttgtcatcgtagttgatccttacggtgagagcaattttcccgatcgtgatgacgttggttcagcgtaatcctcaagtatttgggtattcaacgtctgtgtccttcgtcatggtctcggtcgtcgtgatggctcgacattgtcatgattgatctggatgccgacctctgttttcttggtgatgctagatggaagcggtgtgacctctgctatattcaggttttatgtggcccctggatctatgattcgagggctaatgacagccaaccagagtcctgggggagtcagcattggattctttcggtcggcgagaagctccggcatcattttcttgttgggctgcagtggcgacgatcatagtcttgaccttattcaacatcaaagtcatgttttctggagctttgtcgatgtgggtgtcaatcaacgtgacggccaccacagcgttctattgaggtgtagcgaaaacattactgtcttctatgcgggtttggatgatgttgtgtgcaatgtgaccgcttctaatcagatcctgctgccttcactagcgttcctcctcagctttggcacgtgcttcctcttgatccctcgtgatgccggcttgctcgtctttgtctgtggtgccaccgacaatgaagacttcgaagaaaaactaaagctcaaattcggaagtcgttgtagctactgagactatcaatgtcgaagtcgttgtagccatctaaaaaactaaagctgttgacaactttcgtggtgctatgtcgcgcccgaaaatcaccctaaaattttatcgtctaaattatttatgtaaaataggtgattccccacgctttgctgcgggaattacaattcttaatttttttttgtcaatcaagtttggagtaaaaagaaaaaaataatgaaacatcaggatttatcagtcaaatggaacccgtgctttagagtgaaacatattgataagtatagatagatttgttaaaatattgtgcaaatgatatgagaggtgatgattagatatgcttgtattttgatttgtaaaattaaataaattgtagatgatgttgtatgcttacatgagattaaatatgtaattattactagtgggtgatgatgtgttatggttgcatgttgagttttagacttagtgggctttaacttcaacaattaaaaattaccatgtttcaactcaaattgatgtgtgggtatttttgttgaattcctcatgcttcaaaatatttaaacaacttttacttgaattttacataataaataattttaatgcaacaataacctttctcagattttattaaaaaaagaaaaactaaaataaatctcgtcgcccttcttgcgaaaatacattacgttgggcgaccggcgcggggg

SEQ ID NO: 69977 - DNA, 1530 bp, Oryza sativa
cgcgcgcccctcccccacgtgcgtactgttgggcccacccacttctccctccctttttccacaaaagatatttcacctaatgtacttccaatgtttcactctttatagatctaatgttgcagtgaattaaaatattcttttgcaaaaaaaaaacccacatattttggaaaatctctattaagggaatttggtttattttttgttccaccaaaaatgtttcacctagtgtactcacaatgtttcactatgtatagatctaatgttgtagtgaatgaaacattccattgcaacaagaaacccacatattttgaaagcccctattaagggaatttggtttatgttttgttccactgaaaaatgtttcacctagtgtactcacaatgtttcactatgtatagattgaggtgtagcgaaaacattagtgtcttctatgcgggtttggatgatgttgtgtgcaatgtgaccgcttctaatcagatcgtgctgccttcactagcgttcctcctcagctttggcacgtgcttcctcttgctccctagtgatgccggtttgctcgtctttctctgtggtgccaccgacaatgaagactttgaagaaaaactaaagctcaaattcggaagtcgttgtagctactgagactatcaatgtcgaagtcgttgtagccatctaaaaaactaaagttgttgacaacttccgtggtgctatgtcgcacccgaaaatcaccctaaaattgcagtgaactgaaacattctttcgctatttgctgaaacattgtttttatataaggtgaaacaacacccgatttaaacgtgtgaaacattttcgatctacttagtgaaacaattccgatatacctagtggaacatcgtgcaacatttaaaaataattcaataataatctaaattttttttgtcagaatatatctatgtgaggtcttgttttgaagatttaattgcaacaaatttaatggtgcaatcatatcatgatttagataagtaatttaagagaaaaattagtttaaagaaatttttcacgtaagtcgatggcgtcagcgtccgattttaccccctcccgatcgggcacccgaccgggagtcgtctcccccttcttgggccattttcggctcaaattcctcccctctccccctcggcttaaattcctcccctccctctctttcccatcctttctcggcccggcccagccgccccctccccggcccagccgagccactgctcctgctgcaggcgacgctgccacgccgcacatgcgatgcacgcgcgcaccgtcatgggtcccgctcgtcaggagcatctcctacctccaagccaggctattcctctctctcccatgaaactcaacactcccgcctcctttgatctccctcccctatcgttccgcctccaaattaattgcaaatctatttcttgtgtagcgggcatcaattcccctaacaaatcccattcaatctcgtattaaatcgcactcaatcgaattctttaactgatggactaaattgggagactcactgcc

SEQ ID NO: 69978 - DNA, 13025 bp, Oryza sativa
  unsure (1)..(13025): unsure at all n locations
tcgccgtcgttgtttcctcaccgttccagccgtttgggtgagcctcgccgccgccctcgcatctctcgtgtcgcgcaccgctgcaccatgaccgatagccggggttgccggctgccatgtcctgacacacctctctctccctctctactgtttccccctctctgctgttacaggcagcaagcacacacagtagtttttctttacaaaattaattcataaattagtaaaatgccaagcaaacaacacctagaatttaaatgaccatatattgactgtttgaattcagaaccgatctattcatattgctattgttttccttaaacagtgatgaacccatttttagggttattactgcatcttatatggtttttatttatgttttgggcctttttcgttgcatatattgtatagatgctgcatatctggaagagccgctctaccttgaagtggatctagaagattttggtagtgagcaaggcaaatcatgtcattttgatcatattgttgtcccaatttataaaattatgtttatctaaattattgcattttgctttattaaattccgacgcttatctttgttttgtttagccctacagattctccttgttatagccttattatttgtattattatgatccttgataactctaggaaaaataaaactagtcataacattatatatgtggtgcttactagtaaatttaggaatatgcttagcgctgcttaaatagaaacaattagatgttttccaataattacaaattgggaataacttgtaaagaatggtaaatatggttcagtggttgtttatccatgacatgatgttccccttcaaaattccccaaacatattttgggttgggctcagggtgcttggtttcgctagtcgcaccctggccgtcattaggacaggtcttcgaacctccgttgcaaagcatatgctgtacagccacctgtctgatgggtagggcttaacgcatcatctagtacggtcatgtacaaggaagacacggatagggatggatgaagcccttggtggggtcgatgactctggcagtacgccagggggcatagactgtctgctcgacccagggcacctggtgggggaagtctatatcagtcttctttgtttagggcggtactaagaggtgggttatgtcatgtcttatgtccgtatgccgtggtggcatgtggcacatggcaacatgtgagaaagatgtgttgcaatatacccaagttagaatttagttctattaattgcgtaattggagttgtcagttgttggcacgagttaaggcaagatcgcattggtgtgcggcttgaaaataatttgactagagataggtttgtgttttatttaaatgcctttaaatatttaaatgctttgaaatgctagttttatgcaaaaaaaatccttaaaaatgaattctttgtactcccttgcattatatctgcattttcatgacatggcttgctgagtacggtggttgtacatagccttgctcttttccccccttctagcagaggagtacttcggatatgatggctttgatgtctagctcgtgcctgccgtcaagcgcctgtggtgactctcgtagcttctggctttttactgtttatctttcattgttgggcttttggtcgcccatgtaataaagtactctatttaagctttcgcttatatactctattatttaccaactttgtaatgtgtaccttgcctccttggacaaggatttatgcactcacaaacggaatatattgttctattttccgggcatgacatgctatattatccaagtgattcgatcatgattcccgcctccctagttctgatctcgggtggacttgggacttggccgggtcgtgaccttggagaggaggttgatcatcccgaaagtcatggcgaggagcggagggagttgcatggcactcttgggatgctgcattgttggataggctgtgaagatttgttgatgatgacgattccctcagtggtttgaagccaactcagaggtgagaatccttgagtagatctcggcagtgttcggggcactgaacgaggccaaagagatggggtccctccctgattggttcaaatccgagtcgagtagagagatcttgacaaagtcatcggtgatgaagtcgatgtcaccgaattgatatgcctagcccggatggaaagcggagtcgccggctctcagaattaatccgattgcacttgtttgcgaaaaactctacgcaacccctaccttgcttgccaactattgattctagaaatcaacaatgagaaagggggacgagatctaaagtggatgagtaaaataacaaacgtttatacaggttcaagccttcttgatgaaaactaataccgtactcttgtttcgaggattgaatccaccgggtgttgtattgatctgatgatcgagttgtggttatgcccttaagagcatctccaacaacctctccatcctactctccaagctaaattttagcaactttggacaaaaaaaatgcactccaatagaatggctatccccctagccaaaaaatagcaatggccaaagatagggtcaagctagctaaatttggccagccgttggccatccacagcaactagctatctgtgggccccaccatctttttcccttctatctctccaccatccgcacatccctgcccgtgccctcccttcctccgcctattgctgccacgcccctccttcctcctcccatgcctaccgccgccacgggaaggaggctcgccgtcgcagccggcaaggagtgcctcggcttcatcgccggcgacaagatgggagaccagcagtgaagagggccaccgctgtgcgcctcctctcaatcccgctacttcatgggcaccgaggtgaggaccctctcccgctactccggtgactggagattcactgtatccacctccgacctcccctccagcctctcccccgccgccatctcctccctcgtccgacgacgctgtggaggccgtcctaatgctcctgtttggtgctgcaaggagggcgcgacagcaagagaggctcgacgacgcacgccggttgaggaggaggaggccggtgatctccatcatcatcgccatcgcaatctgttgtccaccatcaccatctgttgatcttcatgagagtatgaagcatggggaaaaggaaggaatatggggaagaagaaaggattgtagaggctgacatgtgggtcccactgtcatagattcagagtagagagggtgaatggagaggctgttggagcaaacatcaagttagacttgataaattagatggagagttggccaaatagacaaatggagagtgagatttgtgtcgacgggggatacccgtagactggataaagagggtattggggtacgctagtacgaggatctacgtaatatgacatcaagcaggcagaaaacaaagattatactagttcaggccccttgataggtaatagccctaatccagttgatatgggattatatgatggaaaccacagattacaaagggaatagtggaactcgacaataccgacaagatcgtagtcgagttgattcgactagatctcccggcgacttggctccgataagctccggcttcgtaggctgtggtggatgtgttggcagtaagattcgatcccttaggccctcccggggggtcccttttatatcgcaagtcaactggtctccaagtatgactcggagacatcgggcccggcacgatacaataacgacccagttctgtccgagtaggattccttccatctgtgaacttccataatgaatttccttaacttatgccgaaaacgtccgtatacgcgcaagtataccatatcgatatgtgacgtatatcgaagggtagagggtataccttacccgtaaccctaacagtagcccccgacttctgcttaaatgaactcgtgaaactgatcgcgacttctgatgtcgaggttgtcgttgttctcggtgtaaggaccgagagacaaggagtgatcgacaacgccgggtgaagctcaacggtcatgagtgaatttaaattgaagtccaaaaaactgccgcgcgtaacggacccagaaatttccggcggccatctctctcctttccttagaattcgcaccgtcggaggtgcgtctatttaagagagttttggggatccaagttgaagcccgcttgttgtgaaaaaactcaccagctttcaaacgtccctcgtcttctctgctcccacaaaaaaccctagctagctcatctcggtcctttctccggcgatccccggcggaaatggatcttgacaagtctacctccaccagcgcgtcgctgaagaagttgcaggaagatggcgcccttcccggtcgcgggaccgcggagagagaagtgggaggtactgaaccccagcctgtcctgggtcgcatggttgcgatcgaggactttattctctgtggttttcttcctccgccttctgaatttcttctcttggtcttgaatttctacggtgttttcttgctccacttgaaccccaattccatcgccttcttgagtatcttttcgcatctttgtgaggcctacattggggtagagccgtttcttgacctcttccgcttttactatgagttacgctggatggaacccaaaaaggtgtccgggtgtgttggtttccgactttgggatggcctgaagtcgcgatacatccccttccagtgcccctcatctcgcagcaaatggcgggggaggtggttctatcttcagatagaggattcggatccggtcttcgttgttcctgaggagcaaccaaacaagattccatcttgggccaccaaacccgccttgaccccatccctccaatctttcatcgatatcgttgacgacctccgagaacaggggttgtcggggtatgaagtcgctgccgacttcattggtaggcggatccagccgcttcaggctcgagaccatccggcctttgattattctgggccagaggacgcgacccgggtttctcctcggggtattttcctttttagttaaattgactcccttatgcgtgtgttcctcccggcttatcggattctggtctcgatctacaggctaggagcgccgcgtcagccaacttatgatcagtggcccgacaacggcgagcaacgtccccgtccccctttgcgagaaaggggcagccgagcacgacgttgccatcaatgtaagtgtactcagcggtccttttgcatttttcttccgggatcgcattatgacttcatgaagcgtaggctctccctctgactgatatcatcgagccacttgtggaccatctggtggcggcgtcgctgaaggagaaagtcgccaaggaggcgtctgacgctgctgctgccgctgccataacgagcggcggcaacgttccgaaaaaggggaggacattctcctctgtggtcagacatcgtcggaagacgtccaccccctcggtaagttctcctgccctttgatcgcgtagtcggaaagcttctacctcacatcatatcggttgtactccaggcctcggatgcatctcccacacctccacgacggcagtggctagtgacgcttggcgagaagtaagtggttgactttgaggtcttgtcactttgtcaaactgttgcagcctgtttcagttgcagctttacgcagggcggcgcggccaaaggcggcgcaagatgggtctagagggacctccaacgcgtctcctgtcgtggtcgcgcctaggagccgcgaggcgacacctaacggcctagctagcgatcttgcggctggtcggggtctgccggctgccgttctcacctgggaggagctccaggtcgagatggggtgcctcctcgaggctggtgctcgtggcattggccacgagatcacggaggtgaaggcggcggcggcgtcgtcggcgaatgagcgtgctgatcggcttgcgcgcgatttagcggaggttcgcgaggacctccataagatgcgggagctggtggctggcaatgagcgacaacggcaagggctcaagcaccgtatgtctgagcttgagaaccatttgtcagagatccgtggctcactgcaggtcacctacaccggcatgcaccagctcgccgggtagtgtggtgtcaaggccaccatcccgacgaatcccaacgagttctcgttgtcgtcttcgcttgcggaactggcaacggcgatggaggtgatcccctccaagcacgcggccatggtcggagaggagacgtccaacgggatctataccggggcgtgccatgtccttgcgtgtgtgaggctggcgcatcctgaactcgatctgcggaagatcttggatcagggggcggctagcgatgcgcgcaaggatgtgatggaggaggtcggcgacctgggggagtccgtcctcccgctttttgaagagtaggatcttagctctcttgtactctttagccatgctttgtaaaactcttattggttcaaaccacctttgtgtgtgcagtattttgatcttgagtactttgttgtcatttgtagagatgttgatgtcgaggatgtccagcagcgcgggcagcctgagttgccagtggtcgttccgttacttgcgtccgagccacatgtgccggagggcgatgtagctcaaaattcgcctgtggagatgagcatggcaacggctcccttaggttggttatctttgttttcatccactttactcttccgtccggatcgacttgattcgctgtattcttggaagagaagagcagtctaacttagtcgtttccatactaagtagacctcgagagtgcgcttgctgaccaggatcgtcgcatccagtattggaggacgaagtttgaggtcgcggaactcgagaggactatgttggaagtgaggaaggactaggccgtggagacactccgtggtcgcgaggtgtggttcaactcgtatctgaagagttgctgtacctccatgtcaagagtctttagagagcttcgagtaccccgtggggatcccgaggaatcggcggctggatacatctcgtggctgaatggggcctgcgcccagctcgagggcatcggccagcatatcgacgaggccctgaagcaggagtgtcgtcgatcgagctgatatgccggggggcatgtattggcttgtatacgagatcatcgtccgcagctgcacctcgagttcctccacgaagggttttctcgctctcggagaactcctacggagatagatggcctagcgaagtcgatggcgccgctggcggaaaaggtcttccagtctatggactggcgttggccttcctggtagtctccgtgtcctatgacaaatgtcttaggggaaaagtgtaatataattttggatttttatggaactgtaagaagtacttgtaaaatagaaaagaaatctatctaactaagctttcttactctggatgtagcgtgtatgagtgtcttctcacttcgtgactttgattagttgtttgagttatacactctccctagcccccagcctttgacctgcctcggttgaacaagcactgatcctagcccccagccatgaagttacaaaatttatttccgattacacgacttggttaatacgcacggcgagaactcttacacgaccagatcttacatggtctgtcgtctctacaggatccgataaggccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtagtctgtacctgaaaataggctttattgaagttgtaagatgtcttacaagtatggatactattgacttatacatagaatttacgtaattgatcaatgttctaggaatttgccaactcgcgactatcgccgtctgcaattttgaatgcgcccggccgcagaacttgtgtgatcgtgtacggtccttcccatttgggtgagagcttgtttccccctgcttggctttgaacccgtcggaggacgtagtcgccgatcgaaagcgtgcgtgctcggatgcgcttctcatggtaacggcgaagggcctgttggtagctggctgctcgaacggcaactcgttcgcgatgttcctcgagtagattcacatcatcgtatcgctgctcctcttgatcctcatcggaatacttctgtactcgtgtactttgatgttgtagctcggtggggagcatcgcctctgagccgtacacgaggaagaagggtgtctccttgttggatgttgtcggtgtggtacgcacggcccatagtactgatggaagatcctcgacccacttcttgtcgtgtgacatgagcctgtcgtagacgcgggtcttggattccttgtagtactatgccgtttgctctctcgacttgttcattgctctgagggtgagaaaccgaggcatagcatatcttgactcccagcctgatgcagtaatcctggaaatcggcactgatgaactaggagccgttgtctgttatgatacggtggggcaatccgaatctgcagaatattcctttgatgaatttgatggtgttgtcggccttgatttcccccgtgggtgtcgcttcaatccacttggtgaatttgtcgatcaccacgaataggaacctgtagctaccctgtcctcgtgggaatggcccgagtatatctagcccccagcacgagaacggtcaagtgagagggatagtctagagtgcttgcgctggcagctttgtgtgtttactgtggaattgacaggcttcacaccgctgaaccatgtcacaggcgtctttgagggcggttggccagaaaaacccttgtcggaaagcttttctgactaatgtccgaccggcggcatgtgacccacagatcccttcatgtatgtcgaggaggaggtgtctgccatcgtcggacgagacgcattttaggagtaccctgtttggtgccttcttgtatagatcgttgccgatcatacagtagacttttgctttacgggatattttctcggcttctgcgtcgtcctcgggcaactcttcgctatctatgaatttaatgagtggggtgcgccagtcgtccgtggtctcgagatcggcaatggcgtgctctgcctctgtagcccccgagctgatgttgggggcgaccgggctatcttcgccgcttgcctctttcactgatggcctggtcaggacgtccagaaaggtgccaggttcgaatggctctcgtctggatgcatgctgtgctagatcatctggttcgatgttgtctttgcggtatacatgtcggacctcgatcctatcgaaccttttcttcaacttcctaacttctgcgagatacctggataactcggggctagagcacttgtaatctttatgcacctggttcgcgactagttcagaatcccctttcacgatcagtcgagtgcagctgcagctcttatcctggcgagtagtccttcgtactcggctatgttattggtcgccctaaagttgaggtgaattgcatgcttgaattgatctcccaaaggtgatgtcaagatgaatcctgcccctgctccttggctgttgagtgcgccgtcgaacgccattgtccacgtttcgttgtcgatttggttgtctgacctgttatcaggcatagtccaatcggctacgaagtcggcaagtacctgggacttgnnnnnnnnnnnnnnnnnnnnnnnnnnntcaaactggcttagctcgactacccatttcgcaatgcggccgacaacgtctttgtttctcactacttcaccgagagggaaggaggatacaactgtgaccctgtgggcttgaaagtagtggcatagctntcttgatgtcatgattaccgcgcaaagcagtttttggatctatggatatcttgtctttgcgtcgtggagagcttcgctgacatagtagactggtcgttgcaccttctctctctcgacaacaatgacagtgctaacgaaatatggcgtggcggcaatatagagaaataattcttcattaggttggggggcaacaagtacaggtggatttgataggtagcacttgagtgcaatgaatgcctcttcggcttcctgtgtccatcaaaatttgtcttgctttttcagcagagcgaagaaaggttgtcctcaccctcccatcctagcgacgaacctacgtagtgccaccatgcatccggttaacttctgtacttccttgagtcttgtaggcgacttcatgttcttgattgccttgatcttctcgggatttgcttctattcctctaccagagacgaggaagccgagtagcttgcccgatggtactccgaacgtgcacttctctggattgagcatgaggcgatatcgtcggaggttgttatacgtttcccgcagatcgtcaatcaatgagtcacttgtcttggtcttgacaacaatgttgtcgacgtaggcctcgacattgtttctgagttggtcgctaagtgcgccctggaccatgtgctggaaagtgtttcctgcggttattagtccgaatggcatcttaacgtagcagaataccccgaacggcgtgatgattgttgtcttctcctcgtcctctttcgccatgctgatttggtggtagccagagcaagcgtcgagaaagctcaacaactcacaaccggctattgagtccaccaattgatctattcgaggaagagggaagtgatccttgggacacgccttgatgagatcggtgaaatcgacacacattctccatttcccgttggccttccgcaccatgactgggttggctagccactctggatggagtacctctctgatgaaaccggctttgagaagcttgtcgagttcttctcgtatggcttgttttcgatctggtgcaaatctccgcagtttttgctttactggcttggcatcgggtcgcaccatgagtttgtgctcaatcacctccctgggtacccccagcatgtcggacggctgccaagagaacacgtcagcattgtcgcggaggaaggtgatgagcgcgagttcctatttctcgcctagtgatgctccgatcttgacgatcttgtcggggttggtactggagagtggaacgatcttgattgtgccgtccggtttcggcgtcttgtttgttttgctcactttcttgggtggttcagctgtggcaggtgggctaggcgtgtgcttgaccatgtcgaggctctacttgtcgcattgcactgccagcttagcattcccttgaatagtgattgttcccttcggtcccgacatcttgagtacttgatacgcatagtgagatgcggccatgaactttgcgagtgcagttctcccaatgatggcactgtatgctgtatcgaattcagcgacatcaaaggtgatctgttccgttcggaagttgtttgcttggctgaaagtcacaggcaacgtaattttgcccaatggtttggacgatgactgaggagtgatttcatggaagggttgattggtaggtgtcaactcgcttcgtgggatcctaatcgcgtccaaggtgctggcgaagagaaggttgattgagctgccgccgtcgatcagaactcgtgcgaccttgatattacgaatagtgggttcgaccacgatcggatattgccctgggatgacagcagtcctggggtggtcctcttctgagaattctatcttctgctcggaccacttcatcttgggcgcagccccctgccacatctaacagacttcacgttccaccttcttgtattctcgctttgaggagtacgccgtggaacctccgaagatgtgcgagacatggagatcggagtctggatatgctgagtctgattcctgagtaaccgcctcagcgtccttctcaaccacaagtactcgcttgccttttaccaatgccatgtgttttgcgagcgactttttgaagacgaggcaatcttctagagagtgtctgtctgacatgtgtatagggcaccatattttcttcgcgtcgctgccttgtgggtctgggcgcttgggagggtccgcgtattctgttgcgagaacttccgattgagctttccttttcctactcttgtgattcttcttcttgcttgacttaggtgcgtccttggctggtttcttctctcctctggtcttcggtttgtcgttcttgtgtctcagtgcgtcgtccgcatgagcgcatcgatcgacaatttctaataatctcctagtagtcgtgacgtgcctcgttgccaactcctgagtagtatagcgatctctgataccggacttgaaagcgcgaattacagaagcatcggtgataccggggattgtgtttctgcactcgttaaagcgccgaacataatccctcaaggattcactcgggttctgtgtcaatgcatgtaggtcgtcttcgatcgcgtggcgcttgtaagttccttcgaagttggctacgaactgctgccacaggtctgcccacgaagagatcgagtaggggaggagatgcatcagccatgaacgtgcagagcctttcaatgcggttggcaagtaattcgccaacacgttgccgtccgctccagcagcgtagagtaccgtagagtaaacctgaaggaattcttcaggatcggtactcccatcatatttctctattgttcctagtcggaatctttcaggccatcggacatctcgaagtgaacgaccgaaagctctacacccagcgctgggcacggtgggttgtcggcgatcgtatgtccttcgtggatgtctatctgatgatgaggatgaggaggatgacgatgatgacgatgggtcgcttggttccggcgcacgattacgaggacgtcggtcgggttctcgagaatcctgttgtcgtcgcctgttgtgtctcagtgccgatctccatcatcgtcgtcattatggcgacgtcctcgaccagtatcgcccagcccccgccgttcgtgatcgtcgtgatcgcggcggttgtggcggttatcatggcctcggtctttgctcaaacggcctcctcgatct

SEQ ID NO: 69979 - DNA, 6611 bp, Oryza sativa
ctatgaagagacgcaatgtcgagaatggttctcgttgtctcgtgtgcgtcgcgcctctcggcagccattcaggtgatcgcggagatcgccggtgccgcgaggtggaggggtggctcgatgaggcgattcccgccgttcagggttttcaccattagcatcgccagttggtggctgttccgggtgcgccgcagcagcggcctcttcgaacgcgttgctgaggttggtcactaactctcgtaaccattctgtccatcgtgcgagatcgtcgttcagaacggggttgtaggaagtttccctcagtattgtattgacggctctgatgtgctaggccggtgtagtcacttgattctccgcttccgcattggtgcgtgctgacgtgccgacatcgtcgatagccaatacctcacgcggcgtactcgttgttgatgaaccatagccttcgagcaggtgcaagactgatggttcgtggggatcgatgtcgattacccaacaaatcgatctgaaatcggcgtcgctccttgttccttgtcctcatccctaagggggatgcatgactgctggaccttagtatgtggtgtcttcatggcgctgaaaagaccttgcagctcgagaggttgtgattctttgtcttgtaaataggacaaaagacatcacgagttggagaggtacgctgaattccacgctctttgcaggcacgaatttcagcatggacgttcagaaaaacccaacaggcttgcaaggtgtgttttctggttttgtggataggacaccaggaccttgtcacctcggaagtaatcctcgtcggctcgtgattcctgtcggaaagacaaggcttggccgcactagaatccttctcgggctcggatgtcgtcgaagtttcgatttccacttcggcgggaggatccttcgacatggagtcgtcccgggttgtacccactgcgttctcatttccggccattggcggaccagctgagattggcactgtggtgtaaaccggaaagacgatttacccgacttgagtccacaccagtgttgttgaagtaggaactccttggttgaggttggtgttgacgctgttgtcgacgaagctggatgtcatagtagtagaaccttgagcaccaagtccccctacctggcgcgccaatatcaacgggggatacccgtagactggatatagagggcattagggtacgctggaacgagtctctacgtaatacgacatcaagcaggcagaaaacaaagattatactggttcaggccccttgataggtaatagccttaatccagttgatacgggataatatgatggaaaaaacatattacaaagggaatagtggaactcggcgataccgacaagatcgtagtcgagttgattcgactagatctcccggcgacttggctccgataagctcttgcttcgtaggctgtggtggatgtgttgccagtaagattcgatcccttaggccctcccggggggtcccttttatatcgcaggtcaactggtctccaagtaggactcggagacatcgggcccggcacgatacaatgacgacccagttctgtccgagtaggattccttccatctatgaacttgcataatgaatttccttaacttatgccgaaaacatccgtatacgcgcaagtataccatatcgatatgtgacgtatatcgaagggtagagggtatatcttacccgtaaccctgacaatttggagagactgttagagatgctctagggactccatgtcttccttatatagcttcaggggcaaggatataaaggagagaacccaattggacacgacttggttccattatacatttacataattgtatgctacaaaacgtatggtacatgtcttgggaaacacgacaatgtaatttccaaagcttagtctatttacataatatacgtatatggcccaccacctatctcccgtcagagatgctgtccacatgggtatatggtacctataatcttcaaagggcacaatggaggtaatcagctaatcaacaatgctctatgttcctcaaccaagtcgaaaacattagaaacaacaattaacatacacaataatagaattcagtaagaaaaaaaaacatcatttgatcagcaagcataagttgttttaacagagaactttttgctgcagaagttgattaggtcctctagaattggaccaaaaagatcaatcagcatgatattgtacttctcctctccaaacaactacacatgaggacttccagctgaaatttataaccaaaacataaataaaatgagtgaacaaatttatttgaattggtaaacattttttgttaggcaggatgccagtctctttgttcaccttttggaaactagtaatttgctcgtactaacgctacggtgacatttaataaaataattagccaaccaaaaatatatacaatgcatgctttagtgattaagactataatgcgcaatatagttttaagatcacgcaaaagaaaagaaagagaattagattgttcaaacatttatcaatatgatatatatacataaataggtccaaagtacacgtgttcggtacaatacataaatacctttcatcagtagtaaaacacattgtctgctaaggcaacatgttgcgcatacaccatcatccattagagcagacatggtcagtacatggctagttgttatgtaacttaagacatgttgatcttcaggatgcgtttgcacagcctcacagatttaggagaaaacatattcgtagatcttaaagcgcaaaggaggtcaacaaaatttaattggttctatgacaataatctaacatccacaacactataagaagtgatttctaaatggtatgagtaggttggtgcacagggccatcgaaggccatgcgcgagcacagtggccgcacatggctcccaatttttgagggggcccacctcggagtaggcctacagcctggcttgaattcagcggcccataagtgaggaggcaaggagttaggaactatgctagacgcaaacgagttacagccaattattacagagtaactgtttagtgttcactcacggagagacgcgagttgctgcgtgtgtgcagcacaggcggcagcgacagcatcacgcctcacggcagcaggcagcacatcgctgatgttgccgagcggagcaacgggaaacgacgagcggcgcgctgacacagagcagcgccgaggccgcgaggcccagctctagttggaaacctggaatcgataatttactttgaatcaaggctaatgaaattacactgttacagtattttcaatgatccatcattccattggattgataattattgaatcaaaagtaatgtgaacgtcttcactttttttataaaacaggaagacctcaaatcctcgccagatgatgcttctcactggaatattagatcagtactacctttactcttttaccattaatatttgaaaatatatttctatatatcgtagaaaataacacattaaagttatataattaactaaaaataacatattatttttcaaaatttagggtctcaatttgcattcgttccggggcacccaaatcctagagacggccctgttggtgcagtagtgcgtaagatgcaacttaaaccttgaagcccatgattttcaccctttggctctagaaactctagctctgaattgtcatcatccactgagatgaagagtattatctgaacattgtagtattatacccgaaggaaatgaaaaaaatgtttttttccaatgtaccggatgcacgcaaagcaatattaaataatagcaactacaattatttttttctccgagtctaaccctaccaatgttgagaaaaatagtaagggcaaaatatataaaaggtacagaaaaaaatatctagtgtcagaagttccgtgagaaacatgcttgacccttttgtatttcacaccataattttatataggctcctaaaacacaattcggatatcaagttaatcaaacaaaatgtagtatacatgaaaaaaaatcattctacattaaatttaattgtcaaaacgtgacataatatttaccctgcgatattcatctatcatctcatataactccagcattcaggtttgtaaggggcatctataaatttggtgaaggaacctatcaaagttcatcactcagctagttacagttcttataagtgagtttcgtgttgaacatgtaacggttttccgattgcaaaaaaaaaaacagagagaacttgcagaaagcaagttgagatttcattaaaaaaaagagttcaatggttgggagtagagaagaaaataaagcttaaaaatgttaatgtaattgttgaaattataagcacataatgatttaatttcttccataaataaatcatgacattgcagatgtaaacaagcatgaacgcatcattagatgcaaagtgcataatgatgcaaagtatttcagaaagtataatgatgcaatacggttgtttatcagccaagtgcataatgatgcaaagtatttcagaaatcatatacagtatttcaactcccatttatcattcacgagccttggagttacccttgaccaacgagtcagcactgtagtgggaactggtgtgtatacatttcgtgtgcacggtgcattgtaccatcgcctggataatttggttccaggttctcaagggccgcgccatatgcagctttacttttatgatacagaagatgctgatgcactagcccatagggttcgcaggtctcctgaccttgatatcaaccttgttcgggtcattgtacgtattttggcgcaaaagccgtacgtacagaccttcagcagagttggatccatgcccaatatagatgactacatgattgagctcaacactaatgtaacgcctgaccaacgaagatggggatgatccaatgagaacttttgatagacaagtcttggtacatgcaaaaggtgataagccctgttacatcaaagcataccatggttgttatgaccctttagcgtatcctttatttaaccctaatggggagactgggtggaacctgaaaatgccgtacaacgatcccaaccagattctgcgtgatgtggaaatggatgaacagtgtgacatcatctttaggtgatgtacgtaccaacgaagaaagcacttttgatgatcttccaggtacgtacactcgtggcttttgtcgaataatttctaaactttatgtccttatccattgtttatgtatattattatgtaagtttggacgcagagaacgaggttgtcgacaattatctagacaatgaagatgataatgatgatagtagtaaatccggcaaaagggaaaaaggacaagtttgtcacagcgagggagtactattgcttcaggctgcaggttagaaggtgatgcggacatcactacctcggatacacatagcaatcctcctacggtcattcaaggaccgataacaagagctcgtgcgtgacaattgaatttagaggtgagctcgttcctatgttcttctttgtatgaattcgagaatagattgctacctaatgattatattgtgattaggaacaatggaggggacaaggagacacttggggaaggacttagagccatggatgatcatcgaggacgtccaagtcaaggtggaggcccaaaccaattcgacctcgggtgcaattcggagtctaggaccagtctgcactaaaacgggcgcccaggtcgcatatgtgctcggattagggcgttctttatatatatggaaagctaagaacataacctttccaatggttttggtcccacatccaaattcttcccgagtcaatgggaattgatcgaacaagttgacgtccagaatttgtcccggtgctgcgtcaccgtatttgggcttttggcccgtgtatcgtgttggaacccattagggttgtgtcgagagggggttgcacaagcctaaactctatatatcagtacccaccgccatctttaggtttttgggttttgcttagattattctttcaagaacagtttcgccgctagatcggtttgtaagaccccaatttgtgagcttaatcattcatctgcaattttggttgttttctatctcgttcttgtttgtattctttgattggcaaacaaggattagccttctcggcgaggtcatccgcgtttcgacacgggtgataactagaggagacatggtgctgcgattgcggggctcaagagcatgcgcgttcaagaagccggatcgatttgtgttgcgactccgcccaaatcgttgtttatcagaacctctcggaagatcgggaaccctagtgcacatcaggaggggacttctaaacatcattttgttcggaggatgacttttccaacaatgggctattgatatgtacatcaaaatcgagtctatgaggcttgattggtactcaaaacctgagaagcaaaaaaagattcaggctgagctataccaggtaaatggtgtaacatatttccacaactattgacactgtctcccatctgtgattcaacataccagttatttgatcatggtgttatttaatgattgcagggcgtggttgatgtgctttcttctggagagaagcggttccgcagttggtaaga

SEQ ID NO: 69980 - DNA, 35043 bp, Oryza sativa
  unsure (1)..(35043): unsure at all n locations
actgtcacatcaatgttgaggcttgtgcaagcatcaaatctgtgaagtacctctataagtatgtgtataaaggacacgactgtgcatctttctcggttgatccaactggggaaataaacgagatacaacagtacagaaatgccagatacgtgacaccaccagaggctatatataggatgcttggtttcccactgttcggtatctatccagctgttctgcagctccaacttcatcttcctaacatgcagtatgtcacgtataatgaggatggtaatcttgaggatgttgtaaatcgtccatcttctaccaggacaactcttacggagtatttcaaaatgaatcaagtagacccggaagcaaggaagctgctatacaaggagttccctgaactctaccgttggataaccggacagaatgtgtggcagaaaaggaaaatgaagagaggccaagttggacgggttgtgtacgctcaccctgcagaggtggagagatactacttgagagtgctcctcaaccacgtgcgaggtgcaacctcatttgaagatttgaggacagtgtcaggtacttcatactctacctttagagaggcatgcgagaagagagggcttgtggagacggataagtcacatgatgattgtttgaatgaggcatccactttccaaatgccatttgctttgcatcgattatttgcaaccatattggtattttgcgaagtcactgatatccgtgcactatgggacaatcacaaggatgcaatgtctgaagattatagccgagggaacactaaccctgcagtagtagagaagatggtgctacgagacatacatgatttgcttcattccatgggaaaggatatcacggagtatggtcttcccgaggtcattgatataggtattttttgttatactatcacgtcttttccttattaatttacatttgcaccacccaccaatagtttcatcatgcatatatttgttttcactaatcaggtgaacgttgcaacgacgtaatgacagagattatagaggaacttaacgtgctagtggatcaagaccatttagacatatacacatcccttaatgatgagcagcgtgcaagatttgatgagatcattgatcatgtaactaataaaaagagccaggtattttttatcgacggcccaggtggcactggcaaaacatttatgtacaaggcgtttcttgctagagtgcggtccaagggattaatagccattgcaactacgacgtcaggtatagcagcgtcgattatgcctggaggatgtaccgcacactcgagattcaaaatccctattaagattgctcacaatagcatgtgcaacttcacgaagcaaagtggcaccgcggaattgcttcacatgtcgtccttaattatttgggatgaagctgcaatgacgaagcgtcaagccgtagagacccttgataggtctcttcaagacattatgggttgttcattgccatttggaggaaagtttattgttttttgcagtgattttagacaggtacatcccgtggttacacgtgggacaagggcccagataactgatgcaacattacagatattgtatttatgggataatattaggaagatcagattgtcacgtaacatgagggctcaatctgatctattggtttcgggatatctcctttagaatnaggaaatggcactgaanacactatcagagatgattatgttcgcttgcctgatgaaattgtgattgcttatggggatagtgaggattcagtacacgaattgattaatcatgtgtttccctcgcttgaagatgaaaagaatgcaagctctgcatcttatatgagcacacgtgctattctatccactaaaaatgattatgtggacaagctgaatgcggatatgattgacagatttccagggcaggccaaggtttatcacagctttgactctgttgatgatgaccctcacaacagttatcctctggactaccttaactctatcactccaaatggtctcccaccacacgagctaatagtaaaaatcaattgtcccgtgattcttcttcgcaaccttgatccaaataatggattgtgcaacgggactagactaatggttagagcttttcaagataatgcaattgatgctgagattgttggtggacaacatgccagcaaaagggtgttcatcccacggatccctttgtctccctccgacgatatatctctacctttcaaattcaagaggaagcaattcccaatacgtctcaatttcgcaatgaccattaacaaatctcaaggacaaaccatcctaaatgttgggatctatcttccagagcccgtgttttcacatggtcagctatatgtcgcattgttaaggggtatgtcaaggctaacaacaaagattttggctaagccaaagaaagaagttgattcaacagggaagagcactagaaatatcgtgaataaaaacgttcttgactggtgaacaaagataggttcgcatgatctaaattaattcaaaaaaatattgaatatagtaaattgctcatcgaatgttactcaccatcgtcctcttgtttggtacagcacgccatcaccttttatatggaatgccgtgtgattatcttttacaaactatctcacactagatgcgtcagtttgcaccagactgtcatttgagattgtaaatatggtctgtattatataaagggatacatatgcttacaaaattgttctggattattatttttctatatggttcatccatacaacttaaatgaataatgcaccgtagacagcccgaaccaccgccattgccatcaccatccaccacatacagcctgcaccactaccatcaccatcaccaacgccgccgccgccgcttgctctgctgtttttttgggagaaaagacagagagggagaatagggctgacgagtgagccctacgctttttaatttttctcctatcacttacatgtgagcctcatcttgtaaagttttattgtgcccacgcaatatcatagtactgcaccttacatgaaatatattttatataggatatgaattgaattaaagttcaaatgcatcgatcatataaaaatattttttgctaacatgaaattctaaaaattattaaagacatatacaattgcaccgtagcgtttagcacgggcatgttactagttaaatttaattgtcaaaaggtgacataatatttaccctgcgatattcatctatcatctcatataactccagcattcagatttgtaaggggcactataaatttggtgaaggaacctatcaaagttcatctctcagctagttacagttcttataagtgagagttttgtgttgaacatgtaacggttttccgattgcaaaaaaaacagagagaacttgcaaaaagcaagttgagatttcattaaaaaaaagagttcaatggttgggagtagagaagaaaataaagcttacaaatgtgaatgcaattgttgaaattataagcacataatgatttaatttattccataaataaatcatgaaattgcagatgtaaactagcatgaacgcatcattagatctacacatgtaaactaagcagtaaaacatgaacagatcaaatatgcgcaacatgtcgaacacgtaccgaggtgatggaaagaccggttgctcggcaggaactactcgcggttgcgggcatcgacgagggcacgcagcacgcgagcggagaggaaggcgagccgtcgcggacgaacaggaagcagtcgcgcgaagcgcttcccaaaaaccttattaccgccttctcccggtgcaggacgtcgaaggcagaagttccggagacctgctctcccgattgccggtgcacgccagcgagcgagatggagtagtctacgagcgacggcgcagcatagagtaggaggcaaaccctagattgatttcgcgtgtgttgcgtgaagacggcggctcggtttacatagagataggtcgcttgatcagggcgcccgcacgatctccactccgcgtaaccgaacctgataagtcgctcataacctatccggactccatgccattttcacgcaccggattgtttggaatgtttccaaaacaaaacaaatctgaatcttccgcaacaaaacaaaactgcaaaaggagaaaaaaaacctgcgcaagggtgaggagccaatttgcggaccattcgacgcgtacgtcgtgcacgcgcgccgcctgccctgccaggccaggcgaggcgagcgagcgcgcgcatgtgttccccctcttctctccaccacacatgctttaagtggcaaggagggcatcctcccttttaaggaggtccccctttcctagaataagtaaggtggtactaaactccacatgcatgctatcctatgaggtgggcttttgtgattttccaaagaattaatcttcgagtgggccttagcccatccattaattccgacaatccccccaccaaatctcaaaatcccactgagatttgccttttccaatataatgtttatataccagcggttcgatggagaccaattatggttgaacatccatctagaactccaagctacacttactcacaacttgaacaatggactacgccttgaattgcaagtcttgtgcaagcaagtttcactcagagtcttacctggtactagatcgtctgtagactacccctcgggtggagcgtataagtcatactcctaggtctttagtaagcttcctagaagattcacccaaaatctccatagactgcgaccaacagtcaagctcacaaacgtgaattctttcaagaatgctttgcaggacagcaccttcgctaattaaagccagcagaactcattaaggcattgccaacctgccttgcagcaacgagagtacatgcatcttcacttagagagggtataaattggtactctcctctactttactaatggttagttcttcccaggttctaatccacgggatctccgatcacatagactgggttaccaccatagtataactcacatgggtctcaaacccatctccttcgatgcattgtctatcacgtttcgtgatagtcccttcgtgaagggatcttccaggtttctagctgtttggatgtaatccaacgttataactccggagtttctcaatttcttgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagctattctgcctcaacagtagcagtatctagtaccgtcagctctgtttccatggttgacctcgtcaaaatggtttgtttgcaagacctccacgaaacaacaccatacccagtgtgaagacatatccactagtggatttgatctcatccacatcagagatccagttagaatcagtataaccctccagtaccgcaggatacccagtatagtgaagccctaattccatagtacttttcagatagcgcattactcgctcaagcgcacaccagtgatcatctcccggattagaggtaaaccggctcaacttgctcgcagcaaaggatatatcaggcctagttgcactagccaggtacatcagcgagccaatgatttcggagtattccagttgatccctaccatttctcttgttcttgcgaagcaacaagctaggattataaagtgttggagaaggcttactatcaatgtagccaaagcaattcaagatcttctccacataatgggactgcaagagtgtaatcctattctcacctctaattagcttaatgtttaagataacatcagctactcccaaatccttcatatcaaaattttgagaaaagaatgatttaacctcatttatcacctcaaggtttgtcccaaatatcagtatgtcatcaacatacaaacacagaataactccctcacgcccaccatgacgatagtacacacatttatctgcctcattgactgtgaagcctgcagatgtcaatgttttgtcaaatttctcatgccattgcttatgagcttgtttcagaccatacaaagacttcaacaatttgcacaccttaccttcttgaccttcaactacaaacccatcaggttgatccatatagatctcctcatccagctctccattaagaaaagttgtcttaacgtccatttgatgaacgagaagaccatgtgaggctgctagggaaagtagcacatgaattgtgttcaatctagcagcaggtgagtaagtgtcaaagaaatcttcgccttctttctgagtatagtccttagcaacaagccgagccttgtacttttcgatagtaccgtcaggcctaagcttcttcttgaacacccacttgcaccccacatgtttacacccatagggtcgctctgtcacctcccaagtcccgttagcgataatggaatccatttcactacagacagcctccttccagtagtctgcatcaggagatgcatatgcttctgaaattgacttaggagtgtcatccacgaggtacacagtgaaatcatcaccaaaggacttagccgtcctttgtctcttactctttcgaggagcttcactgacatcctcctcagtgatatgttcatgtgtatgttcagtttgttctggtggtgtgattgaaatgggaattatttcaaagggttggctcgaaccactatgtgtatcattcatagggaaaaagctctcaaagaaggtagcatcacgagactccataattgtactaacatgcatgtcaggtacctcagatttaactattaaaaatctataggcaatgttgtgatgagcatataccagaaagacacagtccacagttttaggtccaagtttgtgcttcttcgttattggtacattgactttcgtcaagcacccccatatgcgcaaataagaaagtgatggttttctcccaatccatatctcatatggtgttttgtccttatttttgttaggaactctttttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcatttgagaaaaactctcaagcacgatcagacctaagtctttttatctttctgtcaagttgattttcaacatctaccttataaattttaaaatagtctagagcctcgtctttcgttttcaacaagtacacatagtaaaatctagtagcatcatcaatcaacgtcatgaaatatcgttttccacccttcgtcaacactccattcatttcacaaagatctgaatgtaggagttctagtggtgccaagtttctctcctcggcagccttgtgaggcttgcgaagttgcttcgattgcacacaactatggcacttagaacctttgacaatggaaatcttaggaattaaacacatgctggaaagtcgagacatcaagctaaaattaatatgacataaacgtgagtgccaaatattagcctcatcatccacactgccacaaatatgattcacagacttattgcagaaatcaaaaagggaaaagcggaacaggcatccgcactcataacctttaccaataaaatatccatgtttagacacgactactttattagactcaaaaaccaacttaaatccgtctctagtcagacgggagccactaacaagattcctgtcgatagaagggacatgttgcacgttcttcagctgcacgatctttcctgaagtaaacttcagatctaccatgccaacaccatgaacagaagcatgtgacccattcctcattaggacggtggaaccccgtgcgacctgataagaagaaaacaatgagatgtcagcacaaacatatacattggccccagtatcaacccaccaattaatagactgattaactgaaaaaacagtaggtaaattaccatacctgcttccatctccagtattgccaatggtcacattagcagacttagtctgccctgcaggtgccttcatccccttgcgttgtggatacttcctggccagatgaccaggttggccacacacaaagcaagtcctctcatcctgattaggattgttgttgttcttcttctccttcttgaagttggtggtctattgagctttgtatttccctttgctcttgttatgggccttgtgcacaacattggcactggacagcccaccatcgcccttagacgcagcatctttttcccaagctttctcctcaacatcaagagacgctatcaacccctcaacggagtattcttgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactatagaacggttgtcagccatcctgtagtcatgaaactactccatgatgtacagatcattgctagcatcaatagcaccgaatttagtattcagtgcatcgcacaactccttagcgttggtcatgtgcatatacacctcgaccaaacgatcgccaagaacactaagaatgtatcccacaaagagagtagtggcttcctcgaattgcttctgctgattagcagtaagaattccttcaggtttaccagtacacatacagaagcatttcatagctgttagccacagagtgatcctgatctgccatctcttaaaatgcacaccggtgaatttatccggcctcaatgcatcggcaaaaccagccatagtaaaatcacaacgcctataataaggttttattgaaattataagcacataatgatttagtttattccataaaaaaatcatgacattgcagatgtaaactagcatgaacgcatcattagatctacacatgtaaattaagcagtaaaacatgaacagatcaaatatgtgcaacatgtcgaacacgtatcgaggtggcggaaagaccggttgctcggcaggaactactcgcggttgcgggcatcgacgaaggcgcgcagcacacgagcagagaggaaggcagccgtcgtggacgaacaggaagcagtcgcgcgaagcgcttcccaaaaaccttattaccgccttctcccggtgcaggacgccgaaggcagaggttccggagacctgctctcccgattgccggtgcacgccggcgagcgggatggagtagtctacgagcgacggcgcagcacagagtaggaggcaaaccctaaattgatttcgcgtgtgttgcgtgaagacggcggctcggtttatatagagaaaggtcgcttgatcagggaaaaccctagattgatttcgcgtgtgttgcgtgaaggcggcggctcggtttatatagagataggtcgcttgatcagggcgcctacacgatctccactccgcgtaactgaaccggataggtcgcgcgtaacttatccggactccatgccgttttcccacaccatgacaaaacactgcaaaaggaggcgtacgtcatgcacgcgcaacgcctgccaggcgaggcgagcgagcgcgcgcgtgtgttcccctctcttttctccatcacacatgcttcaagtgactaggagggcatcctctcttttaaggaggtccccctctctttaaataagtaaggtggtactaaactccacatgcatgccatcccatgaagtgagcttttgtgattttacaaagaattaatcttcgagtgggccttagcccatccatttaattccaacggtaattacagggaatgaaattgtggtgtaagcattgaaactatcagtgatgcacgggttaacttgactattacctgtaggttctttgctccatcactaactgcatggctactgagtcttgccaccagtgccagcgagggcggtcgctgccttgcctatgagagtgtgagagagagagatcggggagagagaagggaggaggcgagaattgagaatttaagaccgatagtgagagcttcccaaaaaaagtgagagaagggtgaggaataaaaggcaagagagagaactcgacttggatcagtcctgcttttatgaaaacccagtagagcagatacaatagcaggctataagccagctataaatatattttaaagagataaagatagagagagaagagcagcgggcaacaaatctgtagccagctacaacacggactccaagatgtaatgtgtgtatgataggtgggaccagatattaacagtatattaagcaactattgtataaattggttattacattggctatagatggtttggagctagcacacatcaatgcctttctaaaaagaaccgacattgataacatcagagccagttattctaatgaattggtattggtatttttgtctcatcaataccgtttttttaagctgacactggttggttgcgtggggttctgatgaacgggaaccactattggtgtaagatttagtcgaacagacactaacaagggtattagtgaaaaacatatctctatctctatctctactattataaaaattgaaaatgtttttgtcagattatttggaccatcgtcttagaatctcaatcgctcccgttcgtcgtttttcttttcagcattcgcatgcatttcctttttttcttaagtccgtaacgcatagcttagctccgtatcagtgggagagcaccgtgcaactgtgcacctggaaaggcccacgtgtgtgtagggctgcatcttctatttttaggcccactcatcctgagatgtctattattctattatataaaggaaaataaatctctactattataaaaattaaaaatattcttgccgatattttggtgcgtcatccgtgtatgagtcggttatatatatatatatatatcaagcgaactcccacagtgaatattatcttaactaaaccatataacaataataaaattaaaataaacttcacccgttgtaacgcacgggtatttttttctagtctacttaataattattcaaatttaatatttcataaccctggtgctatttgaagtttgaactaatttgcagggtagcagaaataagttgttgctgcaggagcagaagagtgaggcctggtttacactactacaaaacatcaaataggtgtcaccactataggtgccggtagtgctaaaactggcacctatagaccttttcccacctctgcgggttaaaatcgtaaaaaaccgacacctttaagtaattataggtgccggttctaaataaagtcggcacctattctattttgtgttagttttttttaaaaagggaacctttagtattaaaaaccggcacctataataaattataggtgccggtttatgtaaaataccggcacctatgaattgagtcgagctgggatgagccgagccagcgggccccaccacgaagcttcgaggagataaggccgctccgcagcgctcgtctctctctgtctctccactctcttctctcctctcggtgcctgtctccactcatctcctctcgttctctccgctctcttctcttctctttctcctctcccggccagcggaggcggcggcgggggccgcgcgctcccctccgcaagatccggggaggggcggcccagcggcagcggaggggagggaggatgcggcggcgggatgagaggcagtggcggcctggcgacggcaccctcccctctcgattccctcgctgtccgcggcttgcggaggcggtagcagcggccgcgccctcccctccgccagatccggggaggggcggcccaacagcgttcgcagaggggcagcctagcggcggcggaagggcggggggatacggtggcgccctccctccatgagatctggcgaaatgtttcttaaaagatttgtgtgaaatgatttgtatgatgttcttcaatgtttcttgatgttagtgaaatgatttgtgtgaatgacttctatggttggggattggggattagtgaaatgatttctgtgatttatgtgaatgtgttgtgtgattggggattggggattggggattagggattgtgatgcagggtggatgagctcgatgcatcggctcaaatcgagccgatgcatcgagcctttatttttttttgctcgcgagtggtatcgaaggttctggtttttaaaataagattggtgccggtttaatgctgccttcatagtgccggttgggaaaaccgacacagaaaggggtttctcaactggcactaatctcgtgtcctgtggtagtgttagctcctaacttattcttcaaacttccaacttttccatcacatcaaaacttccctacacacataaacttttaacttttttcttcaaacttctaattttagtcaaatttctaattttggcatggatctaaacacaccctgaatgttcagattgctaccgctacagagcgagttgcccaaatactccttccgaaactactgtgttcaaaatcaaaaagtacaataaacataggagcagtgtgtgccattggaatcggaatcggaatatataaaggggcgcgagttgggcaagcgaggacgggtgccacgtcaggattttgctacagtatgtacagtgcgcgaggtggtatttttgtgaaaaaacccttcgatttccagataattcaatcgaggtccctcaagaatagtgcctctgaggtgtttattgcattaaggtccttatagaattcggatattccgtgcatagaaaagaaaaatcgtgaattaaaaccgcgttgtaaaacttaaaacatgaggggctttttcggaaaaatggctcacactaacccacccaccccatgccctagccgtataggtgtccaaacgggcggcacgccccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgagctgcactggccgccaggccgccaggccgccagccgccaggccgccagtgcacagtgttttttaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattttactggggttggtctggatccaggtagagttgctcgaactgggcggccaattcttggttgtctgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacttgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgacagccgtatgatccggtacctcctccacagatggtggagttggagccgatccggaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttcaaattttgtcaaaataaaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgtgccgctggcccgctttcggcctgacgggccgccggtgaaacgggccgtgccgtgccgcgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctacctagccgccgccgcccttctcccctcctccctctcgtctcaccctctccctctccctctgccgccgccgagcaccgtcgcctccccctcgcgccgtagccatcgtcgtccccatcgccatcgcgccaccgccaccgcctccacccactctgccaccgccgtcgcgtcgccgtttcggagctcctccaccgccgcctcgcgctgtcgccaagcgcagctatctctgccgagcaacggtgaaggcgggcacagccttcatcagcgacgaggtcggacctccgacgaccacgccacaggcggcgcaaagagctaacggcccagatcctggcatcgggagccacgccgctgcgcccgccgatggtggcggcgaggaggaggaggaggccccgtcgccgcgtccgtctccgccggttgctacaccttcctccgatcctcgtctcgccgcggcaggcaccggcgccttgactcctccgcctccgcttccggggcggcgcatgtggtcagggtggaggtggggacgacgaagggggagaggagcttgttcccctgtcgacccggccgtgctcgaggccgggctggtgtggcgcctcctcgcgggggccgggcagctgacccgcggcggcgcggtggcggtcgccgtgnacgctttgctgttcgagcacctgtggtggctgcagcatacgccgacttcgtccctcccctcaccatcgtgggtcatcaattcccctagcagccgacccctcgcgccgcccgactccgtcgacgtcatccctcccctcgccatcgtcggccgtcgcgccgccaccccaccgccgctgccctcccacgcagcaggtccatgccgcaagacgtccactggccacaaccatcgctgccctctcctgcagcagatccacgccaccggccgccgccctcaatcacaatgtgatttggaggtggagaagcttggtgtggtacgagttcattttcaaatccgctaccctcgatgacagcccaggctgcggcttcttcgccaacaccagggtcaaccttgccaacgacatgtgagttagcttcttcctctctacagagatttctggtgatttttgtttaggcggaacaacgactacacgttgatgcggttgctggcacaggcggacgccatcaacttcatcttcttcaccaagatggacattggtgggttgttgtgctgccttcaattatgcagggttgggttggactctatgagggtttcgagggcgtgtgcattgctgaccatggctgcgggtggtcctcacaccaacagcagcctgtgactccatgaagtatcgtgtctggatggatggtgagtgactggctttcttttttaactttctgactagccctaattgccacctaattctatacattcacctgttcatccagcgattccagaatgtggcagtggcagtgcggcttgccttgatttgatttgttgtgctccacgattatcagttcagaatgtcagataagtgaaggttggttggttagctagcaggaagttccctgatcattctgttatttgtcaaaatgtgacaagcatactgatctctttgttttgtagtgtggtgctacctagctgggatgccggtagcgatcgctgtagtggccgcggcgacgattgcttcttccttggatgggagccaccgttcgccaaccttgctgctgccgacgctcgcatatccttccctgtctgtgtgccagaggtaaacggcagtttcttcctgttcttccaccgtttgtgctgatgaatgctgtgcattccctccttgtttgagctcggccatggaggagtcactggtatctctgggctggcggtgctagaacagtacacatggtcgcgttgccgagggagctggacggccttttcagggtgggttcctgcaggacagggcaaagatgatggttttgtcgaggaatttctgtgatgttatgagccattatgttgatctgcttctgtttcccttccaggatttgtgggatgcaagcaacagcagcaacagcgaccgggcacgtctgattccagctatgttcagcatcatgtatgggaaggtggggatcagtgccgacacccccagttctacctccgattctttcttcagtgatagtcttaatagctcttgtgggcagtcattgataggcatggtgtgtacttaactgcttattgaaatgatcaggtttactttccattcctaccggttcatacattgttctgctctaaatattttcttttattcgaggggataggcagatgttcgcacaggcatggggcaatccggtttcctttctattttgtttgtattgccatggtgcacttcgttggattgtggtgttctgtgtagttttctactatatttaggtttaccacggcttgttgtttactggttgtaagaaagcacataagaaatgaaacctgaatatctggattgatgggtgatgggggaatatttatgtttctgcttaattggatgggtttgatttctctgtcaattaatattccgtatacatagagcctcaatttttggtagagggagattgtcaatgctcttgcctcgctcgctatagatttcctttctagataattatagacatgttttgttagtttatatatgtgttggttggctgttcctatttactccgcatgcagaggattgttcaaggtgaaagaaagagcatggagattctctgtgtcgtcctatctatatttggatcctattttatcatgctcagtgtttttttgttgtgcaatacctttggcttttattttcgtgccaaacagttttagaattggttcagacatccttttacttctatggctgcaatgaggttgcggcgtgatggagaatccttcttgatattataggtgcagaggcttatgcgttctttcctttatcaaaaaaagatagagttgttcttaaaaaggcactgcccatgttctcttttatagttctctgtgtatttatcgctatgggaaaaaatgatccgtgataaaaaaaattgttagcttgaacgtagagtgtcaacatgttccttaggtgctggtcactacattttgttatttaaaggtcggtgtgataggattcctttatttctggtagatgttcagttatatatgctattggtagagtgcctgcagaaacatagagtgttccagtttcatctattttgtttccaggtgctcatgcagcattcgatgccgcttttgctcgttcttactggtgtttgcatgttggtttatgtccctgtgtttctgctagcatggtgcattccattgccttgtggtaccctatgtgattttctatttcatttctgctggcatggtgcattccgttggcttgtggtcccctgtgtaattttctattatatttacctttgctgcagcttgccatctactaattgcatggaagcaaacaggagataaaattttaatatctgcgttgatgtgtaaggagtggatgtttatatgcgtgtttaattggatgggttggttccactgccggttaaggttttatatagataaggcctcaattgttggtagaggaaggttatcagtgtctatggttcacttgttatgcatttcctttgtggatgattatagacagattttgttaatctatatatatatgttgattggctgtgcctttttattccgcatgcagagtgttgttcaaggtaaaaagaaagaaagtagaaattgtctatgtcgtcccatctgcttttggattttattttatggtgcccgatgttttttattgtgcagtgcctctggcttttattgttgcgccagacatttttagaattaaccgagacatcctttcctttgtttcctgtatagtttcaaatcaaatcaaacagacatgtgcatcaatcatccaaggtatcaatatcagctatcagcctcacaccagagcaattactatttctgccacttccactgaaggttatcctttatcatttctcatacaactattatttttgtatatctagcccatcttatgtgcttgtttcttcatctagagatacacatatataaatgactgtttattccaaccatccaccacatgcagatacatcagacacttcttccaacactaaaactgatctatcatctgataccccttccaacaccaccatgacaggtaaatctaatccttgttttatgtaaattaattaaatttgttcacacagtataatgaagatcaaataatctcgcatgataaaactacatggaaaacaatcatgccaagcttcgtataatgttgtcagtacattttactcacactgaccttcttaaaaaaaactccgccagctgacacctaacatctattttatacttatgcaattttcacttcacttacagtcattacaccctatctagcagcttgaatactcctcagctagatctcttaaaactccgtcctaagttttttagatgctaatgtaccagttgcagcctgcaaaaactctcttcatcagcaacttttaaatgttcattcagttctttcgcaaacaatgcaaatactaataggagtattttcatacaggcagcactaagcgtgcgtttaacgagctgtgtttctgtgcaaagaatgttgatccaacagctgacttgaaaaagtatatcgaagatcttgagtgcctagaccgttcaagcaaattctatgctgttgctgtgaataacacattcatgaagcaggatagagttgtaagttcctacatctgctactcatttatttatatacaccatacatggctatctatcttaccaattatgagtcaaggctgatatacaatgccaattacagtactgtactaaagaattttctcaagactacttaaagccattaatggaaggcaaggaaaccatcagcattggagttcaaattgcaggtggtgtttcaaagaatatgatcctccatatgtcaacggatggtcgatgcaacctgaagaaaggatgggcaaaatttgcaacccacaatcacatatacctacaatcactatgcaccttccatttctacaaaacaactcgcctggaagccaccttcgatgttctataaagaacatagcaatactcatggctatgttgcagccatccttttgctgccatcaaccaggttgatcactgtcaagataacatgtattagttctaggccttacatggtaatcatggaacctcctaatatgaagaaccatctatatatgtacttactgctattagagacctctaaatatcaagatgcctgtgtgcaatttgtactgtggtttgcttctatgtaagacacttcctcgtactttcttgaccctggttgcgtccaggcggcatttcctcgtactgtcattggcgcgcccctagctctagtgtgatagtagggtggactttctgtgcccaccggcactcgcttgcacagccacaagctataccgacaaaaacttcagggaagcagctagaagtcaaaagttctcttggagtcgagagatccttcgactgttactgatcatcttcacttttacttttcgcttcaggctgtgtttagatttaaacttttttcttcaaactttcaacttttttatcacgtcaaatgtttagacacatgcatagagctttaaatgtggacgaaaaaaccaattacacagtttgcatgtaaatcgcgagacgaatcttttgagcctaattatgtcatgttttaataatgtggtgctatagtaaacatttgctaatgacggattaattaggcttaatagattcgtctcacatgtagtttacaggtggaatctataatttgttttgttattattttatatttaatactttaaatatgtgtccgtatacttaaaaaaatttaacacacaaactaaacacagaaacagaacctaatctggagagatgcctgtttgcagatgtcactctggtacgagtgcgacacgcagtcagtccagtacacataagagagcaagaacaggtgtccaccatgtgattgatcagtgcgccccagtacaccaaacaaaaacaatgatcatctgatgaaaatgatgttatttttcgttgggctggaacacaatatttttacttgagcgatcgatctatggaagttggaatatcgttctcacagggcagccaaatggcagcacgctctgagaattttcacaactcgatcgatcacagcacagccgaacttacaataggaattgaagctagctagagaggagaggaaaaaaataagaatgtgccaacatccatgcacgatcatgcctcaatttctaccctagcaagcaatgcaacaaatcgcaatgcaagcgcgcctgcctcatctcatctgatggaggtggcagaggcggaggcgaggacgccgtggaaggtggcctcatcgcagggcagggtgatacccatgtcgtggtcgaagccaaactcctcctcggccttcctgagaagctcctggaactctggcgccgcaaggcacgccaccggcacgatgtagcgtctccggctgatgccgacgtacacggcgaagtggcccctcggcacgtccccaggcagcccatcgtcgtcgccgccggcgccctttatcccgaggctggacgagcacctccgcagcatctgcttgagctgccccggcttcttggaccccgtgatcgccatatggcgccggtcgatgtccaccggacgtccggacggttagtgcgtgcagcagtagtagtggtacgtcgagcagcgagacatcgacctgccacctgcggaatagcgtggtatttaagggggaagggtgggagacacgcgggtgcatgtgggcgtgggctcgctcgggcacacggcggcagcggcacggccgggtgggtgttagtagtagaaggctggtagctagtgggtcgcgcgcgaggtggaatgtacggtcctaccacgctactgcctggcgccgatcgcgcgccgcggatatggctgatttctctactccggtttcgcggcctctgggagcgtggcggggtagggaccgtgtaccgggcctaccggcacgggtgcgcagggcggtatgtggcgcatgtggacgttgtcccggcacctgctacgccagaagccgttgctgcgtactgtactaacccggttgctgcttctctggagagagggataacaagggagattttctgtcttgcgcggtcaattgattgaatgattgattttgattcgggcaggacggtccttttttgggcgggtttatcaggccacagaaggctagctagtactagctgtctatactgattgcaggatttccgaaacaccatgttctctacactgccaatctgcgatgttcaatgaatctactcccaaattgcatctgggaatgtactgcttttcgggggttgctggctggtgatcagtagggaccggaaatggtaggtgaggattgtacgtaacactgtacgactgtttgtactcctcgcaagttgcagccaatgctcccaaaaaacatttctttatgccatatttcaaatacagtaaattaatcacttttgggctgtcccttttaaagaaactaggtgatgcgggaattagtaaacaatgctcaatttgtttttcaagagaaaaaaaataataaaacatcagggtttatcaatgcttatcatgaaacaaacaaatgataccccgtattaatgtgaaacatattgataagtatatcttaaatattgtaaaaatgatagatttgttaaaatattgtgcaaatgatgtgaggggtgatgattagatatacttacatgttgatttataaaattaaataaattgtagatgatgttgtatgcttgataagaatatgtaattattactagtgggtgataatgtgatatggttgcatgttgagctttagacttagtgggatataactttatagaaagtacatatgaaagaatacatagataggcacgcttctcaaactactaaacgatataattttaataaaaactttatatacatatgaatttattaaaaatctgtttaaaatataatttcaactttataataattaattcattctatggatctgtttgggggagcttctagcagctgcagcttctcctagaatctccagtagccagaagctccctccaacagttcagctttttacccagattctgagaatcaatctgtagtcgtagaatctagaaaatgaactagaaaccaaaagctgggttttctagcttctctagattctcaccagctagcttctcagcagctgcttttcataatgttaagctcccccaaacaggccctattccatttagaagccgcgtgcatatagatactatagtatccatcctcccttaacaatacaatcactggtggagaagaagtttttactcccggttcgtaacccccctttagtcccagttttccaatcgagactacaaatccggaactaaagatcgctatcgttagtcctgggtgaaataaccgggactaaaaatctatctttaggactaaagatattgcctttagttccggtactaaagatagagccaggctgatcccggctgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatattcacatcacacacaaatcaaatacatctcagatccggatcacaaattctcaaaaaaaaaaaacaacaaaacaagccgccatcttccgtctgccgcccagccgctgccttccgccttccgccggccagcgccgcgcgaggccggcgccgcgcctgcagaccggggaggaggggggagggggaggagaaggagcctcgtgcggcggcggcgccgcctgcagatcggggaggaggggggagggggaggagaatgagaggagggagaggaggaggggatcctccgcgtgtaagatagcgaggagaaggggatcggaggagaggagaagaggagaaggggaggaggagatatgtatcttgatcccgcacgcctcgatctctgtgcgcatgccgatctttttttccggttgatgttactaaccaggactaaagattgattaccaaccgagactaaagatcaaaaagtacctataacctttttcaaccgagacttaagataatctttagtcccggttttattgtaaccgggattattatggaatctggtcgaccgaccaaagatggtttctccgccaatgaattataccatgttcagacacgaatattctacaccgctcgattattgagtgtaccgatgataatgagcaccatctttgctcttcaacttatcaaacgtgaccatattataaatttgattttttttcatgtttttaacattgtttaatttaaatatataaaagtttgaaaagaaattcattttttcccttaagctatttcaccagagcactcgacctctaaacaatttttgttcttcttttacacctcaaactattggagatggtcctacttaatccctaactgcatttctctttttcccttcctatatattacttcttctgtttcaggttataagactttgtagcattgcacatatttatatacatgttaataaatctaggcgcgcgcgcacatatatatatatatatatatatatgtatatatatatatatatatatatatatagattctttaacatatatatgaatgtgggcaatggttgaaagtcttataacctgaaacggaggtagtagtaagtaatattctcctataagtctcgacactatttataattttttttatcatcattgttcgcatggtttggaagctccaaaagactgatctaaaaatcaattgctctacaaaactacagcataaaaatatatagcttacatagaaagttttgaaaagaaaaatattattatggataaagtaaaccattttcaacagtttagagtaaaatgagcaaataaatagtataagggttaaatgatcccatgaaataattcgactgaataaaaaaagttttttttttctaaagggacataaattaattttttgctactaagcattgctgcctaataattaatgacagataaaatatcgtaaattgatcgatttaattgcatcttttagataatggaaagactcccggcctttgcttcagagaagctacaaccattccctaaaaaaaaaaagaacctacaaccacttattacatagttcactcaataaagagcacataaaaactaggaaatgatgaaacaataactaataactcgaacatcgtttattcaagtccatttggaaatatacacccaaagttagcaaatatatacatgaccattgtttctaggtttcagcacgcaatatatattagtttcttgtcctcgtcacatctttgaagttgtgcccagaaccgaaatcggtacgttgcccttaacaggacctgcagataagatttcattaatgatttgttaaaaatcatatcatttttacaaaacaaaaaacccaacatatagcagatgcccctactagaataagcttctttgtttttgagtcaatacctttaagccaatttccatcaatatgagaagtactaactccatcccaaaataagtttatttttacacataccaataaaaaacaaaaaaaaaacagaataacccaactttattaaatcccaatgcaactatttctcactttatcaaatcccaatacaattattctctactttcacaaactccaatgcaatgattattctaaaaacaaacttattttgggacaaatagaagaagcttaaaatgaacctactacgggatagaggaagtaatttttagaggttccaagccacaagaaatatgtattgatctccaaagaaatttagcaaaatggtactaaaaactgataaatagtttcacttttaataaaaaaaaagttatattgctattccaattccttcatggtaaattatctttagttaatattacttctttaaatggtaatacacaaaaatgtttattttaagaagcattttaatttctataaaaatatgtttctcttaatatggtcattatttattaaagccaagtgcatagaacaaacccaaaattaacaaatttgatgaagattccatctaaatagtcaatatcatcattcaattgaatatgcacaattaatattggtcactaaatcatgccaattttccaggttctggcctaccaataatgcacttttaaagaaaccatttagtggaatagaagtcatgaccgttacaactgaaacatttctctttgagcaatattgtagagaattggatatctatccataaagtagaggaaatatttcctaaccattatccttccaatatcttacttgcttcccatcatttactacccatgatcctaatttttttaataaaattcttgacctttatgaggcttgaccaaaaatgagaatcctcttgttttctcttaacttgggtgactgtattgttttataaatatttttctttaatatgtccggccaaatatctttctaattaatcagtttaaaaacaatttgcttaacatatatttattatgatttctattttatgcacccctagtctatcctggttctttgattgagcaataatattccatcttgctaatctatatttcttttttatcatctcctaaaaaatacgatctataataatcactttaattgcatataaaatatgattgtatcaattatacactaccagcgacgtacgtcttactttctactagcttgtggtccactctagtagtacgtatttatttaatttaagttcgattgctgttcaataaaggtcccgcattatctaatagttttaatttagacaaattttacggtacattgtactgcaaatatatactaccagtacattttatctaacggtgtaaattaatctgatttttctctaaattattctgcaatataaattaaatagggtatatttgtcttttcatctatttgcgtggagggtaattttgtaaattcgcatttcctcacttagtcagatccggtcgataggcgcccagtcaaatccgctgctgggggaccgtgccataggcgcacagctgcggcagctcgcagcggcaagggcagccgagcggcggcaggtggaagtagcagggcggcatgcggtagcagctgggcagggaagccccgcggcggcgatagcctataagtaatgcaaaaatcacaaattaatatttctactagacaaggactcttgtccgaccatgacgaccataaaaattcacaaataaaccaattcacaagtgtttgtagagaattacttcgagttgaactaattagagataggtttaattattgcttgtgtatccattgtcccgggtgaaataaccgggagtaaaaatctatctttaggactaaagatattgcctttagttccgggactaaagatagagccaggctgatcccgactgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatatccacatcacacacaaatcaaatacatctcagatccggatcacaaattctcaaaaaaaaaaaaacaaaacaagccgccatcttccgcctgccgcccagccgccgccttccgccttccgcctgcggccgccagccgcccgggcgcgaggccggcgccgcgcctgcagaccggggaggaggggggagggggaggagaaggagcctcgcgcggcaccgccgccgcctgcagatcggggaggaggggggagggggaggagaatgagaggaggaagaggaggaggggatcctccgcgtgtaagatagcgaggagaaggggatcggaggagatgagaagaggaggaggggaggaggagatatgtatctcgatcccgcatgcctcgatctctccgcgcatgccgatcttttttcccggttggtgttactaaccgggactaaagattgattaccaaccgagactaaagatcaaaaagtacctataacctttttcaaccgggacttaagataatctttagtcccggttttattgtaaccgggattattatggaatttgatcgaccgaccaaagatggtttctccaccaatgaattataccacgttcagacacgaatattctacaccgctcgattattgagtgtaccgatgataatgagcaccatctttgctcttcaacttatcaaacatgaccatattataaatttgatttccggcactgatgatagtctgctagttacgaactgacactgatgttattttctgtagtagtgattattgaggaaaacacagaccttttcgaacgctagaatactgttctcctcgctagaatctatacgcacgaatgactagaataaaaccatgaaaaatagatggaagaatggcggaatctattatattattaaaacagcttgtgttgacaacgagtcacagctctacaccttaaacacgttgtgtgcaactcgtggtggcaccctaagacagaccactgtacggagtgcgtagatgtcgccgaacgaacacccgggagaggccccgtcagggtggacgttacaccggtttattttcgactcggcaggccagttagaacgtcctctaactctgtagagacgagagacaacaagcaattttgagattggaggagaatacatttgggattggtagtaagaaggagggtgatatagaatatagagggtttggatactaaatagatttggacaattgattggttgtttattcaatcgatcttagcccacttatattaataggaggggcgggattccttcccatggttttttccacgtccaattaggtgtagaaaccaattaagactctaaaatcttaggctttagcaagaaaatccgaggaccgacaaatcagacttagaatcggactccgttggtttgaccggccccctaccgtctatctgactggccagatggctatggtcagactgacctcacgtgacaagtctttgcatgtctgggttattttcaaatttaatcatggttttctattattagtgtaggagcaaaatttggattaacgccttgaaaggaagcaccatgttcattacggaggctaaaaactagtgagaaaagaagacttcgactaggaatacatttagaagtaattgaaattcgaaataaaaaataaaaataaataaaaagaagagttcatgtaaaactcaactaaagagattggactaatccaatgtttaggggtcggagaaggagcgatggcggagagggcgattgggcggcgactcctctcgcaggagagttcatcggcggcgagggtctctccggcgacctcggcggcgctcagagacggaggtaaggttcaaggggcgggatccggaagtttgaaagggcatatcgcgacaaaattcctcgcgggaggggtttcgcgctgcttttcggaagtttctggggaagggcccaaggagctcatccatggcggagggagattgggccatctagcccatccctatagccggggttttggccctagactttcacgtcagctggcacatctggatcggcacctgaagcatctgtggggatcgaatcctcgagagctagggtttagaggggggtggagaaaagaggagttgagggaggtgaaggcggcggcggaggagtggccgaggctaggaattggtggcggggaatcgaggtggacaggtacgatcaagggagatacgcgcagatttgagaaggttgttcgaggtcggattccagcaatggcgcaacaaggagggggttggagagggcgcttccaaccaaggccagcgttccatgggaggcgaccgctaggagtggagcatcatgggaggcaaggccaggagggagttcgagcagttcatccactaccagggcgcgctgaagaaaagagggatgagcaagtctcggctgtggcaaccaaagaggggagtttagtgcagcagatcaagccgatgcagatgcaggagaagaccgaagtgggaattactgtctcaaacctcaagcaggatgaggcgaaagctgaggttgcagcttctcgtcctcctccccaagcaaacccaagacatggtatgaatccgaactctcacagaatcttttgtgtgagatgcaaaggtgttggtcacttggttaaggattgtcatgttgctgtgttttgtgtcaattgtgctaagcctactcacaagactaaggattgtctatatgataagcaacccagacctattgccaagttggtgagatatggtgctccagggcttggatgtatattgattcagaacactagatctgagccagcaaaggaacacattaatcctttggcaatgatttcaatcattagtggagggggattaactgtggcgcaattggaacaaggttttactcagcagttcaagtggaattggatatggaaagcaaaagaaattcctaatgggacctttcaaatgaggtttcccaataggatgaggtttgatgagctgtcaaactttgatcactttactgtcaaggggactaatgtgcaggttaatgtcaaagaatggacccaagaacctgaagctgtagggaagatgcatacagtttgggcaagagtgacaggtattccggatgaaatgaagacttaccctgccccttttgaggttggttctaacttgggactagtgatggaagtagacatgattactttcagggcaaaaggtctcatcagaatcaaggtgggtatgatggatttggaagcccttcctctaaaactaattctgactacaccaaaagggctgctattccaggctcagtacactttggaggaagtggtagagcaagggtggtttagagagcaagtctttgaagaggataaggaagctgtctatactccaaccaaggtgggatagagggaggaaaaacaacatgtcaatgaggggggagaacagggaccaagtagtaacaagggtgtgtatagggctgggaagggggatgaagttgtgctagtactggaccctggattgacaactgaatctgatgtggctaagtgtgttcagttccatagggacagagatttggccatgaagttgcaagatgaggagatggaaaaacaatctgctaggattttggtccaagaaggaaatgtgattctatctaaaagcaaaggggctgggaaagggtctgagatgtctgaaattcccattgtagaagagacacgtgctggagatggggctttatctagtggtgggacaggaactttaagctgtttggaggtgatggctgagactgaattgggccctaggggagaagaaggagaaagagttaacttgggagacagtgaggatttcctagattcccaagaatctgaaggaaactttgccaagcaagttggtgtggttctgactgaagagggcatcgacagtcaagaagaagacacaaggagaagcaagagactgagagataaagaagacaaaaaaccacaagacatggcaatggaaaggaaagaggctcagaatgcctttattaacaaaggtcaggcttcaatcccttctattattgatgaaccaaatagctctctcatgaacattgctaatttgttaggagttagtcttgggtgtgccttggttgatgttgattctaatcttcatctaataaaggatatggagaatgctagagtcaatttgtttatgaaaaatcaagaagcaattttagacaaaactcaagagagcaaatcaggagattttcctgaactctctggcttgggagaattatactctttagaagatgatgtggactctgaacttgatgagatcgaaaatttgattaaaaacatacacacttccagtgggaaagggaaaagaatgaagggaaaccttgacactgttaaggtaacacccatattaggtaagagaaaagggaaaaataattctaagaaaaatgattggacttttttggaatattaggggaatggggagtcctgaaaaaataggtcacttgcaagacctaatcaaggatcatcatttagattttattggcatcattgaaactgttaagcaggaattttctgctactatgttgggtagtcttggaggtggtaggaatttggtttggaggtggatccctgctaatgggagatcaggtgggattcttgttgggatagattctgataggcatgatattttagatactagctttgggaactatcatgcgagattgaagttacaaaaaatagatgataagaggtgttgggatcttgtggtagtatatggggcagctcaatacgcacaaaagaacaactttttggctgagctagccaatgttttatattatcagaacagacccttggttgtaggtgaggatttcaatattctgagaaaggaaagtgaaaagaataaacctaggggatacaacaaatggagtttcttatttaatgccatcattgagcaatccaatctaagagaggttggtatggggaatagacagtatacatggtttaacaaccagattcagtccactctagaaaagtagataggatttttatcaacaatgattgggggggtgcttttcctttaaccatggctagaattttagtgaagactttctctgatcatagccctgttctgatgagaactgagggcatttgttaataaaaaacatttgttcagatttgagttaggttagttccttagggaagacttggggagtgtgataattgatgtttggaataaacagtattctggcaatagtattgagagatggcagaaaaaactcagggcgcttaggaaaaaaactcaatgggtggaacaggaattgggagggtttatataggagggaaaaagaaaacattctaaaataaattgatgccattgacatcaagattgaagcacttggtatgacccataagtatagggaagatagaaaggagttagaacagaaactagcctatgttataagggaggaaaaatggaagtggtttcaaaggagtaaggttagagaaattctagagggggatagaaatacaaaatactaccatgcaaaagctaatgggagaagaagaaattgtcaaattcattctcttagtcaagaggaaggagaaattgaggggcaaagtaatttgctgtgttatatcactcatttctataaaaagttgtttggtcattcagttgaaaactctatttctattgaaatggaagggatctgccaagttactgaagaggataagaggagactcactgagcccttctctatggaggaaatcaaaagagtggtctttgaactgaaacaacacaggcccctggccctgatgggatacctggggaattctacaaaaaattctgggatttaattaaaaatgatttgtttgaactccttagtgatttccaaaagggtttgttaaatgtggaaaggctcaattatggcatcatcacccttgttcctaaaacaaaagatgctgcccaaattcaaaaatttagaccaatttgcattttgaatgttagcttcaaaattataacagaggttctgatgagcagaatttatcatgtgatgtgttatattatctcaaaaaatcaatctgctttccttaagaacagatatattttagaaggggttgtcattttgcatgaaattttgaattctcttcatcataaaaagcaaagtggcattctcttcaaagtcgatttggaaaaagcttatgacaaagtgaattgggtttttgtgcatagaatgctagtctctaaaggtttccctgatcaatggtgtgactggattatgaaagtcattaagggagggaaggtggctgttaaagttaatgatgagataggtcctcttttccaaactcacaaaggtctgaggcagggagaccctttgtccccattgctgttcaatttggcagctgaagcacttactttactggtgcagagggctgaggagcactctcttctggagggtctaggtaataatgaagaaaataagatctctattttacaatatgctgatgacaccatcttcttgctccctgacaacttagaatatgctaggaacttgaaatttattctttgtctgtttgaacagctttcagacctcaaaatcaattttcataaaagtgaggtcttttgtataggagaggccagagatagaaaagtgttgttcagccagcttttcacttgtaacataggtgatttgcctatgaggtatttgggggttcctattgatcaaaaaaggattctcaataaagaccggaaaactgctgagaatacaatggaaagtaaactgagctgctggcagggcagactccagtcaattggggggagattgattctcattaattccagtctgagttatgttcctttatatatgatatctttctatagacttcccactggtgtgaaggaaaggatggatttctttagaaggagattgctctggcaagaagatcaggggattaggaaatatcatcttgtacagtggcctgtgatttgtactcctagagatcaggagggtttgggtgttctagatttggatcttatgaataaagctcttttaggaaaatggatttggaaacttgagaatgaggacgggtggtggcaggaggtgttgagggataaatacctgaagaagaaaacaatgtctatacagaaacctaaacctggtgattcccacttttggcaaggtttgatggaagtaaaggagagattctataatttttgcacaaagaaagtgggggatggaaggtccattatgttttgggaagatagttggctcgggggcagacctctggctcacttattcc

SEQ ID NO: 69981 - DNA, 1165 bp, Oryza sativa
aggggtgagactaatcacggtgaatctggttgatcgcccataaccgcgggcacggctattagaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattctaattaactcacaccattgcggtggcaccaatctaaagctatgccaatagacaaagtctatgtaataatgtgatccccatttgtgtactagttgaactaagcatggctaagcatttcctaaaccaacatctagtcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgcactgatgagacctcagcaacgtcttcgagaaaccgcggatcgacgaaacggccgaaatctacgcgacaaacaaagcacacaagcaaaacatgctataagtctacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaagggggggggcggctgcgccgacaggcgggccccactggcagcggcacaaggggagagggagggggc

SEQ ID NO: 69982 - DNA, 1274 bp, Oryza sativa
  unsure (1)..(1274): unsure at all n locations
aacaaagtggcaggtttggattttaaatcacctttttaattgggatgaagttgaggatttggagggtaaataacttgatttgaactacgattatgtttgttatttagagaagaaaggtgtgtccggttcctgctagtgttttcttatttttctcttatgaccctagtgtttcgatcttcttctatgatctgtatgtgcttaatgatctagtttgttatatcggtcagatgaagaaggtgggcacaaagacgttgacaacacagccgcccgcggcgacaatgatgatggcggcggcggcggtgacaacgatgatggcagccgtggcggcaacaacgatgatggcagtgacgacggcggtgccagcggcggcggagacggcgacaatgatgatggcggcggcggtgtcggtgcagcacacgccggcacaggtaatacacttaagtgtttttttttgctcagcttgtttactgaatgagcctttgcatgtagctatgcatgcacagtaccatgcaaaccatgagtaatcttgttgttgttgcttgatcgcggtcgatatataccatgagtaaacatgacaaaactatgcaaaccatgcaaatcatgactgcaatatatgcacgtactaagcatcatcaaccatgtctaggtatcaatatcaagaggaggaggcactaccctcctgatgtaaaacgaaccatatatgccaagttattagagaaatcaaatcctggcatgatgaaggagggagtgacaaagtcagttgctaatgaaatgggggtgccgttgagagatgtccaacgcgtatggcgacatatacagattggagatggaattgaagcttttgagtccaagaagaagaagtattgtggcacaaaaaacttccgtgtgatcctagtgtcatcaaagatgtgccgcttggacaacgccatagcatccgtgacctagcccaccgctttggttatggaaaagccccattgtttcggcttcgcaagaaggattgttacgcgccatcaaaaggcataatgttcaccccgacccgaatataacctgtaggnncgtgggcttatgtgctatacaagggcttgaatggttaagcaatatgggccccccctaactttcaaaaggggggttaccggcatttccgtggtcagaaattggtttttagggacaagggtttccaccattttttccttgggtaaggcgataggaaatcctaaagaaacgggggttctttggaaagggaatgtgtaaacgaaaccaaggtcctcccaggg

SEQ ID NO: 69983 - DNA, 1631 bp, Oryza sativa
  unsure (1)..(1631): unsure at all n locations
ttgcgtgagntcnannnccgtagttagatangttanaantcaccannnnagnannnaaaaanacaccttntaatgcaagtaacataggctgattgtgaatagtttatccacatgaacatactatttttaccatnctccacatnattgttgttttcctatggaagagccaaaatatccccaccccgcataatcttagaacctgacatgtntacttctgcacacaacgtaaaaatattgcaaacattttaatctcagatgaaccgaactgtcattttaatctcaaaagaatcaaattacattttaacctttccaataatttgcaggcaatgagtgaagaatctttgcaaacatgtctttgagcttcccatttgatgtcattgctttcaatatcttgtcattgaatatcactttctgtgaaaagtgaagaatctttacaaacatgtctttgagctcccccatgtgatgtcattgcttccaatatgttgtcattgaaaatcacttcttgtgagattttgaaccctgcaggctgtggtaatgtggtttttccgaaaacaacagtttggacatatgatccttcctagcttgtctatcatatttgactttctcctatgttcctttctgcgattagattgtttgagtacaccaattctatatgcatggcctatcaccttccatacaacatcgatgagaatttcacgtgatgccccaacaagtgtaatgccttcatagaaccaaggttgtttaatctcaaaataatcaaattacatctagatctagtaatagtatggagcttagatcaccattacatggcaacaattaatcccagttttagtattcaagcaataaaccttttaatgcaagtcacatagcctgattgtgaatagtttatccacatgaacattctaagcttaccattctccacattattgtgcttttcctatggagaagccaaaatattaaatattgattaatcttagaacctgacatgtctacttctgcacacaacgtaaaaatattgcaaacattttaatctcagatgaaccgaactgtcattttaatctcaaaagatcaaattacattttaacctttccataatttgcaggcaatgagtgaagaatcttttgcaacatgtctttgagcttcccaattgatgtcaattgcttctaatatctggccatggaaaataactttttgggaaaagggaaaaattttaccaaccttgcttttggcttcccaagggaaggcaatgctttcaatatgtgtggaatggaaataactttttgtgagaattttaaccctgtcagctgtggttatgtggttttttccaaaacacaaagttggacctatgagaccttctagattggtatcatatttgacattctcccaaggtccttttgcgaatagaatggtgagtacacccatttatatgcatgggctattaacttcatacaacaattatgagaatattcgtgatgcgccacacatgtgattctttatataaaccagttggttaactccaaataatccaattcactttgaactcttaatagtgttgggcctttaacaccctttcatgggacacattaatcccgtttaggattctagccaataccctttaaaggacgggcaat

SEQ ID NO: 69984 - DNA, 1575 bp, Oryza sativa
  unsure (1)..(1575): unsure at all n locations
gcgcgcctttgagtgcgcatcgcattggacncnncncanattagnacacaatatcccctcgaccaattctataggcatggcctatcgcctgccttacaatagaagggtttttatgttttattgatgagaatttcacgcgatgccccaacaagtgtaatgccttcacaaaaccaatgttgttaaaatcgccaccttgaatttaaaaccataaaatcgtacaatcaagcacattttaattacaatcgtaaattcataaaatcatatgacaaaatcgagtctttgacaaccttgtacaacactccttcgttgatgcaaccattacattagcattgtgtttcatgtcattgaaggcctccacggcttcttgaaattttactaggacatttccactcatctacaggatctccttattttcggtccaattgaacattgtgctaagctggtccatgatgaaagacagttattcatgatattgactgagcatatgcactcactctttcatggcttcaccacaaatggacaatctccaagacaaaccttgtgatctccaagacaatctccaagacaagccatgcatatatatatgtttgtatatactatatacatacatatacaaattttattcataagtatgtatagcatacacatacatatatacgtacaaaagagatataggggtgatttgttgtcgtctagcgcgcaccacgcacggcgcacggttatccgcccatcagcaccccagaccgctcctcttctcgagcgaagaaccctagcgccgccgccctcttgatttccctccccgcacgtttcctccacaaattaattgccaaaattgtttccttacattgtgggcattatttcccctcttgaattgcattcgatcgagcctttaatcaccgtgggagacgcctgtttcctctctgccttcaatggctggtttcccacttcgccggtgccgatctccctgcctagcgccgttccttctccctagtggcttatataagcccgccggaggagtgtcctcgccagtgaccagtgaagacgccatcgtcttcttcctccaacagcgcatccaacctcaccggagtgccatcccgcaacgccgtcgctgccgccagcctcgcctcattgagatcttcctcgtccacgccttcaccaagatcagcaagcaccggacctccatcctcaccgtcaacccgagctacccacctctccttcttcgtcagccggaagtgattgtagctcaccggtggcagtgataatggcatgttgacatcagatctatgaccaatggaccggatgcaaacatggaagcactggtggagaaaccatctttggtcggtcggccgaaatccacaatagtcccggttccactaaaaactgggacatctttagtcccggatcaaaaggttagagctacttttttgatctttagtcccagttggtaacatcaaccaggactaaagatcatttttagtccccgtttaaaagacagcaagctgtgtcagacccctctgtatatttagtcacgggtggtaacacccacccgcactaaagatctatttntaggctcgg

SEQ ID NO: 69985 - DNA, 15687 bp, Oryza sativa
  unsure (1)..(15687): unsure at all n locations
cgcactggtgattgacattgcagctggcacattggcacatcatatacatcccacttgatttgggagaaaataaaaagaaaatggaccaaccgggactgcccctatcctctctttagtctcggttggtagcattaaccgggactaaagatccctctttttagtcccggttggttaccaactgggattaaagatcgatgtttactctcgattatttcacccgggacttaagccctgggactacaggggttataaaccgggagtaaagatgatttctctatcagtgaaggataccagtgaaggagaggatgactgttgtgaagaggagggaagctttattatttttggcatcttcacaatttttttctggattttctttcttattgaaaaattctagattcatcttattgaagaagataaaaatggattgaataagtcgaccttggaatcagggtaccttttctttaacatttatcattttcttttcgcgcggatgtttctagaattacctggatgttgctactctcttcattttcttgtgctccgttgatgcatgcacgtgggcagcgtttcccatggccaagcacagtgaggtttgttttaatcctaaaatccttaattaatttatcttaaaggttaactccaattaatcaacgataaactaaaaggcgacataatttatttatttatttagtaaaattaaaccttttccaattacaaagattttattaagttattttaggtaaataaacacggatgtgaattttcgagttcaggaaaattaaaaaacacgaaaaacgggagtaagatgcctcagtgctccatctctgtatctccaacccccaaaatgatggttgatccccataaccaaacatgatacgaaaatcatcccaagttaccaacgggcccgggaccatcccatcctatattttctctaaaccgaattcatgattattactccctctatttcgtattttaagtcgtttaactttttttcataaacaaattttgttatgtttgactaagtttatagaaaaatctagcaacatttattaattagttcgttaaatctaacattgaatatattttaacaatatatttgttttgggttcaaaacattaatatatttttctataaatttgatcgaattaattaaatgaagtttgactagagaaaaagtcaaacgtcttatataatatgaaacttaaaacttagagagtagaattatctgtgcgctattgtcaagagccataacaagtgggtctgatttaaaaccttatccaatccaaaacgtacacatctactccagcagtccagccccgtgttcagatctttgattcttgagagaaggcgtgcacgaacggatcggtttcactagaaaacggcgaaagggccctatcgaaaaaaaaagtagtagtagtccacagcccggcccaatacgcatcagattctaatcggagacgaaatccgagccgacttcgctctctggctctcgcaccgtcgcacgaatttgcctattatatctggctttttctgaatctgaaggggatcacacagcgaaggctccaagcacgcgcatgtctgacgagagacaggaggctgttgttgttgcggaagaagccgagcagacgaaggagatggagcgcgtgcgaggtaatagcagcagcagtaagcgctcagagcctgtggatcttgtcaaggaggaggaggaggatggggaggactggttcgatgcgttgttgagaaaactcggccaccccttcaccgtcgacgagaagggcaggtccgtcccagatcccgactggtgtccctacgcccacggagatcccagacacgtgctctatgttgataggagaaacacccccgacgtcgatatgttcgctttcattctcggacagatgtacgtatcctgatcctttctttctaagttcttgcttttattgatttgggttcataaacctctcgtttcatttacatatgctattaatcatgtttactctagctagctatagtattactttctgtcatagaatacaaggaagtatgaatttggtagtatgtcaataataagtgttctaacaaagccgggctggttggtatgatattatttggtttgctttttgtaaagtataaaagtcttactatataatcaaaaattggttgctttgtttatttttcttggcttacttataagccatagttgcaacaatgagacattgacgataataactatatcttggccgacgtatttaggataaggtcagtgatactattgtgttaatttgaaaactattgctggtcatgggcaatgggcactgctctagtagagctaactataaaaaccatcatacatatgaaatatgcaatgctcatacaatttatagcatttgcattactttttttttcttaaacaagctgacaataattcataagattatgtattctatagtttaaagttccatgcatgtttaattaattagtgtaactgccaattcgatatagtttacactttgctaattatgattactcttcgatgctagacctgtggatgatgctgatgacagggaaaagggcatctggaatgcttctatggtttacatgagagctcaaaacatggtaatgcatttagttagtgcttgggatacctttcttgaatttttatcatttcctttgtcaataataaaatcaatgtaatataatattggagtaaaaaagaaaaacggatatagcattcccaaaagatcgatcggattacatattgcattcactttgtgatagtgctcttacctgatttacccacaatgcaactaccaacatgtatatgcaattgatgctctttgaccagttgaccatagttagagaatttatgcaactgcaaactaatttaaattcttctacacatgcatgtcaaattattcagagtcatttgcgcatggaaagacacaagtcataagataatattattataaataagtcgagaaaatgttaagctattacatttctttttaccagatgctactacataaatttgcatttaatagcatttaaccattcaaaagtcaacttcttttgacatgctttaatttggtgaactagcaaaggtaaaagagaagccacattatttagttcatctggggcaatatcattgcttgaagtccataaaactttttggggaactatttcttctggatagagtatgtcctattatgttccttaggatttttagtgtgtttcatctagttatgacttatcagaagacaaggtccaagaaaataattccagaaaaaattctcctaatggtggtgctagctccactgaataaaataaaagaaagaccagacggttcttatctaatttgaaacaaatttgaataataatcagtgttggatgtgcttgcagtcatagttgtcaattggaaccaaatattcgtcataaattttttatttaattaaggtataaaccagaagaatttgtggatcttagtttaaaaattagtgtttgtggcctcgtgggaactactggcaagtggaaaccattcaattacataaatgggatatccaacgacctttctggaagttattataaggctagtagaattgtgttacaatttgttcctcccatacaatatgccaactcatttctggtttatgcatatgttacattcaaaattctgacttctaaagtgctagtactaattattatattttctttagtcgtcagagtatgatatggttccaaacaacttggtcttgtatcctatgatgtttgagaagcgccgttggtatcactgtaacatcttgggatgtaaacgtttaaacgattctacgggggaacactccacacaacaacggttttttgttgagcttatcattaatggtggattcatctaccatgtgctttcttgcaccaaagttggtatgccatttcttcctttttaatctgatgttaatgtttcatgtcataattccatcattttataaatttgtttttatcaaatttcccttttgtagatggtgacatcgacaacaatctatgtatagcttgtccgcccaacagtggcatagtgcatccacctgcaggtggatttatttgtggggtttcgaaagatcagaagatattcaaggtccccttctattaattagaatttagattttagagcttatatagcaatagtagaattagttgggccttttttggttgttttctatttttcagccttagctttaagtagacagctaagaatagaagtacaacatgttttgccctaatattatttttttgttgcttgcacttactgtctttgccttataagttgtaaaaaaaagctaccaatgtctttgtggaaactctatgatgtatacgctgtcatgtcatgtaacttatatgctttattttcctatctattattctcatgttggatgttctaccagctgcctgttggtacaggtggcacaaccctattttttgacgcatgtactattggcggctgttaaataccaaattcacgccgtcaatacctgcataaaactgaaatataatataaaatatccaacatagtagtagggtttatttctaacaaaatccacaagtgttggcgtatatttagatgcaggtgacaaactactagagttgagaagaaatatacataaagaaggaagataatcaaactcatattcaagcctatggagttttgggggccacaaacctaacgaaacacgttcaaatgggcccattcaccaaacatatgggttgagggattctccaccagagcccaggagaaaaggctgggtcaaatgggccagccatggtttggtcgaaccgacattggtgctgttcgccatcttcttccacgtggacgatctagatagcctcctaatgacggtggagaggtagttgggacatttccaactgccaaaccgtcatatgaaggctataaaaggagctcacatgcttcatttcaatacacaccaaagcatgagctgaattataagaggctctattgcatctttttttacattagaatagggagaaattaaagaagaaagagtcagaggaattccagagttgtcggtactttcctctttactttgtgtaccttgtcaagtactcagctttaattgatattatctttatcgagtaattgagatttgctttctgaggattatctcttagttcctggatcattgttcactatttgtcaattaatagataatgattactttagtgtttagataacgctagagtagtaattaattgcatagatgcgatgttaaggttgttaattaccggtgattgttgcgtatcccacagttcgttagaagttggtgtagaggtggtgacagcccttgagatcactgcagtccttcttgttcgggtacggagtatagtgcgttctggtagcagtgagcaagctagtgcctgaagtattgcgatagaattgaataaactttctatagacaatgttcctcactaggaaatcctctctaccctttgcctatttttgctttgtgtccttggatgaagaggagctgaacacacatgttccctattaaaattcgatatcttcgtgcgcttgcggatttcatctgtgaccgtaagaaatatcaacatgtacgagtgagcgagcccgagctagcttaacgccgcctgtacacggttgcgcatggctcatgcagcatcattagccaggtgccacacatgattaaatggactaggtagacccacgtaggaagaaagaaaagatgaaaagattggtctatcactatacgcatttatttggatacttatgtttacggcataattttgacaaattaatccttctataaaaattattttaataataaaccgtgtcaaaaactaatttcaaaaatagatcgtgacctcagtgctaccctgataatgctaaactaaaatgtctcagtgcacctaacgtggcacaaattagacatgtaaaagtaactcagcgtcactatacattacactgacatcttaatataggtttaaaatatacggcatgtgctgaaatcatgagtagtattaaactttatccgttttataaaaaagtgcctataagtaataaaaatagacaaaacaattttaaagttaagaagtgaatttaaatgtattcgagtaattcatagcacatacatatgtaattttcagttattaaatagaccaagattagtattactatgttttaagcatatggttaaggttatagcatatatactttagaaaagtgctatcacgaattgtgtgtatcgttaggtattcttgcagaacgcaattaatcctagaatgagttcatattggtatatgtatttctccctgaaaagagaaaatgaacgtgcatttttccaaaaagaaaaaaaaagatatgttcaaagtgcttaaatacaaaacgtgcaatttcattaaaaacaatttacttattcacccaataaaacctagctagcgtatgttactactctttctgcagtcttttactaacacaaaattaagaaaaaaatatttaagagttttgtggattgtaagttttctataaacaattaacacgaaatgagtttattcatgtaaaatcttatgtattcttacttgacaagagaacataaatagcatgtttgtgttatataccaatagatctgttatagttttgttcatcgtgtattttaaacctaaattttaaaacccattaattaatattacaggatataaatattgcacgcgccaacgggcacatcgattttctagttatgttccattatgggggaattccaggaaattggaaaatgaaaatatcgcttacttctcaaaaaaaaaacaattgtctctgcaatctcttatttatcaaagccattttgtacttataccagatatgcggataatccaaccattatttgacatgttaagttttgaacactcgaaccgattaactcctcatagcacgatgttcaatgttactaaaaaaaattgtattgatgctggttgcgaaacccccataggtgccgggttttctagccgacacccctcaggtggcaccgatgacaaaagccatcgactagcacctatagcatatagacagttgtaaccatgaaccgacacctatatattgttataggtgccagttcttggcccccaagcgccatgtggtggttgttgtcacagcctgattttcgtttcaggatttataaattacttaataaattattaatagaatttatattaaatgttcattaatttacaagtgaagttaaatgtgggaaataaaatttcctaaatataaagcatggctggatttaatttttattaaattctccatgattaattatactctttgaaattttctcagatttttcagagctcaattcctaaatgatacaaagaacagttcaataattagttaatcaataatcattaatgatctagttataattatgttaaatgcttttctcgtttaaaaatccttaaattataaattgtggtttaaaaggaattattagaaatgatcttaaaagcctaaaagagaagatctaattttaatttgttaaatctcaatataaaagtgggctagataaaattttgttaaatacttctcttgtttctatagttcctagatttttctgggatttatttgagccaaggaagtatttttaatcaatggaatatcatttcatgaataatttaaatataaaaaggttttaaatctctcttttagctttgggccgaaagtcagcccaagtctctctcaccctcctttcagcctgctcgcgcccggcccaagccggcccagaccgccgcgcccctccctcctctcttccttttgctgacaggtgggactcacctgtcagtcgtcttcaacctccggccgcatttagccgcgccgcaagccgccgcctccttccaaaatccggccgcccctttccttctccggccaaatcaattgaggggaaataatctcctcgatctcctcttccttttctctttaggaatcccgacctaattcgtttggaaatcatcggattcaatgccgatttggttagcttctctttccaaaaccctagaccttccatctccttgccgccggccatgggcctccatcgccgccccctagcccctataaaaggacctccgggacctcctctccacatcaccatctccacctttgactgccgccttctctagcgccgcctctgtgtggctctttgcgtcgtcgccgccggcgggtgtccagtcgggcgccgccgtcccttcgattgtcgtcgtcggacgccgtctccttcatcagcatcgcgaggtcatcgccgtcctcgtcccgtcttccgtttccgccgcagatcaccgaagcgcagccgacactgtcgacccgaagctctccaccgtcgccgtcggtccagccgtgccgtgccaccgttgcagccaccgccttcggtcgtcgtcgccaccgtcgggatcacgaggaggagcagcacctcgtccaccccttcgttgccgccgtttcccaccgaagcaccgccgtcaccgccgacccgaagaccgccgtcgtcatccatcgtcgtttgccgtcgtccaagccactggtgagttcgctgagccgagctctacgcgttggtgccctccgtttgcgccgccgtgccgtcgttcgccggcgagcacgaggtgccgagccgccgccggagatgacatcatcgctgatgttagcactttgtcagccgtagacccgtggtagaccggatcgatctcggccgttcgattcagtcaattttaggtcaattagatcttggccgttggttccgtggaccgcttctgtgaacccggtttaccatggaccgtctttgatgatgcaataaatctattttccttttcaaaaataattctttattgcgtcataattcaatttaaaatccatataaatgctttaatgcggtttaatctttagaaatgcataactaattcattgtaactcggtttaatgtggttcaagttgcaaaagttgtataaaataaagatctatatattaaaattatccataaattgtgttaaatttatttaatcctttttaaatgggctttaattagattaaatcttgtacaattcgtaattaattcatatgaagtcagaatgaggccattcaagtctcataattcatctaaaattatgatctacatgtttgtttactttatatgtattgtttatttggagtttcttagtctttttcctcgttttgcgtgttagcttgtcgtttccgtcattgtgaaggttcgcgagtgtgtcggaagtgttccagaagacaaattgaagacccattattgcaagtcaagtcacacagatcccaaacataattcctttgagcatgttgatcctatatttaaattctctatttatttcaactgtgcattttttttcgaatgtcatcgggtggtgtgaacctattcctttgttatggccaatttgcattgattaccctatttcttgattacctcgggttataatttgactagttggatttatatattggttcaattagatatattagatataattacttagtcatgcttagaaacattagcacactattgggataactaaggtttcactattacttaatgatgtacatggcaaagatagctcatgatggtcaatcgtgattggttaattaattaatttgccaactaaaacttgataatggtgggttgtgagcacatggttttgatgatagtgctcatgaaaattaaggaccggttcacaagtttcggttgtgaaacattaaccatgccaaccacaagccagaatgggcaacgactggacactttctatagcaaagctcattgtggtgtgccagactgagaagtggcggagataagcccacgggggtcgctggagagtccatgcctctggtttttgagggggtgactatgatccaggaaaggtgtgctgctttgagttgagctatgcgaggggtcttgtcacaactacacaaatggtgacatgttcagcatgggcacataatgatatggtgacatattatggagttgtgtcttgtgggtacagtggtacacctctagctagagtaaaactattcgaatagccatgcccgcggttatgggcgggtctaacaatgtctttcgtgattagtcctacactactcattaataataatgtggtaattgatggtaattaatttagctcctggtttggaatgacacatccctggtttggagatagatctgtacagccgggtatggttattcaggaaggttgggcctgtgcagtatggatgtgctattcagtgttgataaatattgatgattaattactctactgttttacaattctcaaatgtttgctaaatgctgcttttgcaaatgagccctatattatgccattctttggtatccttgtgcacttgcatatttgctgtgtggcttgctaagtatgtcatatgctcaccttgcaataatcaatcaaacctcagttgaagacaagttgcgaaggagaagacgtttgacttataccccagttgagttgcctgtgggagtggagccggagcttcgctagaccgtaattccgctgctattttcttttcttttgtaagtatgtaacgttattattatgatgaatctgtatattaaattatctgtttgtgtaccttggctgattcctggacgaggattttatgcacaaattggttcggaaattactagtgaatttctgggcgtgatagttgtcaaaggtgtcgtttctacgtaacatttgacacctataagaatatattggtgttggttatcgcttgagctggacacgtggcagcactataggggtcggtttttaccaacaactgtcacctatatgccggtatgaaaaaaaatagtagaccttacaaatttcacagaatcataaaaaatcacagatcatacacgatacattcaaagacacaggtacacatccacatggacaatgcattaaccatcaatacatatatctcccaaaatccctcgcaaagttcagtttgaaacattcacattcaacacacaaatatatatctctactattataaaaattgaagatgtttttatcagtactttggtacgtcatccgtatttgagttggttttaaagttcatttcatttggaaatacaaatccgtttttgagttgtttgtttaagttcattcgttttacaaatacgggagacatataagaaatatcttttaagaaactatgcatgctacctttagatgatcggactccgatcctaattgcagctcatgcgaattcccacagtgaattttaccttagttaaaccgtacaacaataataaaattaaaatagtcttcactcattacaatgaacggatattttttcctaatacatgcatatatgtatgtatacatacaaatatagggacataataaagcgcacatacggtgcacaataactaaaatgctcccctcacctactctccccacccaccaaaaccccccacccccaccccaaaaacaaaaaacccacacccctccccaatccaattttttccgtctgcactccgttccccatttcttttttttttgtttttttccttctgtttacttcattggcccatgggtaaaaagattactagctctactatcaacctacgagtaaaagtattactgagagaaagaaaggccattagtaaacccatgtacttatattattgagatctgctatacgtccgaccaagttatacgactagcgtacaactaaaacagcgaacggtgacggcgtgaagtgatgctgtagattggacctgtgccacaagcccatacactctcatatcatatacataggcccatgtacaagtctaaacccacaatatcatgtcaacatggccgcatgatgcttctgccgaagctttaggtcaatctgaaatgctgaatccactcactgtcaacttgatctcaacattctagtattattttcagtgtagcagatgttaccaagaccagttcatacaactaggtaaagcaagttattttttttattcttttatatagtgtaaccaccaagatcagtttttataactagcttatcattattgattgcgcttatgtcaacaattaagctatgcatgattaactgagggccataagcatttgaatagcatgtgaaaacccacttatactgtcacagccgtaacatacaaacaaatcgtcttaacggacttgtacaatgtaatgatatgaatagaagaaactaagaaaataattgaaaattagcacctgaagaagatccattaaaagctcatgtaagacggtgattccacgcacacgcgaatctgttagtagtatttgtttgttgctgattgcacgaacgcggtcagacatggtagttagccacgattgtgactggcttttggaaggcccaacgagaatgagattcggatcacagcccaaactggtcagctcgcagacgtcacatacgccgtcaccgtggtcgtacgagagttggacgctcgtgatcgtacttaaagcattttcctttttttcttttgggaatttgaatggtaaaaattgctctgaaaattggcacatgatggttctttttttgagcctcaaatgggagcatcgattttattcatctttagtaaaagatggagtatatatttacagctcttagttcgtttgggatggttgggaaccaaactcctccgcacggaaaacgaaacaatctattagcacgtgattaaataaatattagctattttttttcaaaaatggaacaatatgattttttaaacgactttcgtataaaaactttttacaaaatacgcaccaaaatagcagtttgaaaagcgtacgcgcggaaaacgataagggagagttgggaagcaaagtgttccctaaaaaactgatttgaagttggtgagagaacatgacaaacatacttcgacatgtgggactttgtctatagtctgtgtattacagctcatgtttttagttcatataatatcatgtatgccactatgattaggctcctttgacgcacgttgcagggacatgtgcctccaatgtgtgggaccgtgaaggtgagccccacatcttagggactcacgcccctatgtgtaagaggagctgatttcaagccattgatgaccgaattacaagcctcatctttttcttatgcctatgcttataagccagaatttaaatttttaaccttcaatttagagttgattttgggtttttttgataacatttattcagagccaagcaatacctaagttcatccaagcacgatagaccttccaatcaatacatctgaatatatgaaaggcacatagaggacggtacaatagatgccgaaacagctaaaatcggcacctatagtactttttccatccacacaggtacccgtgggggcgtcaaacgaaaaaaccacgtcaccttccaatggaaataggtgctgcttttttaaatagaaccaatacttatatttcctgtcagagataggtgccggttccatataaaatccaacacctttgacatgcatcccatcagaattgttggtcgtgaggcccaccctataaccggcacctttgaggctgtcatagaaaggtgtccattcttagctagaaccagcaactttgactctaccacctagctagtagccattgaagggcccacacttaaaaattggcacctatatttttgttagagatatgtgtcgattctagttaaaaaccggcacctactatcacaatatataccactttcctgtcccctcaagctgatcgagcgaagaacagagcggcacctcttgttcttgcttgaccagctataggaggagggaggttttgctctattttttttttgtcttgttggagcttgaagcatacaaggttagttttcattattatttctcactccatttcactcttgcatgttgaattgaatcgtttgctacatacacatataaagtgcgcaaccgaaacaaattatttgtatttgttttgtaggggaaatatttttttatcatttttgtgttcatttaattatatcatcctcagatgagaccacatgctaattttgaattgaaatattgacatgagagtatgtatttgacaggactacacgacaaagtactccacctggttggagcgcaccccacatgggcctcacttgggtcggggttccagatgaagttacaagcaaataggcccatcataggtttcgcaacacattgtttctgtgattgtggatgactgagataaaatttggcgatgagactggattcgttggaaaaaggactgtgagagcttttcatcaagtacacatggaccaaaaacggagaaggtggacgaattggattccagcacttggaggacttgatcatgatgtcattttattgatccatgatatgaacaacaattatattcatagtagccatggtcacatcaacatcttattgttattacaagtgcggatatttttaacccatgatgaaaaaataaaggaaaacgtactccctccatccacaaaagttgcacatattacttttgacaccaagaccaaggagaaattaaatcaccttggatgttacaaaatcaataagtgaatccaagcatgcaaccaataagcatttagatgactccttgggttctaataaaacatttaatttatctcttcattaagtcttgaatgcataaagactacaaataggaacaacttatttggaaaaactcaaatatgtaatatgtgtaacttttgaggatggagggagtacgaattagccctccgaactatcgcggtcaaccaaattaccccctaaacccgaaaaccagacatcgttcacccagaacttttaataacggacaaattatccccctcaaaccaatccagaatggttttatcctacgtggcgtacacatggcagaccagtcactcttcccctctctctcttctctctcgcgggtcggcggcaggctagggacacggagcggtggtagcgggtgacgcagaggcggcaaggaacgaggaggtggcggcggctatggccgcggccacgacgagcagccgccccctcggcatggggatggatggcggcgggggcgggcggagggcggacgtggacggcggacacggagaccctcctgcaccggagggagttcgccggagctccttcctggagttcgccgctccctcctctctgtcccgcactgtcgccgcctccacgttctgcatcgccgcttcttcctcgtccccggccgccgccgcctccatccggacacgcaggggcggtcggcccgggaatgggcggggttgcggcggcgcactgggggtgggcggtcagcgcggggacggacggtgggcggcgacacgcacggcgcgcccttgcctcgcccgctagggcaaccgccgccgtgtgccgacctcccccattccctcgccttttcaccgtgcccctggctcgcctgccatgggcggcgtcatgcgccaacctcctccattccctttacctgtcgggttgacggcggtcacggtgctcgcctgcccatccacaggcgcttgcacccaccggccatctcgattcaaagtggtcctccgattaacgtgatacggggcgcgctctggcctcccccgctattgaatatcgaatgcgtatcgatctggactgtggcatccttngtcgtgaatgaatcaagggtctcgcccccc

SEQ ID NO: 69986 - DNA, 17836 bp, Oryza sativa
  unsure (1)..(17836): unsure at all n locations
agcattggggggttagaagtttatgcgattaaganataaaggnaacttccccttccccatcgacctcccccatcccctccacctccccgggcgcgtttgcccgcccgtccatgagcaccaccacacgctcactgcccgtccccgcgcctcaattaagagagagagaaagagaagaagaggggaagatgataggtgggtcccatcttttttttaaaaaaaaaaaggtgctgactggattgccacgcatacgccacgtaggacaaaccgctatagattgagtcgaggggggtaattcgtctactattaaaagttgaaggtgaataatgcatgtctggttttcgggttaaggggggtaattcgatcgaccgcgatagctaggggggtaatttgtactttttccaaaaataaaatccagttgttgaaaaaaaaaggttttatattgtgaaatttgcaagatttggaagggttatttctgtcgaaagacaaataggccgacctaaacataactgtcgtgattacggaagtgctaatgggcgatcgatcgcccggcgacaagggtagcgatcgatcccccttcccccctccctccacctggtttcctttttggcaccgcattactttcctattttagtaaatttatgtacctaaagtttatacacctcaagtttacacatctaaagtttatacacctcaagtttacacatctaaagtttagagaccaaaagtttataagtcaaaagtttatatatccgattcaaatttgaatttgaattcaaatattttttatatatagtatttctatacatctaaagtttatagagctgaagtttatagacccaaagtttataagtcaaaagtttacatacccgattcaaatttgaatttgaattatgtcgggaatcaaatttgaatttgaattcaaatattttctatatatagtatttttatgcatctaaagtttatacaactaaagtttatagacccaaagtttataagtcaaaagtttacatacccgattcaaatttgaatttgaattatatccgttcaaatttgaatctgaattcaaatattttctatatatagtatttctatacatctaaagtttatacacctaaagtttataaacccaaagtttataagtcaaaagtttacatacccgattcaaatttgaatttatattcaaatattaatttatagacccaaagtttataggtcaaaagtttacatacccgtttcaaatttgaatttgaattcaaatattagtttatagacccaaagtttataagtaaaaagtttacatacccatttcaaatttaaattttaattcaaatttatatggtgtagcagtaagagaagaaggggaggtaaagtagtaaaggggaggtgcgggtgatcgcttggaaggggagggagcgatcacccgtccgttaggagtaccctgcagactagttcaggataaaatagtgcaggaggaaagcaaagataaaaaagacgggggaaatactacgcaaggaagataatcaagaagtcgtgggctcgtggctatatccttgccgtttacgtgaaatcaacaaggccaaacggcagagaatacgtatcgatcggggtggtgaaaaacccaacctcccccgccgtacgccctcccgaactgatcgacgccggcgccgccaaatcttttcactcctcgagtgctcgatccgccgtgatcatccccgcaattcgcctccgtgctccgcgcctccgccccgctgtccgctataggtaagccgccatctgtaaagtctcattggaagcttatacgtaattcacaaaggtatacacgttattcggtatcttcattcgtttttctccttttattttcttaataatgaataataaatccagccctacatggagatgaatgtacatgggctccttttattttcttaataatgaataatcaatccagccctacatgtctacatgtgagatgaatgtacatgggcacacatggccaatcatcatttgttggaatcgtatgctttgagtttcagaattagtgctatgttttactagaacatgcatctcatcagctgcaaatataatgcttctcgtgagggggagaaacgtttaagcttggtggctcggttcaaaattaattgctcccatgacttggttgctccgactgatctagttttctttttaaataaaaattatttaattgtgaatgaaagtcgttttcacctaggctatgctcgttagtttgttagcaaaaataatctggaatgatataaaaaataagcaaatcataaaaaagttaaatctgatgaaagctcgacaaagacctgatcaagctttttttttccccacaatgttgctactgaagactaattttctatttattcagttttaactgaacttatattgcattcatggttcaaatatcttacaattctggttgaattatacgtcttctagtccagatggttactactttatctttcgtgtcgttttggttcaagaaaagttgttctgcatgtactttattgagggggtacgttttttttcagtactaactagacaaaattgctttgtttatatatactccagcacaggaaaaagtgtcacgaactgttgatagctgatgcatggcaagttcaactccacaatggcaaacgatacgaacaacacctcctcctctgtcattgctactgaaaccacgagcgcgtcacatgtaatcaagattgatggatacacagtaactaaggatctgatggagaatggcgaatttgtgtcatctatcccgttcagtgttggggacttcctctggaacgtcagatactaccccaatggcaactgctcaaagaacgcagactacctgtcgttttctgtgtttcttgagtctcactgggccgaggacgtgaaggcaaagttcagcttcaaactgctggacacgaataataaaccggtgcgatcgcgcaacttcatctccaatacgcacaatttcagcagaagaggttcaaactggggctactccaggttcatcaagaaaagggatttggaacaatcggagcatctaatagacgattcatttactatcaggtgtgatcttactgtcatgaagggcttctctagcaaaggaagccactgtaagccgtctgtggaagttcctgcaggccgtctggacctgcatttgggcaacctcctgagtaataagaagatgaatggaaaagacgtcacgatctacgttggtaaggagagattcagagcacacaaatgcatactcgccgctcgttcgtctgtcttcagggcgttgttcttcggtgccatgattgcggaaacccctaggaccattgaaatcgaagatatggaagctggtgtgttcagattattgctacatttcatgtacaatgactcgctgccagagacgtggtctcaagatgcaatgatggctcagcacctgcttgtcgctgcggattggtacaatgttgggaggctgaagctgatatgcgaggagaagctagcaaagcacattgactgcaacatggtggcgaccactttggctctagctgagcagcatagctgccaaggactcaaggaagcttgcctcgaattccttgcttcaaccaaccaatcttgagaggatgatgagaactgatggttataagcatctgaaaatcagttgcccaattgttctcaatgaactcattgcgagattgctgcctcctaacttgaaagcagcaagacagatagctatggatcttcggtagtgttggtgaacttttattattattatagtagtttgccttgctattattattattattattattatagtttcatcggtaaagataccttgccttgaatgtttagggagaacagaagtaaagttagaatttatctgatgttgcatataacgtcacaaaaaatagttctaacggcaatccacgtcaggattaattttcctgactgataagccagtcctaatggagtaatggtaccccattaggaagcattttcctttaggcaattttacggttcttaaagaggtatcatgaggtaccaaattttacactaatatttggtacctctcatggtacctcatagtacctagctattaagaggtatcaaatttacaataaaaaaattagtacctcatggtacctcctcaagtaccataaaattgtttttttcctttatgtgaatagtgtttttcctaacggtttgtggctatcaggagtaatccggtttgtagtagcaaggccagatgcattggatttgatatgcaactcgtcagttttatttttatacatgcaatttatcaggggcagagctagtggataatagggggtgttcaggaacccggtcaagaaaattttttagctatacctcatctattttcaccatgtatgcaccccttcaatacaaacttaagcaccagcattaacttaaactcgatttaaagtagagtaaattaagcaagtggcatcaccctccatttcgctctagctccgccactgcaatttatattttatatgcaatctttacctacttaaaaaattgatgttgcttaggttcctgtctgtcatatctgcccgactgtgattcgtgcgttcagttcgtaggcagagcctgtctctgaaattgcccgggtacgtatgggacagaacgcaatgggcaagcgtgtgcgttcttgaaaatgcgatgggcttcggttatgattgatcatttccacccagagcagcgtggttccgatccagcatctatcttatgcaccccacgggcatggccgcccaccaggatttcaaattttgaaattagattttctgtcgcgggttgggggggggaggggggaggggcgaaattttgactggttttaaataaaatttgaccaaattcataaaaatcaaaagtttcggacgagatgtgagcattttggttgggggaggtgggtgaaattaccgaaatttcaaaaatttcagaaatttcgaaccgaaatttcaaaccctgccgcccaacaacaaactcaatgcgcggtatccccttgctgtcggggcgtgggctcaacgcaaccagtggcgggagggatagccggaagcatggcgaggagtggctgcgccatggcgacaagccggcgtgcccgttgtgctgtcgatgttctaggtcatcatcgaacatcgggcggtctagctgggtgatgtttccaggtagccttagttcatggcagtggtggctatcatggcggacaccagcgtcaacacattatgcacatcattttcttcccaaaacaccaaaatgggatccccacatctagggacacgtgatgctcactctttcctgtgtcgtttctaactttccatgccgaagttatatatcaatcccattcacaacgtcgttatagttgtagatctagaacttgctttctgaccaactcaaatctttcttatctgagtacgccatccaaattcgtttaatattcggctcgtttactgtttctttgtgttttgtttccttgtagggtatgctagatcttcatcggatgtagacctacactaaaaaaacggaatgtccttggcggccaaaaaccgccaaggatagcatataaaccgcctaggataattattccgtcggccgaccaccaagaaactaccaccaagtctagagtgccaaggatatttaaatttattggcggctaaccgtaagtaaaaatattcatggcggtcaaaccaccaagcaaattaagaagattgccatctttcgaaagcgtcaggaaaaatagccttgtcggttttccaccgccaagaataactttaacttggtggctgcgaaaccgttaagaatactaactgaaacgtcccgcctctcttacatctagcagcttttctaggacatagactgccctcacaaaccaacacaagtattttctacacaatatgtcctcactcgcttaacctcagagttctttggagatcaacttcatcttgttacaaatacctgaaaccaaaaataattattttttctttcacaagctctagccaaatttttttttattagtacaaggctatgaatgcacggagcaacaggctaaggtcttccatgccgctggccagctgcggcatggcctccagcttctcctcctcaggctcctccatggcgtcctcctcctcctctgcgcggttcagccgctcgagtagcatccacctcctcctgtggcgcccatcgggacggcgagccgggcccgaaccggtggcaccatgttggcgcggacggcacgaaggcggtgccccttcaccgtgatggtgtcgcggtgggcggtaatcctggcctcgatggagcggatcctcgcaacggcggcggcgacggcgtgctcctgcacaaggtgccggaactggatctcctggcgcgcgtaggcggctagcgtggggctccccaaccagagaagctcctccacggtgtcgagcgcccgcgggacgacggaggttgtggggggggggggggcgacagcggaagaggtcgatgttgttgaactcgtcgatttggtcgaagcacgcctcctcaacaattccggtggtgtggggattggaggagaagaggatggagtggggaagaaaggggacgagaggatggagtggggaggcagttgccattggatgaggagggaatggacggttgggattgagatcacgggaggaggcgcggattgatgacatggcatgagggcagatcagtgatttggcaggatagcgggaattttcgtggtctgagaggcggccaactcaaatttttgacctgcaggtgcgcgaccctggtaatagggagttggaatttatattgacagttttgcttgtaaccgccaagcaaaatacatatttctttgtctgctatggaatagccgccaataaaatttctttatgcttggtggcaagtttgaaccgccaaattaaagtgtaatcttggcggctgatttcagaccgccaaaaaaatcgcatggccgctaggggcattcctttcttgtagtgctgcggcatgaccagatgagccgggcagtcttattcttattgtgtgtggggcatgttagatccgatcaaggccctattatgcatgaatggcgtaacgagtacgccctaggatggtgaccacgcaaatgccatatatattaccaccgtcacccttggtcgtcctacatggctgcatgtatagctatcaccatcatgggtagcagtgatagccgatgctgatcaagtgaaagaacaatctaaagaaacatgtgcatgcttgagatcgcacttcccacgatgcaaatatgcacaatccggtgaatccatcaatagtaataaggaatctgatcaacaagattgctcgagtggtggggagaagagaggagaggccagggctggctcaacattttcgagggctctaggcgaacttcacactataggcccttaagaattaaggctatttcttttaacttataatatatactctataaagcacctatactatagtgatataaataaacatttctaacatggtaaataataaatcaagcagtttgcaaattgcaatatagtaatttgttctcgataaataatatcgatagtatgattgacaacttaaaacactacaccggattaggttacctctgatggctccaaaccaacactacaccggattaggttacctctgatggctccaaaccctcaccattgacaggtttgggcttggtaacagattagtggtcactagtgaggaccagtcacctttgacggaggaccgtcactggtaacagtcacctctgacggacaagaactctatggcccgttaaaggtaagtgtctccgctaacccatggcatgttacaacccgtcataggtaactcatttgtgacgggtcggagagtaaaaaccgtcacaggtgactttcttgtgacggcatgtatgtgcagagccgtcacaggtgacatcacaagtgacggcttttgcaatatcaaccgtcggtgatgagcaacatgtagaaaaaagtttctaaagattggctagcctcccatgccctctaaaagaatagaatagtcacatgcattcaaactaacatcacacatgcattccaagttgtcaccgaaaatcaacaagaagttaatagatcaaatgttcatcaaactagaagtataagcgcggcgtgacctgcaatcagaaggatgattaacagcttaagcaaagcaattgttaaacatttgtagcttctttttttcaaccaattcccattctccagacaaacaagaattaggaccatgtctcttacattcgtactgccaaaattgctcatagaaaaagaaattacaaattcaaaaattagaaagtaatgatgccatatcagaaaagagctcttttgagttttcaaatatagagacatgctaccaggccaacatcatcaagttcgagaattaatataaaactcaaagaacacaatggcttgcacttagaaaagcagagtcattcaattatctgctatgtcagcaactccatagtctatggagcacctatttacctgcaagcaaaaagatggcactgaattagtttgatatgagaacaatttgcagaattaaataagatgaataactaaagataagcaaaggagaataggagtggaagatattagctaggtaatccatagtacgtgcaacctatggaacaatagagatcatgtattctatctgagacaacagagatatatttttcaacaactcttccaggacctatgcacatataatgagatacacggcacaaaacaatttatgatcgtcaatctactaaattcaagaaggcatgtggataagcaaaaggattgcagcaaacttgtacaccaccttatgggagaagaggatcttgcagcaaaattgattttctgtaattcctgcagccatctcatgggagaggatcttgaatctctgaatctcaaagagctgcagcaactggagaagcagctgaaaaatacatcgaaacatatcagatccagaaaggtactatttgtcatgagaacctgaatagaatagtcaaatcagttctgcaagaacattttagatcatgcacataggtttgctgtatttgacaaacagattcagatatatcacttcagcgcaataggaatctacacatcattcagaggatcagagtatgacaaactgactagcagcttatttaatgctcaactcaactaaaatagaagcagcaaccttatttaagcgtggatacattcctacagacaacaaatttagccatgcaaagaaagaaaaaagaggataacacagaagctcacctccaaagatgtctagctaatgtagccggtaggtggtgactgcacaggatgaggagaagcacatgctcgccgtacagccgataggccttgacggcggacggcagcgcacacagccgattggaggagagaggagacgccatccactcaccatgagcctggatctggcgctgttggcgccgaaggccactggatctggagtacccaaactcgggacagctagatccacagccccccgagctcgggttgtccaaacttggagccctagccggcttgtggtcaccggcgttgcacctccacaccgttcgccatgaccgtgcctctcctcctgctcctgttagatctggtggaggggagggcgccgccgccgttgggccgccgcacgctcccctctgtccctgccaggccgccgctgcacacagagagaaagggagagagagagaagtggagaaatcgaaagaaatggagagagagagagaagtcggccttatctcctccgggagtgggcaccgccggaagaagaaatatctccttcggtttgggtatatagtggcacaactcaccggacgggttagtgcttaaatccgtttgaggtgagtaacctcacttctgatgggtcatccggttacgacccgtcacaggtaactagtcacctgtgacgggctggaagtagaacccgttacaaagtactatgacctaaaatcagtgagggaaaaatctatataatcaagggcctaggcctaatgaaaactaatccaccatataccttaatttaattaacttatggacttatggtgcactaaatggttgtatacttgtattgattcctttaacggttgaacccaaaacggtagcaccctaagtctctaatcaaggtaatttaatggggaacaaaaataaattagaagaacagatcaattctaatcagtgagaaggatcgatggattggatcatcaattctaatcagtgagaaggatcaattctaagctattgggctaaatacctatacaggatatatacctggatcggggctccgattttggctgggccctaggccatcgcccttatggccctgctccaaagccggccctgggagaggcggagagggagataaaggagttgacgagaagaatcggggagatattttcttttcctcccatccatgcttggctcagctcaatatgtgatggttctttaaaacaatctgacacagatatttataggtgccaatttttttataagatgctcaagatgaatgcgaaatatcttatatgtgtcatttagagcaactggcgcatataaaggtgtctgttgatgaaaaaaacacatactggtctaagagatttgctttactctaatgcaggtccaaatcttaattactttcgggttgagagcgtgccaactggtttaattctacagccagcaagaaaaacaagaagcaaagttagatgaacaatagtcgatcggctagtaagccgatgtcgtatcgtcaagaattaagccaatgcaatcagatcgaatcagctcttgtatgatggattaaaaagagcaaaaccctaaatatgattcattggctataatattaatcatgtagtttaatcaatattggaaaaatcaaccgatgacccaatatttagagcaatgtattactctaatacaaacttatataaaagtgttgatcaaatcaaatgcaccaaatatgccccaatcctcagatatgatgatctgagctagattgaatcatgcttgatatatttaaaaagacaattctcttatataagtggtagatacaattatcaaacaagttaaaagataaattcaactgtatcaggtaagatcggttgaaactccgatgctatccttatttttaatcaattccagattagtttttagagttctagacaagagtagggttgatgcaactcaaagtatgtaaagaaaccttgattgagctacgattgggttctcattctcccacgtgtcgctctagcacatgctgtatggatgcatgctatggcggcattctggcgatttgtacccgaagactaattaaaattgcatccaaaaaacaaattagatttggattatgagtacagagtcgcgaagcataattttgcattcgattaaggattccaatttttaaaatatcagtaaaggaccttcggtccatagattctaccgacccgcctagcaatcaagctcttgctgctctgcgagactgggttttttggaaagttggaacgacatacaaatgttgttaaatgccgcacactggtaaaaccctccaagcttacttccccctaccaatctgaatgtaaaagaagaactaaatactactatccatgagatcatcataacaaaaactagaattgcccagctaaataggaatagaaataaatccagggtaagaaagaccctttctctaaaccctaaagctttgcagaagtacgaatttgaaaaggaataggtcttgcttggaagaaaagggaatttggttgttgcaaagcaaggggaaaactcatcctcaagtaaggcaatagttgcttgcacagaaacagaaccatggggaaagtgatctctgaccgcgtgcctgttgaagaatgagctagggtcaaacctatccttggtttaggcaatgccaacctttcctttcgaacaacggtacttactgcccgtaaaacagatcggcacctatcctcggtctcggctatctttacgccttagaattcattcataaaatgacaatgaacagtctttatggctgttttgctatatcgcctgaaagcactatgaccgtcggtgaaaaagaatcaaagagaatggtccatgaattggtggcaagagagcgagttcgactcgcgaacgacccgcaagtgaaggaccgatcctttaacgccagtagtgttgcgagactggtacttgggggctcacgagcaacatatagactaaggttacccatcactccctcgctcctttttgaaggcccactgctccccctttctttaagcatctatcccggcttgcattttgggggcgagtactacaattcctccataatcacacagaacgcccagcttcgcgggctttgcctgccgacgttctaataaagaattctggctcggcccaggaaagtgctggcaacaacataaagaaaggcaatgagcaaaaatgtcactcaccggcctaaacgacgagcaaacactcgaacgtgagagcaagggatcacccaatgaatgggcgacccccaaggaagggggagagagggaggcaagaaccatgctttcagagaagtggcggtccgaatccactctgtcaaaaaaaaatagcagactaagccgtgccgagatttttacccttctctaaaaagaagtgtctctatttagagatttctctacttagatgaataaatcatactctagatatattattaacgaatatgtatcccaatccatctcgagtaatttgagaatatgcatttcgaaatgaaaagctatccccagaaaacaaagaaaacgaataggggcgtagcgaaggcacgtgacgaggcacctcgagggcaattagcagatagaatatctcctcctttgctgtatctccccagcaaaacacgtgcacaaagtaaacaatccagcaactgactaattttcagaatggtagataccttagctaatctaatctagcaagataatttaacagataccagttgtcgacgggcaataccgtgactacggtattttgcatagtatggggatcattggtaccaggatatatgcgagattgaagtaaaagagatggagacaaggttttttatacaggtttgagccctttacctgacagataatatccctactcctattgtctgaagcatgtgttgctctttattcatcataaccacaccagtacaatgtttgggataacctatctaaccgttatcgacttggcggcctagaatacaaacacgtagtcagcaacagggtagtttttctcctcgaatccgtacttagcgagatcagagatagcgctagatccttcttgccggcctccacagacactatctagggcttgtctaggcttactctgacatcgatatttggcggcttgttttggcgtgtgttggcttgtattggtctatgtatgttgtgccttcgtgtgtcctctccccctcctcctagggggtctatttatacgcataggtgtccacttaaccaagtagaactagggagaccaatatagatacaatccgagtagtccatatagtttccatattgaactctattcatccttccttatccggaactccttgtatattcgaggtatgattccgtataagattttgtcaaggttatggataccacatacctaatagtagttgactaaatctcggcaagacccaccacataccatgtcttatacgggaactgacttcagatatggagggagttccggataaggaaagacgaccagagttctacatggaaatgacaaggactactcggattgtatccatattggtttccctagttctacttggacaaggggacacctatgggtataaatacaaggccccctaggaggagaggagggacaatcaacacccaccatagagaatacaaaacaatagatcaacacagaagatcaacataccagccaacatacgccaagacaagacgtcggatatcgacttcagagataggcacagctagtcccctacggtgtctccggatactaggagagacattgcgctgtctttgatctcgccgggcacgaactcgaggaggaaggctaccctgttgtcgactacgagtcagaccttcagaccgctatgtcgacaacagttagataggctaccccaaatattgtactggtgtgattattgtgaataagagcaataccggcttcggccaacaggatgtagggttattacctgacaatgcaggggcctgaacctatataaaaaccctcgtctccgtctcttttacctcagtctcgcgtataccctagcaccgacgatccccatactatgcaaataccggaaccgcgacatcaaacgtcgacagatttggtatatggtgggccctaccgagcttagtaaactactattaggtatatgatatccataaccatgacaccagtataaacctgttaacaaccaaatttggcagtatcaacatcggagatggagattagatcgaggtggaatcgaagacgaagatcgatttgggaacagagtaagagtcggctggagtccaaatcggctacgattaggatcggctgagtccgagtcaggctgggtaagccgatacagccgattccggcaagatgacttggtgtacgacatcaggttgacttgatatgcttcaagatgattgccatgcatggatagagtcctgagaaggcaattatatctattaattaggatattttatgtaattttcttagagatatgtttgggcaaaagtctaccataaagacttatggtatcttagagtttgttagagataagaatcgtgtccgatatggacatagtttgtaattatcgggtacaaatagaccccgaaccccatgtaatcaattaacacacacgttcgatacaatctcggtgcatcgccacccttcttgctttagttttatttcgacaagttcttgtttttgggttgagctgcatcggtttcgatcttcaacaagaggtaaaacttgttatgacggcatgtgttctcgggattagttcttccatcttatgatactctaatcttgtttatgtaaatccaccgagttatcatatatgttccataatctctagcaatatcgctatttaacctacaatcgactaacatctgtcagtagagggcagccaattaggttaaatatcgatgttgatttagattatataagatatccaccactctatgaaacttccggcggcttgattatctagatattgttcttcttttcatacttaatgccgcattagttgagtttgatctattaagtcgtgcttggaatatcaatctctaacctgccttctggttgccgattagggtagtatcgggatttcagctgatcttatctgatttaactacatttgctctatatgttttattgacatgttaaatctgccctttatgtcaagatcttattgcatctaagtatattaagcttctgtttggtacattctgtttgttttaatatcttaacatagagtcgtattggagtattagccgatacatgctagatctatctgatcggctatgctatgaacatatatagtcttgttgttaatatatatttcgatctaagtgatttatactgtctcggcacggtgaccgatctatcccaatcacttgatttaagtatatatcgacaccaggattatatattgttaatatctacagccgatcgagtagatttagttctttattatctatttataattgccgatcgatttacatatgacatcggctcaaagataaatgatacgtcatcggcacctagccgatcggctatcatttatggatttaactacggtttttttgtctttatttcttgttgattacaggaccaaatcaactggcacgctagcatacccaaaggcgagttttggacctgcactggagttaagaagatctcctaggcctcgtgtttttcatcaacacgcttttggcacgcctggtgtgacctgataagaagtcagcatcgcagcagcggtttttctccatggaggaaaagccactagcatcaccatcctcggctagcccaggttctgttaaagagaagatctagcagttgggcctatccgaggttaatgaaggcaacattgtgaccatcactccagacaagctgcacctgatcaaaagaaggattttgaagtgatgatgcagcaagcacggaaccagtttttaagctcatttatgcaaactcgcaagggaatagtggtgcagaagtataaggtaaaggttgtcgctgatgttcctgggactggttcttctaaggatggagaggtgaaacaagctctagatggctcggctcaaccgagtgataaaggtgctacaaatggttctcaaggaaatcaaggtgacaactctcaaggagtacagggagttcaaggtgatggtgctcagggagttcaaggtggaggtgttaatcaagacagcaatacaacacagttgcagttcaacaacttccaagatcaggttgactatgctgtacaccatgctttgatcaatcaatctggaatattaaccaatactttggcaaacatggtgaaatcaatggttgatggttcaatggctgagtataaagctacaggaccagtttatatactaggaggagtgttcccaaattataggccattaatcactgacaatcaaccagttgtccagtcaatccctctcaatgcaccatcggctcagccgacggcaccaataccggctcatgcacctgctgcaccgtcatcggcgccaggccaattagttaatcctcggttgctggtgagagaacaaccacagcacagcggacagaatgtgaatcggctaacgcaagaccaggttgcgtctacgttcttatctccccaacacactgctgatccaacccagcagtagctgattcagcaaacgccaccaaggcagcaggttgtgcagccgacccaaaaaacacccccaatccaacaggtcgtacaaccagttcagcagacgcttcagagatggtaggttttgcagccaattcaatagacgccattaaggcaacaggttgttcagtcgattcagcagcaaggcttaatgaatgcatcagctgggtttgcgacacctgatggtcagcttgtgcagcatgctgcaaatcaggtcgtcccagagcacttggttcatcacgtgcaaccggatggcacggtgatacctcaatacctcaggttattcctgagcatttggtgcgcaatattcagccggaccttcagaattaccaggggggcaatttgagttatcagtatcagccgccatccccgcaagttcaataccagtaggcaggatcggctcaaccccagtttgttcctcaatacaatcaattcgagcccatgacacagcaacctcaaggaacacctcagcaacgaccatggaccgatatgattgcggatgtcatgaaggagcagtttgggcttaggccgaaagatgctggaaatttgtatcgacaaccttaccctgaatggtttgagagtgttcctctacctaatcggttcaaagttccagatttttcaaaattctcaagacaagatagtacttcaacatacaaacttgttagccgattcttagctcagtgtggtgaagcatcggctgtggatgccttgagggttaggttgttccggttgtctttgtctggatcagctttcacttggttttcttctttgccatatgggtcgattaacagttgggccggttgggagaaacattttcacagatatttctatagtggggtactttaaaaacgtcgagcctggtaaaccccaggcgatcccaaacttaatcaccttgtggaacatccccctttcgctatagggcgtg

SEQ ID NO: 69987 - DNA, 35834 bp, Oryza sativa
  unsure (1)..(35834): unsure at all n locations
ggaggatgantttcgataactgatgtaactattccatcagcccacagctgaccantggtctgcatttttgctagtggctgccttaaatgggctgcttgttctaacacatctacagtggaagttgtttcatttttgcagcaaatgaaaaaaaaggggtggcgctagcctaaaccatttttgaagtagtgaacgtgcaaaacttgtgcagaaattaaagaaacgtattatgtgattgttcttaacagaagagtttaattattgtcaccattcaagggagtaaatacaaggtttgtctaggagattgtctatctgtgtgaaatcatgaaagagtgagtgctattcttctgtcagtatcttgaaccactatctttgatcatggaccagcttagtacaatgttctactgggctgaaggtaaggggatcctgctgatgaggtgagatgtcctagtaaaaaattgagaagttgtgatggaggccttcaatgacatgaaaagtgatgccaaggtaatgtttccatcgatgaaagagtgttgtggacttagtgaatgcattacatgtgtcacgtatagttctcttgtatgttgtatggaacccgtatgttggaaggtaagggatctgccgagcttatagaattggtcaagacaagattgtgtacacatacaatctaatcatagaaggaagaaaggagagaaacaaatacgacagacaagccaagaaggatcatatgtatcaagcttgttacaaagaagtgatgttcaatgacaagatagaagcaatggcatcacataggagctcaaaggcatgtttgtgttgattcttcattttcaatgcctgtaaacttagagctaaatcttataatttgattattatcagattaaaatgtcatttcgattcatctgcaacaaaaatgtttgtaatcttttcatgttgtttgtagaagtagacatgacattttctaagattcatcaatatctaaactatttgcttctctagaagagaagcacctggagcccagctaaacagtttcagctccacctaaaataggagcggagttgggtggaacactctcacaaaataaactaaaaatgtggagcatgagttcagcctactccactatagacctaatggaacaataaatttagaagttgaagctttaataaatagccccttgctattcatacttaaacatttaaaaaaatctttaaattgggtatatactcaatctgaatgttggtgccccagttaattttactctttgtgtgtgtgtgagtgtgtgtttgtgtgtgtgtgtccgtgtgtgtgtgtgggtcatctttgatgggccaaaaatatcatgttcaaaatatggttactggggaggacccatcacacatatgaggtcatctatgacgtgtcgtagttgtaacccgtcatagatgatttgtgatgggtgacaaccatggctcgtcatggatgacatgcatccctgacaagtgtaatatcatggactatcatagatgagaccacttatgtatgacgggtctttaactgacacacgtcatagataaagttatctctgaatggatgctagctttacgacccactaatgatgagtgaaaatttaaaagtttcgaattttgcaaaagaaaaactcagattgagacatgccctatataaagttgtagttctcaatgatatctacaactttataactaacaatattttcattacagatcgtttacatcctcgggtaagaattacaagtgatgagatctacttttaaaaacaaaattttgagttttttcaaatgacctggatggaaacatgccccatatgaaagtcatagagcttaaacagatctacaatattataattgacaatattttcatttgaaatagttttgcatacctgaatatccattataaggtgtgatctattttgaaaaatgaaaaattttatttttcttcaaatgacatcggatgaagatattctccatgtaaaagttatagaacacgatgagatctataactgcttagttgataatgttttcatttgatgtcattttgagtattaaataaatgttaaattattcgaacattaaatatctgttaaattattcgaacatttatagaaaaaataataacaatgaatgagtactcaacatgtgatgagtaggtgagttggtaagggggttctttgtggatgtggatgtcttgagtttgaaactcactatacacatgcatgtctatattgtgcggaaaattgtggatttgtaggtagtgatgtgtgaccatgtataggatggctagtaaaataaaaaaatattttttttgagtttttttgttgctttaaaagttcaaaaatcgtaattcttgctttgtcattagtgatggatcacaagttacaacccttcataaatgagtcatcagcgatggacggcaagttacgacatgccactaatgactcatctgtaacgagtgacaagttatgactcctcaaagatgacttacaaacctgtcagagatgagttgtctatgccaggtgttcacccgtcacatgtgagatttcgtcatcagtgaccacttatctctgacgagggctgaatccgttagagatgacggtttgggcctatcagtgttgacctcgtccggcgtagtgacaagcatgattaaagtttcttcattgattaaataagtctcaactaaataagtaacacttatatactttttctaataggacgaacagtgaaacatcatgttaaaattcaaaggtctcatccatttaaaaaattgaacggaatatgtgctgctggcattgacctagataaccgtgtacttcttcatgtgcagcagggtgaccgagtgtccggccatgagaaagacgacctgcagagctctggagtctggaggtctagctctttactgaacatgttgtccatagctcaaacgctgaaaatagcaagaggtagtactttactggaggtctagctctttactgaacatgttgtccatagctcaaacgctgaaaacagcaaggggtagtacattactatcaattttcagtaaactgattactgaaagcatctcgaggtgcctctgctcatatttttttcgtttgacttactctcctacattcagatcggtctagcttaactcatcacgcctctactattaaacattgcaagaccttcagaatgctccatccatctccagaatcacatcctaccttcagaatgacagacaactgcaacactttctccaccattgtcgcggaggccgtgagcgggtcacatgtgatcaagatagctgggtactcaagaatcaaggtgttactccgcaacggtgagtccctgacatccatccctttcagcgttgcaggccacagctggaccatcagattctaccccaacggtgattccgcggagagccaagattacctatcgttctatctgatccttgactccgccaattcctacgacgtgaaggtgattttcagcttcgagttgcttggcaagaatgggagatcagtgtcgtcttacagcttcactacagatctccgcaccttctcctacaaaggctcattgtggggatacaacaagttcattcaccaaacggtattggaagaatcgtcagcccatttaagagacgattcgttttccatcaggtgtgacatcaaagtgttcaaggagatctacagccaagaaaccaagggtgttcatagcaagtttgtggaggttcctccaagcaacctgcatcaacatctaggcaacctcctagacagcatggatggatcagacgtggtcttcgaggtcggcgaggagagattctctgctcataggtgcgttcttgctgctcggtcatcggtcttcaaggccgagcttcttggcaccatgaaggagaaagccgatggagccattcaagtcgatgatatggagcctggagtgtttaagtctttgctgcatttcatttacaccgattccctggacacgatggctcaagaagatcagagcagagacgaagcaagcgaggaggaggatttggtgatggctcagcatctacttgtcgcagcggaccggtacaacgtcgagagactgaagctgatatgcgaggagaagctatgcgagagcattgactccagcatggtggcaaccagtttggcgttagctgagcagcacaattgcaatgggctcaaggaagcttgctttgagttccttgcatctccttccaacctactggagatgatggcaagcgatggttatgaccatcttaaaaccagctgccctgctgttctcaaggagctcactacaagatttctgcctccggaaacgaaagcatcagaagagataaccattggtctatataattagttcttcaagtatgcttattttgattgtgataatcgaaaagaaagttttttttagtgctaatgccgtggtatttctgcaccttagaaagctaccaagtttatctttcctggaagtaatggccttctatggatcaagtttttcagttgtttctgacattttttttccttggttttttctgaagtgcaaaatttgaccatgtatagttagtccctctatactgatatgctattactctatagcccttagaaattccatgcgtactatcatatctgaaaaataattaattgtgtgcatttcaatagtcctatttgtaagaatttctttgtttagtagatctaattccagaaactaacataccgtgaaaaactatatatattaatatcacagtgcttttacatgtatatttccaatacgatccatgagcacagaggaattttagagaaatattgtaggatcgaataacaagactaagccttccagagagaggtgaatggtcccaacaccaaaaaccgaaaacttttaactgaatgaaaagtcactctcgaactgatggagatcggtctgaccggagttgaggcgctggtctgaccgcacagatgcatccggtctgaccgctgtagccgctccgatctgaacgtccgtggcattgccgtcgtccattgctgctgaggtgacgccggtctaaccgctagtattcctctagtgtgacaaagttgaaagtagattgatttttattacttctatttgtgtttacaaagtgcaacaacaacactcctcgcacaaacccttctccatcggaaagatttatggaatggatcagtcatgggtcaggcttatccaaggtcactgccggacccaggggttccaggtgtgcaccggcatactcaaaacttccgaagtaattgtagacctccgtttttcaatagatggcactgttgactttttgtcgtacgtttgaccattcgttttattgaaaaaaaatgtgagttgttttatcactcaaactactttaagcatgatttataccgtatacatttgcataaaatttttaaataagacaaatggtcaaatatttgttcaaaagtcaacgacgttatctattaaaaaatggagggagtacgtatgagtagtttgtagcagtgggctgaatgatcaatgttcgcaacaaagacttcattgactttttaggccatgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccttagtccttctaggacaagacccattgcaggaaagacttcattgacaaaacctattccataatcctgggactaattttagtctctgtcacatcggatgtttggttactgattagaagtattaaacgttgactaataataaaactaattgcataaataagagctaattcgcgagacaatttttttaagcctaattaatctataattagcatgtgtttactgtaacatcacatatactaatcatggattaattaggctcaatatattcgtctcgcgaattagtttagggttatggaacgggttttatcattagtcaacgtttaatacttctaattagtgtcaaatatccgatatgacatgtagtcccttgatccaaacaggcacatagtccattcgctgatttctgaccatgattcccaaacggaggcacgccgtggctcaccgccaatcgggtccagcaaagtggcgatgtagctcaacaagtctttcacatttttacaaactttacttcctgttggggccaaggttatattcagtggcaaaaatgttcagtagtgacctggcagaggtctttcatatgccactctcatatcaagattgtcaggaattcctgaaaattagctcggaaatacaaggcacggtgttaagctccaatgcagataaccggagtactggacatatatatggggtcgacacatattttttttatgttttgaacttttttattttttaacttaaaaatagaccctgcaaaagttatttccatattatgatccttttggctacgtcattccatctgacgtggcaaaacattactgacacgccacgcatagcgggcaaaacaatactgacacgctacgcatagcgggcatgatagttctattttgccatgccagcgagggagacgtggccaaataacgctgccatgccaaccagatcggcgtgaaactgttgttttgtcacgttagtccagttcgcgtagccaaaaggttcgtatcttgaaaataagtgttgaaagggtttatttttaaaattaaaaattgaaaaagttcaaaagataaaaagaattcgtcgacgcacctactcaaagattgtgcaaattcttcttcgctggaatgcaacctccgacggggtcttttgatatggaagaaaaggtgtataataaaaataaaagttttttggctggttattgttcaatgatcagctaaatacaagagaaatgatggatctcgaacattgtgcatctctaaatgcaatactcacttgttctttgtgtgtcactgcatcaagagaaactagaacctagctgttctttgactgccctttcagcagggcctgctggagttggataggaatgcaatagtctctaaacttctataaaatcgttgttcttgtgagattgacactgttacagaaatgatttttctggatgcccgtcccggtagattccagacgggttgtaagtggcaccgtctggaaaaaccgggcgaccggtgccgggctgtcgcccgtacagaaaaatgcattatctcatgtggtcgacttaagaggaccacacggaaaaatcaattttcgcgtgcgagcctcttaagtgaaccgcacgggaaaatacatctccatcttttccctgtcacccacttcaaattttcacatcctctctcttccttttccctctcaccacttcaaatttttcacatcctctctctttcttttccctctcacccacttcaaaatttccacatcctctctcttccttttcccttttattctccctcactccctcctctctctctccttttcctatcctctccccctcccctctctctctctcctctctctctgcctctttcctctcgtcgaagacgaatccatccaaagctaagctagcctgcatgcacttggtcgatgaagtacggggcgtcgccaccaccaccgctgatggcgcgggaggaggcgcagtggctgctggcagaggcggcggagcggcggctgttggtggaggcggcgtggcggcgacggcggatggtcacggcagaggccgggagcggccgcggtgcaacgaccagcgacgacgaggacgacggtgaccacgagcggtagcgcgacgacgacgaccacgagcggcggcggcgcaccgacggtgacgacgacgggagtggcggcggtgcgacgacggcgacgacgaggacagcgacgatcgcgagcggcagtggcggcgggaggagcggtggctgcgcgaccacggcgacgacgacgggatttcttcgattttatttttctcggtttcttttatttccgtgcgggtggtataatttgtccgcacgggataatcgattatctcatgcggtcaacttaacacaaccgcaaccgcctggatgcgaaaatattgattttcgcagacacctgggtgcagacgggcaggacctctgtacgaaaaaatgcattttgaccacacggagaaatcgattctgtagtagtgtgacattcaggaggaacggatttatggaaatagcactactagctttgctggcatttcggaaacaaagaaatgctcttatctttcagcagattcagcctaatgttaacagatggtttgactgcttcagaaatgggattatcttgcttcaggatgaatgagcaactatacaatatagtgctgttacaatttctgaaattgttctgttttcctcttcctttttcttttgtacttaatgttttctttctttaatccgtaatatttaactactgggccttaccagtaatgttcccttcaaaaaagatcatacttcaaacaaagtgaaaaattatatttattagcaaccttttgaattaggactagttgtttagtagtcaatagaaagctcaaagtacgaatctactactaattacatgattccttatttttgatccaaatcacaataacttggaatttatgaagtaatgtatctggtatatgtacgataaatttttgaaaattaataacatcaataataacctgagggagtagtatttacctaatgtatagtttctatacgtgggaccaaatataataaatttatctattatcttctcttttttgtatttattgatttgcctgccgatttgtgtcatatacacttttttggggaaagtgtcatatacactattttgatcctagtacaattttacttgtttcttttttcagtacaatcttacttgtttcttttcttggtgtactcggtgtcttggtaaaacatagtttatatttttcagacctcactaattctcttgtaaaattgtctcgtgccatgtcatttggagtttttttactacctctcgttcttaaatctaatgatggctctttggccagcctccatatccatggtacgattggtcagccattctgaaacagggcaagcaaatcacaaggtttgtcttggagattgtccatctttggtgaagccatgaaagagcgagagcttgtgttcaatcaatgtcttgaaccactgtctttgattatgcaccagcttagcacaatattccattggactaaaggtaaagagatcctactgatgagtggaaatgtcctaggaaaattttgagaaactgtgattgaggccttcaatgacatgaaaagcaatgccaatgtaatgcttgcatcaaccgcggagtgctataaaggtattacacttgttggggcatcgcatgtagttctccttgatgttgtatggaacccttatgttcgaaggtaggtaagcaaccaagcttatagaattggtcaagagaagattgtgtacacatacattctaatcgcagaaggaacctagtagaaagacaaataagacaaacaagcaaggaaggatcatatgtccaaactattgttttcgaaagaaccacatcaataccaaagcctgcaggatttcaacttgtcaaaaaaagtgatatccaatgataagatattggaagcaatgacatcacaaggggagctcaaagacatgtttgtaaagattattcactcattgcctgcaaacttagagctaaatctagtaatttgatatttggaggttgaaatgtaatttgatcttttgagattaaaatgccagttcggttcatttgagaataaatatttatattttttttattatgttgtctgcagaagtagacatgatattttctaagattcatcaatatatgaactcttggcttctccggaagaaaatatccagaatgtggagtatgataagctcaggatgttgatctggttaaattattcattgtcaggctatgtgttgattgcttcaatattaaaactaggactatttgctcccgtgtaatataatgatttgctctctttcgaaaactgttgcaatggaaacatgaagtttccatatcgttggtaactggtaagtatatggaatggcactatagcacatccatataagtgcttccaacactagttgctcagcatctacatcctttaattatctcaaaatttatgaaagcagctacttatgtgtttcttatttagagatgcaacagagcatcttatctgtggagaagaaaatatatgtgtgcacctccattctatcaagatggtgcttcatcgaaatttctttacattatgctcagataatttaatagaaatagtagaaaactaagggtagtttcttcctgattttggaagaactgagattatggtaattctcttaattgcttgagctccagggttcattgagttcttaagctagatgcacgaacggatgactcttgagatgatctgttcttaaacatgcacgatggattgatcacttgattgtagcatttttacaataactggttggtgattgtttagcattttacttttgcattctggtcatcgtaataggctgatgcatgcagatatgatgctggagtctgtgctatccatttcacctgtgtggtggtgtgtttgtgttgttgttgccggtttatatgcaatctaaacttatttggtatatgtatataataaatagagaaaatccaagaaatgcctttgacaagcgcccaattctaagaaactagataattccccacgctttgctgaggaaattaccaagtaatttttattttttaataatcgagcaaaaagtaaaaattatattagttattaacaacaaataaaactggtttgtcaaactacgttaacagagaaataaatttagtagactctgtatgagattgtagatgaaatatgatatcccgcactttgattatatggatgaatatatgttaattattataaaaatgatatatatatatatgtgtgtgtgtgtgtgtgttaaaaatattgtgaagaagatgattggatgttgatttgtagaattcaatgaattatagatgatgttgcatgcttgtataagttttatatgtaattattgctagtgaatgatgaggtgacatgttttcatgttgagtttttatagatgatgttgcatgctggcataagttttatatgtaattattgctagtggatgatgaggtggcatatttgcatgttgagctttagaattagtgggttataactttatagtaagatatgacgcattgataagtacgagttccatgaaatatcattgtataagtgactatgtcctagaagtgtgatcatcgttagagttttgttagtaaccctccgttaagtgttataggataaacagtgctagttaagtgttataggatgaacagtgcatttaacagggtaggatggatggaaccttaatggcgatgacattttatggacaaagtcgcttgtacaatggtattttatgaaacttgcactcttcaatggtatttcttggacttgggcatttgtcaatggtatttctggcattttctctaataaataacacgtctcattcacaatttcatttgcatatccctgtttgtaattctagaactcaatgcttcaaaaagtagcatttaagtgcacgaaaaatttttattttaatatgtaaattgcagatatcgtatactttcttgtctgttttacatactacatgattgaattttcctgtcagactgcatatttgaaatgtgctcacacggtcataccgctcagaaagttttcgatctccttaattgctcgttctagtttgctgctaatatcacccaattcccacaacaatgatgtatgtggtcgtggattttgccataagttcaaaataaacagggagaattgcaaatagatcccctcgctgcctcctctctcctggataagaaccgatcccctccctctcactgcaagaaagggatacagggtagcggtaggtacttcgtcggcggcaatgcgcggcaagcagcagcagctcaggacagcgcagcagccagcaactagtgggtaggctggcagcggcagcagcagctcgcggcaagcggcaacagcacaaggcagcaacagcagctcccggaagcggcagcagcacgagcgctcgcggcaagcggcagcagcgtagcagctcgcggcagcagcagcaggctggtcgtgttgagcaggcgcaggaagcagtagcgggaggcatggggcatccttgtcctaatttttatgagaactcacattctcacggtgttagtttgatctgtcagtttaatggcaagtattataggttccaaccatttttggtggcaactaggcaattatgttttttataatggcaaatccacgataccgattcaaaccaatggcaaatatgtaattggcccaaataaaaaccaagtgagtcaatttgcacaaatgtgatgagacggtaaaaagatagtgatactgggagtgcctttcatctggtgatattcacatttgagcgttcaaactgaagcacaagtacttaatagattaagcagacacaatagagagatggcaacaaacaagttgcagcagtgaaaaactggtctggtgccaatgagctcccatgtggcagtggggtgtgccacagaatggaggtgcgggtcacgagaggaggtaagggcggcggtggtggcagccgctagattggtaggggagggagatcagagttaggaggagtcatatatgggaggccgtcaaacaacctaaatcgttgcggttggcaaagccatcctacatgttcccctgtatgcgcaatcgctagaaacatgcacacacttgttcgtctaatatcccttcacgctacaagtgtggtttgccatatggcaaaatcttaagctcatcacgtgtctggatgggtactccgacctggcaaccaaccaggtgggcagacgctagatgttcgctagaaagccagggcaaaatggtatttgatgccgcaatctgccttgtttccttgaggatttgaaaggaaaggaatgcccgcatcttcaacatggtgtcttcctcgttggcagaagtagccgattagataattgaagaatgttgcacttggcgtgtggctggcctagcaggtccggttgtagatgaccatgaaggcgtttgtttgtatatgtgtatttccttgtgcattacatagctccatacttagccgcatagaagctcttgtggagctgcggttttaaccttcagtgcatgttgatggcaacccaactatcctgttggttttctgctttgcaactttttttttctccaaatcttaatgaaaatgatccacgttccatcgcaggctcggcaaagaaaagagatgggaggccctggcccagatagtccttgtgattgttgggtttggttgggcctttctgcgtttgtaagttataccataaatggtaggcacacaatgacgtaaaatttatctagtgataaatggtaggcacacagtgagtcagcgaggggtagggcgccgtaatggctaattagcgaacatccgctaactagtgatctagcgaatggatctactttcttttttccgattattccaattatcactaataattgcctatttctatttttggcaagttaatcctcgtaacgtacgcatgtgtatggggtgtggctgatcggcgaccagccgcgcgggcccgtactcgcgccgttcttagtccattagtacaactactactgctacaataataatactactactaatactactactaagtacattattactactactagtaatactagtactactataattgtttttatatgtatatatacacatatacaaagtttatatatgacgtatacaaaatttatatacgcgtatacaaattttgtatacgtgtatttttggttttttatacacgtgtatatatatatatatatatatatataaccttgtatacgcgtatacaaagtttgtattaccatatacaaactttatacaaactttgtatatgcgtatacaaaagttttgggtttttatatacgtgtatgtattaaaataaaaaaaacacatatataaactttgtatacgcgtatacaaagtttatatatacccgtatacaaactttgtgtaggcctgtacaaagtttgtatacgtatatataaaaccgaaaataactgaaaaaatatacgaaaaggaaaaaaacagaaaaaaccaaaaaaggaaagaaaaaacagaaaaaagaaaaaaaaccgtccgccagaaaaaaaaattccacacgtcgtcctctgcctttctccccgcgcgatacgtgtccggtcgcgtgggggagggggcgcacgactgaacgcttattagagttctcgctcgcatgtgtatgtgcaatgtacccactgcatgcgagttttggggccctatttttcatgggccagtttaagcccaatacaaagctttcatctttaaatttgtttttaaattcgtttagaattcatttccaaagagtttctatatctaacgtcatacgtggaaagtctgtggatataaactttgcatgtataaagtttggtcatataaagtatgcacatataaaatttacaggtcaaagtttgtgtgtataaagtttacgcgtgtaaaaattagacatacaaaaaatttgtacgtaggtgggctagaaggcctacaaaaataatacaaaggaaacggttgaaatagaattttcgggaataaggggcctagcttgaaacttctttgtgaaagtaggctatattttgacacattcacatatggatcctgtattatcctccttgggcatttcccattcgttttgttccttcttacacacatgaaggggttggtacggtgcatgatgcagccattcgcaaggtgtagcgcgcgcacacacgcgcactagactcacccggggaaggccgcaactgcaagacaagttttacccagtgctccctgctccggtaattttcgttggtgaggacctcaagaatgtcgccgatgttgatgaacgaacgcgaccggcagcgagcgcaccggaaaccactggctgtcatattgctgacctgcagatcaaggggtatcgtcaacgtggagtagcagctctaggcttaggccatcggagtgcggcgtgatgcctgtcaccttcagtgggtggcggcagggaggattgcagtggcagtgcagagccatgctctgtcgcacgcttccttgcggaaggcggtgagaagcgtctctcgttcaactccaaggacggtgaccatggatgctagtagtaacgccgttgccagattccacatctctgtcgcgtgtttgtcaagcaaatccgtgtatatatactaatataggccttgtttggatccttcgggctattaaatagccctccgaaattttactatttaggagtattaaacgtaaattattgacaaaaccaattctataacccctaggctattttatgagacgaatctaacaaggtatattaatccatgattagcggatgattactgtagcattactgtagcaaatcatggattaatatacctcgttagattcgtcttgcaaaatagcctaggggttatggaatgggttttatcagtaatttacgtttgatactcttaaataacaagatttcggagggctatttaatagctcagagcatccaaacagggcaatagagtactataagcttaagctatatgtacagatgaaactgaatcttcttattgttttttgtgaatagcccgtactatcctttgagtttcactccggggttagtttaatctctgatgtttcattttatccaaacaaaccgttgaaatctagcatttggcttaacgcggtcgttaaaccgaacaaaaaaacaccacgtggcattgccatgtcatcctcgcatgcaaggacaacaatcaaactaccattccatccttatatatacaccatattgcagaaaaaggaaaataagtaacaagccagaaactcatgacataaataatatcgggtgggctttctatgattttaccttttcacgtcatttttttcttgacaattatactcctcaacgtgtttactattatcaaacgaggtggtactataaatagatctaaacccttagataaaattaggtctacaatttagattattttttattactagtaaagagcatcatagtgtaccttttaaaacaagcatgtcctagctataactaagatctagagaaaatacttaagctgttagggtgcgcccggcccattgtactatgggccacccatattacattgggcttgctccaccacagacccaactggagccacaactttagctcttttctcgcaaaattaggaagccacatcaccggagaaacatagagcatttgatttcagctccaaacgatgtaaaccgttggatccttaaattcgtgaaacttactcctgactcttgacgaaacttcttttgcaaagaagacccttccgcatcctcacgtgagagaaaaggagaaaaaaaaagaaggaaaaaaacttgctttccttcgtcgcttccgctcctaaatcacgccgcatcctcttctctcttctcctcatcgttgtcgccgccaccgccgcttcctccaactcctccaatgcctctgcagtcgccactcctccttgtcatccacgcattcaccatccacgtcgcctccgtatgcctccctccatgcctctggtgactggtgacagcacggcggtggtaaggcacatcgcccctccatctgcattgccacctgcaatctgccattcgcttccacagaacaaatggtaaggacattactgaaactataaagggtcactggtgttccaaatcactaaattctccatattccaaaatgagcaaacaacaggtgtgtttctagcatgaatttcaatcatccatccaccgatcatcatatttgcaaaccaccgaatcagtggtgtacacaaataaaaggtgactaatgtagtaatatttataataatgatgatataatctgctggttcaaacatgaaaaagacctgattatggacattgtctttccgttctttacatggtacatatattactcaactcacaaaagactaatgctctgtgcagattataaaagctcttctggaggaagaacaattaattattcttgatgagttagtgcgtctgaacaatcttaacatcgacgtacatttatgatagtaattcctactccctccgtcccataatataaaggattttaagtttttgcctacaacatttgaccactcgtcttattcaaaaaattttaaaattattaattattttatttgtgacttactttattatctacagtattttaagcacaactttccgttttttgtatttacaaaaaaaaattgaataggacgagtgatcaaatgttgcaagcaaaaattgaaaatcccttatatttcgggacgtagggagtatgttgcagataactacagtgccctccaagcaaatgttgcagattagaatctgtaatgaaatgctctaagttgttttaagactgtgtcatgttagagttagaatctattgtgtcatgttagagttagaatctattttctgcagtcgacctcatatgtaatcatttgtagtacaataagatatttaatttttaatgttagttagattccaaatgaaagtatagtactaaattaaatttatgacaagggcatgcatgttagtatgttacataatgtaattaagaccaaatttgacctagaattttctaatattatcttataagaactaattcacctagagttttctatggaagtatggatgcttttaaatcttgatgacagagaaggatgtgcaatatctgtacatcttagatagctaccttaatatctttatctaaaaaaaagaagttcagatgaattctgcaacttctgactgaatatattttagttaaatttgaagaatcgaatagcaacaactaagctaaccaaaaggggggtgaatggttgtagctacaatagtcctcacatcaaacctagaaaatattgaggaggagatcatcccctttttgcagctcaatactattctgatgatcaccatccaattgaggttcttgagagattaatttgaattgtgtcatcaagattcagatgccatggataataaccattgatgccatgaaagggtgatcaacattggcccgagtacagatttcctccgaattacatggcattacatcgtccatcgttttttcttagtgaaaattgaaactgatgcaagttttttagacttgaaattttattttgtactgaactgggcggtcaccacgcctcgaaatctcaatgtatactgatgatgcagtagtcttcatcaacccaaagaaggatgatgtacaagcattccctgcgctccttgaatgcttctgacaggcaacaaggctttgcaccaacatacataaatctcaggtgatgctaatcaggtatgcctgcttagacctcgacgatgtgctagaaggcacgccggtgactagagcgagcttccctatgaaatacctggggctacccgtagccatgacaagactacgtaaggcagacctccatccattatttgacaaatccgttggacgcctagtgaggaagaaacattgggatagtagggcaaacaactctagtcaactcaatcctcacatcgcaacttgtctacttcccgatacccctaaaatttacaaaggaatccctagaggtgcttgagaaatagaggaaacggttcctctgggcaggggcctgatagcatcacggacgaaaaatgcaaggtcaactaggcaagaacttgtatgccaacaacttatggaggactggggatgctcaacctggaaaatttcatgagagcgctgagggtaagatggatatggcacgagtggaagtaacaaaaaaaaggcatgggtcatctagacactccatgcaaaatatcttataggctactatttacgacagcgacagcaataacaactggagatggggaagtgatcctttcctagaactcggcatagatgcaaggaagacgcccaaaagacatggcgccaaaagtctacgcgatctccaagaaaaaataggcccctccgagaggccatcgaggacaacacatggttacgggatctcaacttatctcaacttatcaactagtacggacatgacggtggaactcctagaacaaccagtcaccatctagatagcagtgcaaaacatcaaactcaactttaaggaaaagaatgagatcaaatggaagctcatatgccaaggagaatacacagctctttcaacctacgaggcacaattctttggcttagtcaatacgaattatgagatgttgatctggaaaccatgggtgctgaaaaaaatgccagattttcacctagctagttgtccagaatagagtttggactttcgacaaacttgcaacacgtgagtggccaaacaactcctactgtccactctgccgccacacgctagaaacatccttccacctcctggtggactgcagatacacaagtaaaatttgggagaccttagcaaattgcgagcagcacaagccgacagagtggagtgcaaccacaataatccatgactggtgggcagagctagcaaccaccaaatgactattgaaaaagggagtctacacctaatcctcctcacggcatgggaagtctggaaggaaagaaacaaaagagtcttccagcataaggagtttatatccatcagatccttgggagcaaagatcaaggaggaaggcaaaacttgggcctcagcgggagccaaacaccatgcgcttttaattccttaggccttttccctattgtacaattctttctttttattctacatgtaacttttacttctcctatattcaatgaaattggcacatcctgaaaaacgagcgagcatgtagtcttttatcatgtaaatatcatggcatgagcaagttgatatgtggctacagtggtagcagtgtgcacttgttagggcatgtacaataagtatatatgttataacaccgatggcagaagttcttccacatatattaagaataagagttggctcagtttataaggaagatcgggccaaaactatacaactagacggttaattgaggggaactatcaaaacctacactgagggcaaaaggagaaaacaaccttctacaacaaaactactaaggcacacggctcaaataattgttgccaagctcatcaaccgatgagcagcaccgacttctcaagatgggccacaacctccaaccagacccatacaattaaaaaccattaaccatggcggatggcttggcagctgagtgatgccacgtaagataggaatagttttttttccttttttgtctttttattcgccgctcgccatgcccaaccattaaccaagcttcttggtgggtcgtggttgcctctggtgttgcgagtagtttgcctggccaatggcgttgcgaataagtgtagttgcgcttggccaatcaccgtcattagatgtgctggccctaggagctagggatgggcgtggtctggggtgggctgacccaaactcgtcccatgtgacccaccaattctacaacaacactagttccaatgggtaccatgggtcgacccatgaaaattgctagtgtactgaatttagaagacactcgacagagcaaaccaagtaaaagaaactaggtaaaaccccgcgcattgctgcgggaatttagtatgataacaataaaaaaaataacgtgtaagatagctagataacatcagattaagtaaattaatgtggtttatgataatttaaatttaaatagtatgtagaatgatgagtcaaacgtaaaaagtaaggtggtatgacttcatggaagaagaaaagtagggagatagtttggaccgtagattaatcatctaaaggctaaaaacaattaatgtgatatgacttaattagaggaaaagagaaagataatttggaccatagattaatcatttaagcactaagtgaggatgaactatattagtatataggatatcataaaacgtaataaagatatacattgaaacattatgtgaattatgttggatgataatttaacatgtttgtatttgaaaaagctcttaaattataaaaactataaagatatagcatgtttgcatgatgtttaaatgtgatgattgttagtggatgatgatgtggcatcttgttaattagtgaatgatgatgtggcatcttgttagtggatgatgatgtgtcatctttgtatgttaagcttaaggagttagttagaggaaaaaaagagaaagataatttggaccatagattaatcatttaagcactaaccaagtgaggatgaactatataagtatgtaggatattataaaacatagtaaagatatacattgatacattatgtgaattatgtgggatgataatttaacttgcttgaattttaaaatctcttaaattataaaaactataaaattatagataatataacatgtttgcatgatgtttaaatgtgatgattgttagtggataatgatgtggcatcttgttaattagtggattagtagatgatgatgtgacatcttgttagtggatgatgatgtggcatctttgcatgttaagcttaaggagttagtgggggataactttatagtaagataggatgtgtacgcttgtattcctttgtgaactatgaaatcaatgttatgttgaagcaatcgtggaagcaaaaacaaaaggaacaggcttttcattgtttcactagacctatctaatttcagagaaccaattaaggaagtatcatgagaaccaataacaaacaaaccggctatgaggatttgggtgaagggagaaaatgacggtgccgtcgcgtgcctgatgcaagggatcgatcgatacctactgaagcagacccaaatacccacttgaaccggtctttttagtttgggccgggccacatacccattaaagccaaatttatgggacaggccaatgaggctcgtgggtagacttggaccatgccaatccctactaggagccaatcacatcgcttacatggggccattagattagaaatactaataatatagagggaaataaaaaaaaacccaacatatacgcaggcaacgtccatgctcctctgagaataagaatatatgaattggcctatagttcgatatgccaactagaatcactatgagatattccttccctcccaaaaaacccaacctaattagggatgagacacaaatggtacaacaaatatggatagcctgttcagattcgttgtcccatgttgtgtcccattctctactagcttaggttttttgggacgcatggagtattagagaggagaggagaggagaggagaggagggtgagagtcaactttttgcttaaggaaatgttggagttgcagtagcaggtcaggagtgatgaacatggcgcgcactgcattaatgctctaagagtcacaacataagtaggcgattcttcataaattttgataatttgaccctttgcaaaaactatttttacaaactgaatgtacgttggcacgctgacttagcctcccatccgcggtggcacggtattcagcgccacttgacgtggcgctgaggtgtctaagttcagcgccacatgatttggcgctgaaaaaggggtcattttttaaataacttttggcggcagttcatttgtaaaattagttttttcaaagggtcaaattgtcaaaatttgtggtgattcttgatgcacatagctgcctgtggagattatgggtaccacatgcccacacggtatggttatccgactggttataggggataacttatatctatagaatatgtaacagatcatgatttaggtattacgtttccctgtatattatggaacggcctaaagtcctgatttgataatattgtaaaatagatttaggaaactgataccgtatttgttaaggtttttatcttgtaatcccgccctccatcctatataaggtgggcaggagtccctctagggggcatgagcacatatgatcgtcagatctatactacacccggcggattcaaatccccaaacatgagtagggtattacctctcattgagagggcctgaacctgtctaaatcctttgtctccgcatccatccacttttatgtctcgtgcgctacccccttttattattgccgaattcatgtttcgacagttggcgcgccaggtaggggtacgccgagtttcctattgaggaatgcgatggaatcaattttatgagccgccggcttcgccttagcctcaggagcttcgacttcgtcgccaccgacaacttcaacaagcctcactctttgactttgattcaaatcagttggagaagatctaatctagctaaggaggataacaaccactctaccacgttgagtttcagattcgatctactatggccgccgccagcgtcaccttcatcagcaagctttttcgcttcagagagagaaactttatcgtcaggagaataaccggatactactgtcaacaggatcgtcaatagcatgggccgcatgccttggacgatacacggcatgctacaaagtttgcagtcctgatcttgcgacatatgtggtgtgcggttggctacgcacgcgcatcatggcccggccgactgcttcgatagccaaacagtccggtcagcatctttcctcgatctcacagcgacataatcaggggcttcggagcagctctcttattacatgcatctactcatcatcaccatgtattgcatggctgcctgctacaagccaaccaatcaagattccttaatctacaggctgctaccaacaatcgcaggcttgagaccgatcgtccaataagcatcgatcagtgcatatgagtcaattaatctactggagcaaatacagatgcatgcttgcacattcttttatctcctaatcagatatgatttgtatttacatgtccgactatgcgacagccatataacaggcacgttgtttccgatatcactgacacgatcttcatggacatggacttcatcgctgactggtttgttcgtcctcacggccggcctactacgttgctactgatagcgacatcatcttcaccgaccgtctcgcttccgtcgctgctgccgactggtttctccgcctacacggctggcctattatgccgccgttggtgggcatcgctttcaccgtcgaccgccttcgtcgccgccgattggtgtcttcattgttattgatggacgactttgttcccacattggccacctctgccatcaccaaggggaatattacaaagctaagtcatcattatttttctttatatgatatttttcttttcctctacctcactacatcaattggttcgccgttgactagtgagtcgggggctacatatgttatatcatattttttaacaattttcataatatttatcttgattgcttgcgacataatctgagtacaaaagtgcctatcgagttatggagttccatcttcctatgctttccgtttggtttgccaatggatagttgcctttgggccgattcctagcacccgggggctcgttggatggaccgaataacgcaaggtgcttagtattactcggaataattaaatcagaagcatagagatgagataaatttattttctgctcttaataattgcaaaagtacccgagtagtaaattctgatccgtgaaactttgttccattaatgacgaactcatgtcactcatatgcatgtttgggaagtacttaggctgactcccggtgcctggtggctatgactagtcgggcagagtgtttaaacgtaatgagtcatttgctcgtggaaatcaaaattgacaagagaagaaatacatatttataaatattttaaagtacttgaattttcatcgaggactgtttttacatcagatactactcatcctatatgtttgttctgcaagatccagatccagatatgcacaaaagggattcatggctttaagcttatctcttacgctccaggaatgaatcagtcagaacatcaccaccagcttgccgtcgtcgccgccgactggtgtcttcgcctatacggttggttggtcacaccaccgttgttgggcgtctacgtcttcaccgaccggccgcctcatccgccgccgactggtgtttccgcctacacggctggcctattatgccgccgttgttgggcgtctacgtcttcaccgaccggccgcctcgtccgccgccgactggtgtttccgcctgcacggcttgcctattatgccgccgttgttggatgtctacgtcttcaccgaccggccgcctcgtccaccgccgactggtgtttccgcctgcacggctggcctgttatgacgccaactgatgctatcttcttcacggctggctacgtcgccgccaccgctaataggcgtcatcatcttcaacgcaagctgtctacgtctgctgccgactagtttattcatttccatggctgcatgattctgccagtgttaattggccttatcttcttcactgccggtcatctcgtctgctgttgactagtgccctcacctctacatatggtttataccgctaccactactgatggacatcatcgtcttccgtcgccgactggttatgccaccgccgactggtgcttttatcttcacaactgcgcatcttcactaccggtttgcttctgttgccgctgactcatgtgcaacttcattactgctatgcaactttgtcaccatggtggagcaacttcatcttcatggtcttctgcaccggcaatctctattgctgctacttcgcaagttgtgctacttcaccaactacgacgtctacatgagcctcgacatattggcatgcgtcacgaaatttgacgtcgtgctaatctactactacaagtagttctataattttcaagacttatactcggacatcttcaacatgtaacctcacttaagcaatgagtactcgacgacaagctacagttctcgactctatgttcagttgtttcccaactaaccaaagagtcggaggctacacaaatacaagactcaaaatccgacaagttttatgtcaagataaagcaatcaatcaatcaaggagtcaactttaggagtcattatcttcgtctttacttcagagcagacgttctacttcagcaactcttattatttcactggcaattttgacttctggatgccgccacaatctgcttcaaattgctcaagtgtcaagtttgagatttaatatacatgtccgggagtttagagttatcaatcaatcagctcagtttcgacgagttggacaacaacatctacattcctctaagtgaagcttctacaacagctataacatcaagttctactgtcatttttataaatcaaggggcattgcatcatcttcgttatgcacatgctcgccgttacctatatatacttcatcggccctgacgtcttcgccgttgctaatggctattatcaatggacaattatgactacgacagaaggataagctacatgcataggggctcatcaactcaagcgcgagaattatatcttcaatttggacttgttccagatacattcaacttgaatttatggtcatgagtcgatttcttattctcaatgactggattattcattattccccgtaagggctatcaaccgaatacttgtgccagtcgggatttaatttttatatctattttggagtatcccatgagggataatcactcagatcagaagctattcacatgagctacacttggtatatatcacccagaagatttattacttaggagcatgttatatgcgtcatcctttaaagggtgtcgaaggcatattttttggcctaggcctaatatgtctgcagcccatattttcaggtgtggcctgtcacgttattttagggacttaggcactttttgcttaggccaaagtgcacgtgatcaagtgcccaataccttaaaatccttttataccgcagttgctcaactttttaagagttggtacaatgcatcttaaaaggtacccaacggtgaagtttttcatagctgccccgctgacttttttatatatagtcaaggcgctgtttgggttaataaagcaattgattggatacgatatcattgctttttggcacgtaagtgtgcacttttattgaccaatattatggcttaggctgattatatattgtggtaattttctaggtggttggtaaatcatttatgagtttatttactcggatgttacaccacatatgccatatatttttaggtgtggtgaaaccatgtgtcttttagggacttaagcacatctgttaaagcagtgtgcgcatggcgtatgcccaatactttagaaaattctttattcacagcatacaagcttctttatggctattttgctatgtgaattttcaatgatgtagccaactttaggttgcacacatcatattttacaaagcagtcggtatattactcggatcatattattcggagattcacaccgcatatgctatatattgatatcaattcacttggttgattacaattatcaaagccactcggttggttgaattatttattccttgactatatgcttagtttatttagctaaccacatagtcgggggctacacctattaggtgcgtctaatcgatgcacctgactttatttttcagccctccacagtcttcatatttggtaaaagtactcgagagaccatggcaaagataattgaagcatttggctttggagtaatctggttcgagagaagattgttttttgactgtgaaggtctcaggggctactatggagattatgggtaccacatgcccacacgacatggttatccgactggttatatgggataacttatatctatagaatatgtaacggatcatgacttgggtattacgtttccctgtatattatggaacggcctaaagtcttgatttgataatattgtaaaatagatttaggaaaccgataccgtattggttaaggtttctatcttgtaatcctgccgcccatcctatataagatgggcaggaggccctctagggtgcatgagcacatatgatcgtcagatctatactacacccggcggattcaaatctccaaataggagtagggtattatctctcattgagagggcctgaacctatctaaatcctttgtctccgcatccatccacttttaggtctcgtgcgctaccccttttattattgccgaattcatgtttcgacactgccagttgttgaatatatctcacctaaatcaatgtcaaatttccttggttatttgatttttacaaaaaaaaaagagatagtacaaagttggatgccgctatatatatctcagctgcataaaaaaaagagcaaatatccagcataacgttatcatttttcagaaaagaacgcaacactagctaacacatgtgcatatgttgacatgttgatgcgtggtgtgtgctttagcatatagggcttaggagaccttgggaactagttatacggtgatgcataggagagtatttcctgattccccaagacctgtgcttgattgtaacctgcttccagctcagagtctgtgaccaagtaaagcaaatgcagaaggaaggagggttacatagagcctcatcgattgtcataataggctaaagccaaaatcaaaatttaaaatttcaaacataattttgaaactgatataatgtagttcttttagcatttatttttaactcgtcaggaacacatatataaaaactttacttataaattaatttttattttataataaattaaaatagcttattaggaaatatgggtaatcgatgaggctgatatgctactactgctgtcggccggctggactagctgcaggcaagttcgtttcttgcacgtcatgaccatatttcagcaccgcgcgtgcggagcaaacggtcaatgactcagtcggcctcgtccgcattgttttacttttttgagaaataaaccaacggtatatttgcaatcgaaaataatttgtaaaatacatgttcttaacgatgtaaaaataaaagctaaaaaataaacttcgatgaaaataactcggttagcctcagtacgcaatgtttttaaggttaaaaataaaattttagctaataaacataaacattagcgaaaagatgaggttgctcgctatctttcgctgtcgagctacactcatcttctaattttacaattacttgtggtgtaaccaatcgatatgctatctatgtgtgaatgattgatcaatggatcagtgatgccgctgtgcagtagaacagaggtgagccaggggtactgttgggatacccgtaggttacgatagcttaatcaaaattttatatcgtgtaaatcaggaaccatacaagtattagatcatagatcgttaccactcgacaagctgcacagcggaagacgctgagaagttgaaggaactctcgcgaagtagcgggcgtcgatgtagaggaagtagtcgatcacaccggctcgaccttctcctcctcgtgctcgccgtactcccacgccgatcagcaccgtaaaccagcagcgcctctatcggtatccacacgtacagggatggaacgccacgcgcagatgtgctgcaccctcgtgcggctagggttctgctcgggaagggagtggcggctagggtttctcacgtgatgcaatatctccgccggtcacactcctcacgaatatataagatccattactcggacctccaaggcccgtaggactcatatttggattcctatccgaattaagctcatattagatctccatccaatccccttattccggcccattaagcgtgcgaccctataggttcatgtacactcggctataacccgaaaactctttttcggtccacgcatcaacagcggcccctagcagaacatattgagccaccgggcatacaaaaagatcatatcgactgaacctctagtgtatacttatatgaacccctttgcctcacgatatcgattaagctcaaggctagatatgtgccatcctctaatagctcaatcattcactcgaacctgttgatagattatataactcgtgattgactcctcaatcacctttggcatggccatgcatttccataatctacaacatcgaagggcccagagatatttctccatagaaggggcaaatcccatcttgattattcatattccactacatatttcatagcatacccgaaaactagttttataactacccaattacagagtagcgtttagcaatccctaagtaagctactacacatgttagctaggaaccatgataatctaaggattcaacaccaacactaaatgagatcactgatgacacaacacatatggctcttgcagtgtctcatgttggatctatccaacaacatgttcaccaacatgtgtccacattattaatttgttatctctataccatgatccatgagacatgatcattaattaacatatgtgctgatcatctaaatatatttgttccacatatgatatttgatcaggaatcctttagaaatagcaacacacaacataaagagtctcatgaaagaatcacatatttattaaccaataatgagttatctatttcaagaaataaagtcggataaatatataaacatagtatgtgatacaatcatctctatgattgcctgcagggcatatcactgacacttcggtccttccattccacggatcagctgagaattgattatttcaatcattaaactactctgaaactttacccttttttttttcttttgacaaactcacgatcggcaagttccgtggacttgtgcttgtggagtagtaaatcgcagcgacataatcttagtacttgcagattaattagggggaaggttgatgataatttaactttggcatttgtacagtacgctttctcaatatattgagctggtggcatcttaatatgtgaaagcaccaaagttatctcaaagagaatgagccacatcttctaaaatacgagtaacgtttgataaaactgataaataaaactacaccattagatcatatatgagacatatattggactaatcaggaggctcgcacaacttttatctctactctttttaatattatgtttgattaattaatcggttgataaataaaggaaaaagaataaaagtgacctcaaccttgaattcataatggagttattaatccctgtgattatcattaataatgtgatttgctgcaagattaacaagagagtttatttccctggatggagcacgtacatatgagaagtcgtatattgtatatattgatcactggacgtcaggtttaaatatatatgtatacgtttatgtgtaattttcatatgtttccaatttacttttatagatataccagctataatgtataagcgagtttataaatattatattactttcggtggtatgggagcacacaatagcagagtgccatctatcattgtgtcaattttattactccttccatctcaatatattgctgcctttaacatttaaaatgtgtcctaaaaatatataaatagctaattcacatattccctcatcccaactaattacaaccatcaagataaaaaaaactacttacaaccatattatatttatttctttttgtctattagttttttcagggcaattgcatttttgacgctattttgaggactagctactaatttggcccttcttttttgagtttgacccatttgaccctcttttttacaaggaaaaaagtacgaattacccccgaactatcgcggtcatccgaattacccccgaaccacaaaaccggacattcttcacctccaactatgcaaaccggacgaattacccccctcgacccaatccgcggtggttttggtctacgtgacgtacacgtggcagtccagtcagcaacttatttattaaaaaataggtggccccacctgtcggtttttgtatctctcttctatctcttctatccctcactcactctctctctctcttgtccttcagagttcagacggcgacggcgaaggcagcgagcgtgggcagcagcgaggtgaggcgaggcggtagccgccagggggctgcgcgccgcggccgcgtcgaccacaggggcctcccggtggatggcggcggcgcgagacaagggagcggcggatgggcggacggcggcgcgcgaggccgggcagtaggcaggcggcggcgcgagatgagtgggtgggcgctggacggcggacggctgcatgcagcggcgcaggcgtcggtgaatggcggcggtgcgagacgagggagcggcggacgggcgaacggtggcgtgcggggcagggaggtgggcagtggcgagagacgaggcggcggcgcgagacgagggggcgggagctggacagcggaggctgcatgcggcgacagcgagtacaagcaccgccgcctcgtccgctcccgcggcgccgccaccaccgccgtggccggaatcccggggttccacttcgccaccatcccggacggcctaccggagtccgacgccctcgcagctgcccacgctcgctgcctccgccgtcgcccctctgccgtcaccaccgctggacctggaggaagaaggggaaaggaaggggaggagcggctgcggcgaggggggagcagaccgcgagccacgggaccccgcctccggtgacgccatgctcgcctcgcgctgtcgcccaccgcccgccccttcctcacagcgtgccgccgcccaccgccgctcgcgctgccgctcatgcgcgccccgtgagagagagagagtgaagagagaggaagaggggaagggtatgtatgacatatgggtcccacaattttttaaaaaaaaatgctgactggattggcacgcgtacgctacgtaggataaaaccgctctggattgggtcgaggggggtaattcgtccggtattgaaagttcaggatgagcaatgtccggtttttaggttcagggggtaattcggacgaccacgatagttcagggggtaattcatactttttccttttactaatgaagatgagacttggccctattccatgaagtcaacatgacggtgttaactcaagacaaatatgtcatttatacccttgtgaatttaacctggtttcttaaagttttttattcaatgcagttttgtgcactaattagtatatattaaattgcctcaaacagaaatacatggcacagatttatgtgtaccaaaaaaagaaaagaaaaaaacatgttgacaccgcgccgccgacggcaaactctcaagcccatccatgcggagcagccgcttccaccaatcctccctccgaccctccgcgagccatcgtcgcctgcctcaccatgcgccgccgccaccggtgttccctccctccccgcagaaccgcctcctccccaccgaagtccgccaccgccgcgccgccttcgccgaccgctggagccagatccatcgcatgtgcgtctcggcgccaccggatccgtcgcctcatcgccgagcctttgccggatccaccctgtcggcgtcgcccctcctcctcctcgtcgagccaccgccgccactccttcgcctcgttgagccactgccgaccctcctcctcatcaagccgccgtcgctcctcctcttcgttgagccactgccatccctcccatgccgctgtcgtcgcagccactcctccacctcatcgagccgccgccgaccgcagcgcggctgccgttgcacaaggagggcagcgggaggaagttgctcttaggccgccgacgtcgctccctccctccacgagccagcgccgtgtggattcccccgctccgcgccctgcggccgctgccacggccgctccctccacgagccgccaccggcactcgccgagagagagatagacgagaaacggggagagacaggatagataaggatagggtttgttcgatggtattttggtcattaagaaaagtaattatatttcattcttttttttaaataaaaacttaatggtgctacggaaaaagggccaaacggagtgtttgttttaaaaaggtagggtcaaataagcaaactaaaaaaaatagggtcatattggtagttaggctttaaaacagggtcaaataagcaattgtcccttgaagataatattatatgtctaatcaattaactattttataaacttgtaatttttacttttgcttttaccttttataatagagtaaattttacaaaactacatgatttatggttcaagttgaagaaaaccacacacattttgacacttggcacttaagtacctatattttggtagtttagtttcacaaaaccacagtatcgatgaatggatttacccatgtgatgacgtggttgttacatctaggatgatgacgtggcatatcctattaatttcgtgcgatggctgataataggatcacacgtcctcgtcctatgtgaaacaaccatgtcatctcgcgggtgaatccattcattgatagtgtggttttgtaaaactacactaccaaatatatgtaattaagtgctaagtgtcaaagtgtgtgtggttttctacaacttggaccataaaacgtgtagttttatgaaatttactctttataatataattacaacgcacatgctttagcttgtacttagaggtaaaatgcagggtacgtgatttcgcccttaataagtcaccgtttgcccctagtcaggatggcagctctgtgggtccaaaactatggaattaaagaaatgataaagaaagaatccaatgatttacggtatatgaattgacctttctatccctagttatatctctcacccaaaaccaagtgtaaactgttcgggccaagtgcggggacgagttaattccaggttgctaatgttctttcacagaaccatcttcatttatctcttttcagtgctacctgtgtcctgtgggctgtggtcgtacgtttggagttggggcttagatccctatgttttagtgttgtttgaaactgatgaagagataaagattaagctgacgtacgtaaaacgaaaaaactttaacacatgattaattaaattttaattattacaaacttaacaaatggatatatttaatattttaaaacaatttatagatatttttcgcacgaaacgtatcgtttaatagtttgaaaagtgtgctaaagaaaatcaagaaaaaaatctttatctcaccgagataaaatttgtctatgcgctttccgtctcagttggtagatattttcgaagaaattaaactaacaagatgcgatactcaatactcctatctgcagccggcagccccgtaaagaaaccatatgtctagtattaatccaatctgcaattcaggctgaaagttaccacatatactatatatatatataggagaggctggtatatatgctggtgctggtgctggtgctatagcgtatagggcttagaaggcatcgggtactcgacgtgtccatgaagatatgtttggccatcgcattttttttcttccataactctgcgcttctagtaggagtacacgggttgtggcatggagaaaaaacagattaggcaaaaaagaaaaaggttaggaaagagggcaatatattttccctgagctgcaggtgagtgtac

SEQ ID NO: 69988 - DNA, 12806 bp, Oryza sativa
tcaccctcttatgctgccaaagatgcaatgctcacaaaatttgagcttcccgatgctttgtccatctagcaatcctcgcttgcttaattctgccaaaccaatttcactcatatgcccaagacgcatatgccaaagattagtagcatcggaattatataatgaatcagaaactgcagcaatattacctaatatagttgtacctcgcacatggtacaggttggcagatttaatatcagctttcatcacaacaagagagcctttagttaccttcaaaattccgtctccaccggaatatttgtacactttgcgatcaagagtacataaagagatgagacttctcttcaaatttggaatatgccgcacatctgacaatgttctgatacaaccatcaaacatcttgatctgaactgtttcaacacctgcaacctcgcatggtgtatcatcacccatcaaaacagtaccaccttgcacagcttcataggtggcaaaccaatccctattcaggcacatgtgataggtgcatgcagtatcaagaatccactggtcactagtttgtgcacaaccagcataagcaacaagcaattctgcatcagacttctcatcagtaacaactgcggctttaccttcctcttctttctttccttttggtacatattttccggttctcttgtctttatcctgtagcttccaacactcagagatatcatgtccatctctcttgtagtatttgcatgacttatacctgcctctggactttgatctcccacggtagctacttgaacttttatctcttgatttgctgtttgtgttcttctcctgttgcctgccccgaacaaccaagccttctgcttgtgaatttgaaccttcagagggtaccatcttctttatcttttctttggcatgcaaagcatcataaacttctttcaaagttagagtatcacaactataaagaatagtatccctgaagtttgcatatgagctaggcaatgaacacaatagaataaggcataaatcctcttcatcatactttacctccatagactcaaggtcagcaacaattttcttgaaagcggagagatggtccattacagacccatcatcttgcaacttgtgcaaaaataacttttgcttcaggtgcatcttactggtcagatccttagtcatgcatatctgttccagcttcaaccacagcccagcggctgtctcctccttaagcaccttcctgcaaaatattgttagatagatgaagatgaatatatgacatagtcttacgatcccttttcttctcatcgttggaccaatcctgagtcctcttgtcaaatccagaaagcgcatcatcgaggtcttgttgtgcaagaacggctcgcatcttcacttgccaaagtgagaatcttgtgtctcggtccaggagcggtagatcatacttcaaactcgccatgggaattaatcctgaatttgctagaaagaaattagggtaaatctagcaaaaaaatgcgaaacctggtacgcttctcgtgtgcacgtagcgtagatctgaaacttcctggtacacaagcttgtgtgcgcgtagcaattccacgtgaatagaaaatcacgtgaacaggaacctgatcgcttccatcgttgacttccttttcagcctcgggaaccgtgcgatttagttggatgtattgacgccgctgctactcctggacgtgcgcgtagacggcttgctgctgctgcttgccaatcttctgatgcgtgcgccgtttccaggacgtgggctgctgctgccctaatttcgcgcgggcggtagggatgacgccgatcagatcgatccggcgcctcgacgaaccggcggcggctgcgtgacctgtagatcgatctccaaagctctcataccacttgttatggaaatagatgcacaatggagacgcgaattttacgtggaaaacccttgcgggaaaaaaccacgggcgccgaccggcaatgatcactatagaggagttgattacagacgtaggggaatcacaatgggaacgtcaccacttcccgtacggcttacaagagtatatatataggggataaaagaaagacatctaataggactcctactaggaaactaatccgaatatattgtgggcctaaaattcggatcacatatttaacaaaaatgattcctatgcacaagttatttaaaaaaacacataatgtatttttaaattttataataattaatacttaattaaccatgtgctaatgaaattaatcatatgataatgagaaaataatgagttttctcgtttcttatgcgctgaaaatatccctatgtaccattgaatcgaacggagtcgtcggcactggagggataggcacatctagttccgtatcggtgtgtctagcaagccattggaactcaccctgcagggatcacatcatgtggtgtgcatgtagaatgaactaaagcacagttttcagtggcagtgtgaatctgcgaggggctaacgtgagcagtggttgggtaactggtgccagccaacaccaatgctgctcatctcgaattctcggcacatcccattctcaaagacatttgcatcgttgaatcgccgagacaaatgttctaccctctcaccgctgcttttccacatatagaggaaggtgatggccaaggtttacatttactggtagtgctatagttcttctcaacctgcgctagtttatttataggcgcttgacgaggtacactagctagcatgcacttaaagtaccacaccaaccagatgagaggctttgatcgaacgatatcactgacaagacatgaagtcagatggattactcttctgtcttaaaattaaccaaacttacaattagatgagacataatctaatacaataaatttggagaagatcctgtttagattcgttgttctaacatgccatccaatcctgattgatttatttgggacatagagaatagctgatagtatctgattggaagtttggaactgacaaatcatggacaactcacgaagacaaagaggtacatttgtagcgacatgcatcatccattcataataagtgaaatcgaaacgatgattcatgtgagaatatatcatacacacacaaaatctaaaaaaaaaaaaattcagggaataaagtactcatagagtttgagtttcacaaaatcttgtgcccaccagttcatcccgattgacattcttctcaacaggacgatcaacagatgtgtttgaccttcggtgattattggttttactagctgttttctcgttcaaaagatgaaactttgctatatattggactctatggtttagtagaaatgatataatttttgacaaatcctcaataaaatcttatatgtatgtactatttagggcaacgtattggttccagttctgagcacaactataaatatgtgacgaggacaaggaacaaactgcgtgccgaaatttagagacgtcatgcagatatttgccaatctcggatggaaatttacaaacaaacttgaatagtgttttctctattttgtgttggtattattagtcattgtttagtcatttcctggtttttatatgttctttattgagtaaagtatgtaataagtggctctaactttttttgaagcaaaaatgtcagaattctttccattatctaaaacaaggaactttgcagattggagaagaatgaagaagacaaatctcttgatgatatcgccagcgagacaaggaccaccgagtagctattatatcttattggaaacctggtttagcaattttgtatttgcacatttcaaagttaagaaaagttaaaattttcagctacatgagagtgtatatatcagtacccaacatgcaattctcatatacatagagaagatcagaactgaagcacatcccaattaagatttgatatggtcaaattaagttttccttaacgctatatgttcacaaatcacaggaaacaaacccagattggagacgataggatcacaagatgcgtgtgcctttgcgagaggatggttcgctggataagatcacttgtgcacggctgcacgctagttgggcggaatcccctactcctgtttacccagcaacgccagcatcaccatacgttggggcctgaggttgcacgccacacctacgtactaatttgtccaatgtgtgcacgcgacgatgcgctggatgtcgcgacgacgatgctcgtgccgatcacatcgtatgctctgcacacagactgaactaaactagagcacggccatctgcgacatcacgaatctgtgagaggctaacgggcactggggtagcaattggagccaatctagatcaatgttgctcatcttaaattccccacgcatcccattctcaaggggcatcgtattgtctactctttctcactgttgattttccacttacagcgtttatatttactatgtatggtattaattgctatagttctttctagatggtagagtttatttataggcgcttgacgaggtacactagctaatatttcagtgccacaccagctagatatcacaaacaaggagtgaaaaggactacgacattcatctcaaaatgttgctacctagtatagcatgtgacattttctagtataacgaatctagacagtaataacaatattttaagacggagatagtagctgatatttgattgtaagtttggaactgataaaccatggacaaactcccaaagatagaggtacatttgtgcacaacactatggctatatgcctatattgcgcgtctagccacggacatggctcatctgtttataacaagtgaaatggaaacatggtgcatgtgagaatagatcatatacccacacacaatccacccaaaaaaatattgcattctgagaaagctgaaaattcatggaagaaaatgctaattaatatataatgactccaattggtacagtgcatcagaactgctcataaagtttcacaaaatcttctacccacccgttcatccggattcaccttcttctcaacatggcgatcaattgaagcgtttggacctcggtgattattggtcatactccctcccactagttccattccatgacacttctcgtccaaaagatggaaccttgcaaactggagaagaacggaaaacgcaaatctcgtgttggtgatatcgccggcaagacaatgactactgagtagctattatacttctaatctgattgaaagcagggtttagcaatttcgtcttgcacatttctgttaggtgatatttcacttggatatcatcaggaggagatggggggtttgtccaataataacctcgagtatgttttgtttatcttttctttcttcattagctacgtgtgctcctgcaatttcaaagaaaacaaaaaaagtggatcctcctaaaggaaaatttcctccacttttgttgtgtactggtgtctatctctctctctctgagagcttctgagatggccaatgtcactctcaccggctcagcctgagaaagaccagacgaagcagcagcaccgcccgcttccggcgtcgtgcatagagaacagaagggacccgtactggactgagaagcgagcagctaacatgaactggaccatactgatgtcaccaaagttcatctccaattccccatgactcccattcttattaaggcatactatcacattttgttgtcgaaacgccggtatatgttgtgttgctctttccactgccaatctcttgtagatagatgaaggaggaggtcatggttttatagttttgttttaggaagaaaatagaattatagtttggttttggagtgctgattctatatcataggagtagcatctatcttatttataggcacttggtgaggtatattgtatcatatatatacatggagtggcccgaagttggtagcacttgctttacgagccctttggagaaattgaaacaaaatattagtaatacgcgtataatttcttttagaagcgtagtacaaatgtaagcgctcataatgcactcacacccacccctataaacgcacacatgcctcgccctatcccaataagcatccaaaaaacctggaccgatatatattgagattaacgaagtcatcacggacatctcgttgtcgatgggtacgtcgtctaccactgaaagaataattagcaataaatgtgagcacccgtgtcaagtttaggactataacgcgtgtgggttgatttcatcacaagaaatccaaccagttaagctaagctcattttataacccatatgtttaatttgtcacgtgcatacaatgaactcatgaagcataacaaactatttatatttcacaatgtagtgggaggaggaaaaaatggacgctgtagttaacttccacaacttcttttctaatcaaaggactactctagatttcgagatcaccataggatgtgtgtgccttgcgatatgttggtttgctttatatactacatcatctcactcgaggtgtgctcctgccttacttttgtttacctagcacagcgctgccatttatttatccagagcaacatcacgcgttgtgaccacatgcaacaagtggcctcgcgtataggcggcacactcactgtcctgggcaagccgagggaaagaatccccgtgtctagtggccgatctagaaaactgattcgttagatgccataatatatctattgatgtattgttatagcatgtcaattatatttaaattataatgttagtataatttatggatagatccgctccggttagggccgatcgatcacatcattgtcagcatatgctcttcacacaaaataaactagaacatgatctcctacgacactgaatacgtggctaacgtgaccggcggtgtgataactggagcatcaacgttgttcatctcgatttccccatgcattccattctcaagacatgatatcatcgaatcgccgtgacaaatgttctattctttctcatggttgcttttccgcatatagaaaaaggtgatgggtacggtaaggcttaaataaatgtgacagtaagattttatattttctagtgctatttcttcgcagtagagaagcatcagttagcttatttttatatgcgcttgacgaggtacactagctagcacttcagtgccataccaaccagagatgtttggagaaattaaaggctcttaatgatatcaccggcaagacaatgattaggagtagctaattaatttttcctccgttcctaattaatcatcgtattacatgagtgaaaaaagaacaaggaaaactaataactctcactatatttactcggtaacaaatttgacgcattaaaaaaacaaattcgatgcatgcatcatccacatttcttcccagccaataacaaatgaggacattgcatgaaaaaagattgacgattcgaatcaaaatcgaaatagcatctacaagatgcacgtaaattctcagctgaaaattcattgaagaaatgatgtcagcgactagagtttatttcacttctagcattcaaaatctgttccaaaatacaataatttctttacttatttcttgatcacatatgtattatccatgctcatcgggaatgtagtcttttctcaacttgtgatccaggtgctagacctacgcactctgattctcggttagtttggccctcttcttttcgattaatatatagatttatctttattttcattaacatgcttttcaagttattaaacggtatattttgtatgaaattttttttatagaagttgctttaaaatatcatatacatctattttataagtttaaaataattaaaacttaattaatcatgtattaatgattttccatagcacattgaattgttgcagctcttggaatctatcgcgactaataaatcgaaacacatcccgatgcttgggagggagctggcttcccgaatctcagaaacaatgatcatggtagaaacctagaggaagaaatccatgaaatcaacaccaaatgtgacaacatacgagtacaacatctcgttttgagcgttgatattgcactcatcttgtatgtgaaatcccaacacatcccattcctataaaatataatcatcgcaaccatcaaagaaaataaaaaacaatcgctatgggcaagttttgcagttcgcaagtaatgctgatccttcaagggaacgagcagtagtagaacggtgaactattatattaatcgagtattatttactataaacttgaaaataaaattatttatttattgaaagaactttagtatagatttttttttcaaaagcactctatttatcgttcggggaacatgttaacgattaacgagagagtcgctcaaagcagtacagtcgaaacgaatgggcccttagggtgtgtttgagaataaggggattgaggagattgagaagatacgtaaaacgagatgagctattagctcatgattaattgagtattaattttcagtggcaacacttcccttaaaaaaaattcgagggctgcaacaatcatgtgtggtagggacgataaaaaatgccgcgtgcccgttgcaagccaagcggacaggagcattactggtcactgatgagctagagcacacggtaccactccatcacattgttggttcctgagaggctaacgtcaccagtgatgcctcctctagagcctctctatgtcgaattgtcgaggttgtttgtgtcaagttcccaatgcatcccattcttagggcaccctcaatggttatctatatgctatctacaagagatccatgtcagcatattttcctacttggaagagattaaatgaagagagagagcaaagttatctactaacttagagatagtctatagagaaaaacgaggcaatgaattagagagctatagatacccatgtagacataccattgaagtgatttactattaatctagtctattgctgagatgtacatgttttatagatagcacattactttaccattgcgggtgctcttagagatatcgcttataatgttctatctactctttcttcattgctgctttccgacagtcgacacagaaatgtgatgcatgatcagggtttacttttctggtgctagtgcatagaggagtactccctccatctaaaaaacccaatcctgaatttatttgaatctgtccagattcaaatattgggttatgttttattttgggacggagaaagtaccaagctagcacagtatatctgtatatgggcactgacaaagtactagcggcacaccaaccagatgagaggatagagtctccgtccccatataagtgcattctagaagagaatatcagttcaaattcacagtcctataatatgtcacatcctcttcaaaatacgtttatattgggatggagggagtacattattttctgaatgatattggtatcatccggtaggacaaagaggtaagtgattcaggaaccaagctacatcagagaaaaatcatgcggtgttggtccgttcgatccacatcggacggaagctagcgagagcagccggaatcaacggcctcaccttggcccacggcaacaaaattgccccacggatgcacaactcaacaagcacttccaaacttcacgatgcctccttcctcatctcttttctcaccttgccccatggccggtagccgcgctcgccgcctccacgagcctcggtgtgggcgcagctggagcatactgccaatgaagcccctccaccacaaccctcctccctatctcttgtcccagtggcctcgccgtgtgacaatatagagcactaactagcccaaactttagaaaataatgacaccttaattagaacccaagtgttacactgagtcaacaaccatgtgtagttgattcaagtgtaccatgtgtagttgttttaagtgtacaatatagtataatatatgagaattttatgtccttgaggtactaaattttacactaaatttttgatacatatagtacctcatcaagaactgtaaaattgctcataatatatattgttcatcatagtgtgaattattgtgaatttgtgattgcttgatagtatgtagtgcattacttgtcatcaactttagtcatccatagttatatggggcctatggcaattctcaatatctcatacacaacatgacggatgctgatgaggatgatccgtattccgtaagtaacctagcatgtttctattgtactcattcttcattggaagttctaagattgaagcataccccaatgtcaattttgcatggagcgtctcgtgaaaggtttttgtcacgccctgaactagccccgaacggaacttgcccgtgacgctccaaattaacctgttaatcgataccagtcccaggaaacagtgctgatatcacaggaagacagaatatcacagcaacagaggtctctttattacagagtaggagtacagtcatgttgggctgcggatagatcccgagctcacaactgcattacaaaagggaaagcggaagccaagacttggaccaatcatcacaggcgcgacttgggaactagaccgaaaccctaaaactcatcgtagccgacttgctcctggaagaactcctcatcagcgggatccacttcatcctcttcagcgactgggggggtattatttatatagagcaagggtgagtacaggagtactcagcaagccatgggaattaagtgtttaatgcaggcttcaaaggaaaggctgttgtttttgcaattgattttatttaaactcctttttgaaacaactaagcgagtgcttctcaaacgacacgaatgagacagtgcgtcttgtccggtcggagtatgtgcagtgtatcagtctttgaattgatcaaggttggcacccggccaacagctttcaaatggccacccaggcctagctgatcctatcagccgcagattttccaaacatcgatcccattccacaacagcaatttcacaaagtagtagtcaaacaaaactacgctaggaatcacctcacatccgcccatgaccgtgggcacggctgttcgaacaatttaataacctctgcagagggagtacactttacccacacgacgttactagccttggtcacctagcccgtgtggaacggccacgtctggagaccttgaggctttcatgacaaggcatttcgaaagccgacacaggttcaccatatgccaacgagaggggtcctagaccgacatcaggttaggtcccagaccatactgtgccaggaagcccgggggttctccccggcaccaccccgttgaatccacatgtctcttggcatcatggctcccctgattagctaattactcagccaggggcgtcccatttcacccatgtggtcgcacttgtcttatgttcggatgaaattcctagggaaacggtccttaagtgcaagaacgggaaaccgtactcccggtacgtcccccggtctgcggttttggaaattcatttagttcgcaagcaccgacccatgtgtcgggttttccaagtcttttgtaaaaccccaaattttacccatagttggatattttaaatttgaggggaggtgttctgatgcccgtgcccgaaggcccgtgcatcgaagcacaacagttgacaaaggaggttcaagtgttcaataattcacggagggtaattgcagcaattaggattggggccggcaggctatctcacaagccgcggccgaattacttgtgttaaacctattcatgcaacatttgcggaaaagaaatacttagatttaaattataggtgcaagatgatcaaaagtgacttgccttgctcgagatcttgagcttgatcctcgaaatcctcacactgcgggtcttcgggctccgaaactacacgcgaaatgggacaactcaacaaacggcgaaaacaaagccctattattgacctctaagcgtgccattagatagatcttgagatttgaggaattttggaagttgaacggagtcaatcggatgtacggttgagaagatattgaatttctaagattattggatttttgatctaaaggaaaaaggatttaattaaacccttttggaaaaagaaagaaagaggaaggggaaatagacttccctcgggcggctagggctcggcctgagagaaaagggcggctcggtcgagctaaatgggccggccggcccgagaaggcggcccaagggcacgcgcggggagagagggagggggaaccggtgggccgagtccaccttgcatggccccgagtgggacccgcttgtcggcggcttggctcaccgtgagcggggagcaggcagcgcggcgctagggttcggaggggggcgcagctcgtagaggacgcggatgcggcgggcccacgcgtagcctcacggctcgcggtggaccgcgggcgcaagcgatgcggaggggagcggtgggccgaggtcggcttgacccggtcctggccgaggtggcgccgacgtggcgcctacgtgactgccacgcgggccgacgggaggttgaagaaggcgtcggccggaacggacggcggacggcggctgcgaacggcggggcgaaccacggcggtacaagcgaaagagagcacaccgggaggtagcacgggttgagaggggacgagccaacggcttggattcggcaggggatgctcgatggcggcggattgcggcggcggcattcggcggcgagaaaagggggaaacggcgacggcgcgacgggaggtcgattccttcggaacagagcatctacgcggccaacggagtccgtttctagcgtcggattgggcggagctaccccgagcgaggcccgcgacgagaggcgctactgagctcgg

SEQ ID NO: 69989 - DNA, 12558 bp, Oryza sativa
ctgcgcccatggatgcggcggcgcggctctggcacgcgcgcgggctcgcggggcagggcgcggcagagcagcggctaggcggcgcaggcgcggcacgggcggcgaccgcgcgggcgcgcgcgcgaggcaacggtgcgcggggaactcaaaaacgcggcggggagcttgccagggatggagtggggagagagaacaagagagggggagagcgctcggctcggcgtcggctcacgcgcacgcgcgtgcggcgcacgggtagagcgaggggaaggctgagggagagagagagagagagagagagagatgggccgagaggggaatcgtcccaccgaacctgagggaggcaaactagacttttcacttgattaagcggctcccatagccttttcattttctcggactcccagaggccaactgcccagcagcacaacaatccgcttccactcgggaagcctagtctatgatgcccgtagacatcccgaatcacacagattcgtttcttgaccagtcaggtcatctatctgccacataggctgattctggtaacgattcccacaccacaacaacttttcacaaagcacacgcaaacaaatacgattttcacaaacgcagaagacttaggtggtgtattccagctggtatcccaactggtctaacaccttaacacggactaccaaacaaaactcacgcacgcactagtttaccaccactcctaccgagcgggtgacggagctaaggtcttcttatcaatggggcttaactaagacacctagaggcttgagcacacctttcttcaactgggtgtgaagacaggtttattctaggtcaaaagtcaaaacaaatgactagcttctaccttttggacacgaaaagatttttcacaaaattggagctaaaggggaacaacgacaccttagttttcacaaatagtttttgtactcaaataatgccatccttttcaggggtttcgatcctagggccaactaatgctctgataccatctttgtcacaccccgatctggcaccgccgtacaacggcacctgacaggagcgtgtcgtaggaataacggcgcgaaccgctttctacgaaaccgcgatctcagtaccagtcccaggacatagtgctggtacccacggtgacaaacatgaatcattgcaaatccttaaaataaatagatgacttatttaccttaacttaggttgcagctcagaacagcccgagaatgcaaccgacgacacagacgaggaaacaccaataacaacagcagcagcggaacaaacgaactaacacccaacaccacaggcgacggctaggaaccatgacgaaaccctaatcttcactttacttcatcttcagctttaggacggaggaactatatatatttatatagagcaagggtgagtacttttgtactcagcaagtcacgggaacttaggtgtttaatgcaagcttggaagagaggcaaggttgttttgcaaatcttttgttttgaaatcattttgaaatcactaagtggtttacttctttctaagtttgggccgaaaagaggcttgtgtctcgattcgactttaagagatgtttttcaacaactcaattggtaatgtactgaccccccaggtcagatcattacttctcggctctcagagcaatttcacttgattaagcggctcccagagcctttttattttctcggactcctagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacaccacaacaacttttcacaaagcacaggcaaacaaatctacgctacaggaaacacctcacatctgcccatgaccgcgggcacatctattcgaacagttagttaacctctatagagtgggtacactttacccacacgacattactaacccggatcgcccagcccgtgagatcagccacgtcgggagaccctaaggctttcatgagaccctaaggatttcatgacaaggcatttcgaaagccaacacagggttgccatatgccaacgagaggggtcccagaccgacaacaggttaggtctcagaccatattgtgccaggaagcccgagggttctacccgacaccaccccgttgaatccacatgtctcttggcatcaaggcttccctggtttgctatttactcagcaaggggcgtcccattgcacccgtgtggtcgcacttgttatatgctcggatgaatttcccacaggaatcggtccttatatgcgaatacgggacaatgccacataggcacaactcccgcatcgcgagttttcacaatttattttattttcaaacacgccgacaccacatgtcgggtttttcaaggtttctcaaacccatttcccaaattatcgacacacaacggtgtatgtggaatagttggtatacgcgctcagagagcacgaataccgaagtaccacaaaggtggagcgacaaggaatcacggtagtacagccgacaggaattagtgcgattactgggtaggtctatcggtttggcacgcaaatcgaggccaagcaagttaagtgtgtgattctaataatgtaagttgcaaacaaaataataatgattttccaattataggagcaattggtcaaaggctgacttgccttgctcaaggtcttcacaaagcttcacgtatcttcgagaaaacccgcgatcgacaaaaatccggtaaccgcaactatacgcaaacaatcaaaacctaaacaaaagaccaagaaaaagatcctatttagactaaataatagtgccattaaatagatctcgattttacagaaatactggaagtggaacggggtcaatcggacgaacggatcgagagatatgaattttggaagtttaatagggttttctggacaaggagatgatttatcggaattttctggaaaagaatattcccaagaatattctttaattactcattgacatgtgggaccaacaagggaggaaagatggacttatgtgtagggaagctgatttggtggagggggaaatatggacttgttgcatgtgtgttaggctcggcaaggaggcaggacatatgaacttcctttgtctcaaaaggccgaggaggggggggggggggacggctggtgggccgagcccatgagcgggggagagagaggaggcggctgaccggctgactgggtaggggcgggcccggtcaacgccacgcgggcagccacattggatggaggaaagggagccaggatccaacggctcgcggcggccgagaggcgccgacgaacggcggcgaaccggaggaagcggctggcaccggtggcgagaggaggaggaggggaagccattccacggcttggatcggggagaggatgcgcgacggcggctggcggcggcggcgaagctcgccggatgccggacgcggatgcgcgagagaagggacgagggggcgcggggtcgggcttagccgaaccaattcgtagttgcgacacgggggcgcgggacccaatggtcgccgcgttcgaactcgcggcggcgctatgcggcggcggaagaggcggcatggcgtgggagcgggtggggaggccggcaactggggcggcagtctgggaaggttcaagaggacacggggagggtcgcggcgcaaggaatcggcgagagaagggccgacggcggcggattgcggcggcggccatcgccggcggagaaaaggggaaaactcgccggggcaacgggagtcctattcactggggaaggagcttctacacggctccgggaactcgtttcaagcgacgggcggcgatgagctagcctagggagtcatggcgacggcgagcgacctccggaacagagcaaaggcgcgcggtggctacgacggcgacggtggagccgagcgagcgtctaggcgcgaggggacaaggacggtgaagtcgcctagagcctagggaggggagaggacagggggcgctcactgacgagagaggagcggcgtcggtggcgggcgtggcgcggcgagcgatagtggaaagtggttcggtggggagctcaccgacgagagaaacgacgtcggtggagtgtatggagtcgcggcgaggcggacgcgatggcggggcggcgtggcaccgagggtgcgcggccggggaagaagggagggagaggtggcgatgggcagcctggagctcctcgtcacgcgtccacgcatgcaccggctcctccggtgctcggcggcggacggcgacggcgagagaggggcgagcagcaataatggcgcggcggtgatggaagttcggcggcaatggcgcggtgggtgtgaggcgagtgaaaacgagagaggaaggggtttggggcggcttgggttttatagatggtggtgaagtcggtttggggaggaaactgacctatgcggtcaaggagcgggagatggtggtcgcgctagcttggctggcggtcacgggcgacgcaagagcggcagacgacgaggatgcaaggggcggcaaaggcggtcgatcgggcggtggaaatcgaaccgcgggagtgagaggagcagcgcgggctggcgcgggggcgagctggcgctcggtgtccatggcgctaggtgccacgcggtggagacagggcgccagtccgggaaggggagaaaggaaaaaggggaggaaggaaagggggctctgcccatgccattttgggagaaaggaggagggagagagaggctctgcctccgggatttgaacgcacgtggcttggagcgaccgagcatgggcggctgcggggcgcaggcgcggcggggccgacgcggcggcgaccgggtggttggccacgcgcgagcgcgcgcgcggatgcgagggcgcggccggattcaaacggcgacggcgggaaaccggcgctggtgggagagctcgacgagagagagaaacagagagagcgagagagagagggaggcgctctctctcggctcgggcacgatgcgcgtgctcagcacgtgcgaaggggaggggaaacaggctgagaggagggatgggccaagggagaggaattcggcccacaaaaacaaagggaggcaaaatagacttttccagaggaattgaattggagagaattggagagattcagggtttggattcgaattcaaatttgacattcgaactcgagggtttagggaggaatcaagggagactcgaggagaagtcaaggaagagattcaaaatgagattttgatatttttgggaacgaggacaagtatttggcgaggatttaaaggagacgtttaagtttcggagacttgaattggaaggaggaagtcgaggtggaggattttgatggtgacgagggtgaacaacgggagatagaattgagatccatggcacgacttagactctcacacaaagaacgaaattttcgcatataggattttgccgaattagttttttaacgtttcgcagaagcgtagcgttacaccactacaggtattaactcctataaagctaccctattgagatttcagagcccactctattaaaaacttcttgaggtgaagccacgtcatcgttattttacagtcgtaggatcaagtgatatgacgctagatcaagtgccatctggatggatacattcaacagccatgcacacaaacgttacgatgacccatcatgatgtacgacgagatgggctcccagcctcccacctatgacgttaatctccctgcccacctcctaattaatcgcgtggttagccggcggttcgagacgacaccacccctccacctatgcgatgccaggacctgctactcattcgcgcagtggttgatggcatacctcaaccgcgtggttcaagacgacgacggcggcttcaggtgttgagatccagttcggcgtgctgagatccagttcggctcacctcatccagtgcagattgcagttggtgtccagaaatgctaattttagtttgaagttttctttgttgctgaatttcacactaaactttaagtgatgtgcttctatgctcctcagaaaaaaaaacgcacgaatattaaagatggtgaatggtctatattaaaaggtgattaacaggctaaacgttattaggaagggcaatttcgtccttgaggtggttacccgtatcacgggcgttcaatcttgacgcagcgccgcctcgcctgtcgccgcactcgatcgcaagtacgagagaagaaaagaaggcattccaagattccaaaacagcgaatcctcctctgttgcagctacacatgtgcatcacctcaatccaccatttgattagcatccatgttcaggctacggttcttgccaaatcaaaaaatgagatgggtagagataagaagcatgacaagaaaaatcagaaaaatcagaagtggacgaaggcagggagcacgccgcggtagactaacgggaaaggcggtgtggcgagagaagaagggggtggctcagcaattagaatgccggcgatacgagtcatcaatttgtaactcctcatcggctgatcgagtatgtgataacttcatccaggacaaaactgccccttcctaatgacttttactctgttaagcaactttttaatctaaaccattcatgagctttaatatccgtgcgggttgttttagtgaggagcatagaagcataagtgttagttcatttcatatattatccttaagagcttcatcaaatcaattctattaaattcccaccgcaacgcgcggggtctcgtctacttactagcactttgatgccacaccaatcatccatgaggagaaggggaaacattttagtttatgaacattagagaggtgaatctaactagtatagacccacttgcctataaaagcaatgaagtaactatataacatttaatatttttttatgaaaaactttcaaatatagctatattataattttaatataattacattgtatctagcatttaattagattgcaacttgtatgtaactcgttctcatctatgataaacatacggttgtgcgcatggctaatgctgctagtgtgctagcaggccatcatgggttcaatcatatcttatttttctcttcctccctaccacgaatcttgaatcacatatatatgattgtcaaaattttagaagttttaaggggaaacaatctgccaattgccaaatgttttttctgagattccgtagaagtaattgtaatgtgaagattaattaattgattagccattgtgaatggttcatgtagagtttatactactatgaccttttacaaaagaggaagggagcactacatggatgaacattgcatgagcctttgccttctcgtctttcagcacagagagaatgattcagtcatgcagctgatcgacgaacttagagaagttcttttttttttcacgctgctttcttcagtcttcaccaactcagaagcaaagcttagagaagagacaacctgaaaaaaataaaccaacggatcatctgcacgagtagaccacgcagcggctgaatctcttggccataaattaacgggctcagcataaaggtgttccgttgatgatcaattaatttacgagcaattctacggtttttaagaaggtactataaggtacccaaaaatttagtgtaaaatttggtacctcatgacatctcatagtatctagataccaagaggtaccaaatttacaataaaaaaagtggtacctcatgataacttctcaaagaccgtacaattgctcttaatttgcaggtcgaagaagctgcgccttgcaagccaactggacaggaacatcacttatcactctgcaatcgctgcgtacatagtgaactacttcctccgtccaagaaaaaagacaaaccctgggtttccgtgtccaactttaactgtccgtcttatatgaaatttttttataatttgtatttttattgttgttagatgataaaatatgattaatactttgtacgtgacttgtctttttaattttttttatattttttttaaataagacggacggtcaaatattagacatagaagtcagggtttatctttttttttttacggagggagtagagcatactactccactatatcgttggttcctaggacgctaacatgagcagtgacgtcttgtctgaagcctctctatctcgagattgttcgtattggattcccaatgcatcccattctcaggacatatcgcatcgtcgaaccagcgagagagcgagacaacgttctatctctactcttttctcgttgctgctttccaacagacacagaaaggtggtcagggtttacttttttctagtgctggttctgcacaaaggagtaccgagctgtagcctaatttatgggcccgataggacaacactcctaaaaactaatttcccacagtgtaaatggcttcaggtggtagtctcaggctgtgtttagttccacgccaaaattataagtttaaaaaaattggaacgatgtgacggaaaaattgaaagtttaaagaaaaaagttggaatctaaacagggcctcatattttaatttcagcccctggtgttttttattttagtcatcacaattttccaatttatatatagaagttcaaattttaaactgaacacccaaaaatccagaaattaatataaaatctctcctccctccctcttctccccaccgacaccccaatcctccaccccactcctctccatctgtcgacaccaatagcgacacaactacctcgagctccactcaccggcggtcgcctctcctctcccatcccctccccggcagcggcggtagctgcattggcagcgatgcctctctccttcccggtggggcagtagcgtcacaggcggatctgtggtggagcggggcggcggagcgcggcagaggggagcactcgaggaagaggggagcacttgtgtcggtggctgatgggcttcccggtgccgacgcaaatcgatgcgtcggtggccgacggagcttaaaggcggtgtcttcccttgacaaaggccaccacctctatacccccatcgtcttctcctccctcgtcggccaccgtggcatgaaatctcttcccgacagagaacggaggtgaagaagaagaaggaaaagggctggatggggatccatcacaaggagacaacctcgccaacacacttccccaagcgtgccttcgctgttctcgagaccgggcgagtagaggttgtcacgccccgaactagtcccgaccggaactagcccgtgacgctccaaattaacctgttaatcgataccagtcccaggaaacagtgctggtatcacagggagacagaatatcacagcaacagaggtctctttattatagagtaggggtacagtcatgttgggccgcggacagatcccgagctcacaactgcattataaaaaggaaacggaagccaggacttggaccgaacaacacaggcgcgacttgggaactaggccgaaaccctaaaactcatcgtagccggcttgctcctggaagaactcctcatcagtaggttccgcttcatcttcttcagcaactggggggggattatttatatagagcaagggtgagtacgggagtacttagcaagccatgggaaataagtgtttaatgcaggcttcaaagaaaggctgttgtttttataattgattttatttgaactcttttctaaaaacaactaagtgagtgcttctcaaacgacacggttgagacagtgcgtctcgtccggtcggagtatgtgcaatgtatcagtctttagaattgaatcaaggttggcacccggccaacagcttttcaaacggccacccgggccaacaactttcaaacggccacccgggcctagctgatcccgtcagctgctgattttttcaaacatcgaacccctttccacaacagcaatttcacaagcagtagtcaaacaaaactacgctaggaatcacctcgcatccgcccatgaccgtgggcacggctgttcgaatagtttattagcctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgacttatgtttggatgaaattccaaggaaacggtccttaagtgcaagagcgggaaaccgtgcacccggtacgttccccggtccgcggttttagaaattcatttagttcgcaagcaccgacccaggtgtcgggttttccaagtcttttgtaaaagccaagttttacccaagttgttatttagattttaagtttgaaggcatccgtcgatactcgcacagagtgcacgagcaccgaggcgcaactgggtggttacaagggaacatggtataacgattaacaaaggaaggatcaaatgcaacaaattaggtaggtcccgccaatctgccttgcagacgagacaaacagattaagtgcgatcctatcaatgcataatatttttcaagcaacataattaaattcaaatataggctcaagatgttcaaaggtggcttgccttgctcgagatctggagcttgatcctcgaaatcctcgcaccgcgggtcttcgggctccgaaactacacgcgaaacgggacaactcaacaaacggcgaaaataaagccctattaatgacctctaagcgtgccattagatagatctcgagatttgagaaattttggaagttgaacggagtcaaacggttttacggttgggaagatattgaatttctaagattattggatttttggtcttaaggaaaaggatttaattaaatcctttttggaaaagaaaataaaagaaaggaaaataaaaggaaagaaaagagggagggaatatagacttttctcgggcggctagggcgcggcctaagagaaatggagcggtccggccgagctaaatgggctggccggcccaaggcggcccaagacgcgcgcgcgggaggcgaggagagagagagcgccggtggaccgggctcactgcgcacggtcccgggtgggacccgcttgtcggtgacacggttcaccgtgcggagcgagcacgcggcgcacgcgcgcgggcgggggagggacgcggtgcacgcgcgtggttcgcggagggacggatgcggtaggcccacgcgcagcctcacggctcgcggtggaacgcgcgcacgggaggggctgaccgggatcggcccgacccgatctcggacgagctggcgccgacgtggcgcctacgtggcgcctacgtggctgccacgcgggctggcgggaggaagacgaaggcgccggccgcgaatggacggcgggcggcggcggtttctccggggcgccttgcgacgatgaggggcgacggggcgtacaccgggatgacgaggaagaaggagagggagcgagccaacggctcagattcaccggagggagtccgttggcggcggatttcggcggcggcaaccggcggagggcaaagggggaaacggcgacgaggtcacgaggggccaattcccggcggtgagagcatttacgcggccacgggaatccgttgctagcgtcggattgggcggagctacgccgagcgaggccggcgacgagcgggtgctacggagctcggcggcgacggcggcgagcacacggcgagcgacggcaacggtcggggcggcgccggctagttacggggaggctactcgagctactaccgaaaactaagggcgagagatggagcgaggaggacgaacggatggaggcactaccgagatgaggaggggcgctgtgacgagaggccgacggcgtgggagtaatctctccggcctcgggccggggaagaggaggaagacgagcgcccggagtccccttccgcgtccacgaacgcaccggctctcccggcgcttggcgatgaacggcggaggcgagacagagctcggaaggcggcggcaacaatggcgatgggaggagaagagagggagggcgcctgggctttaagggcggcaatgttggtttggaaccgacttgggcggtcaaggcgtgagctggcgctcggcgctcgcgtccaattggcgacagggcggagggaggatgacgccggcgggaggaaaaggggaaaaggagggagggaaaggggggctcgcccctttcttctttgggaaaaggaggaggggcgcgggggcgtctcggcagagggaggagggctctgcctccgtcccttggcggcttgcgcgcggagtggcggggccgaggcgatgactacggcgatgacggcggggcggtgtggagcggggcggcgacacgggcgacaagcgtgggcaggcgc

SEQ ID NO: 69990 - DNA, 52313 bp, Oryza sativa
agggctcggctcggcgcgggcggctcacgcgcacgcgcgcgggcagagcgaagaggtaggggcgctcatcgcgggcggctcacgcgcacgcgcgcgcagcgcgcgggcggagcggatggggagaggcagagagggagcgcagccgggggggggggacagggccggggggagagggggagatgggcggagagaaattcggcccatcgaccccgggggaggcaaaatagacttttgcggaggaatttgatttggaaggatttggattcgggattgaactcgacgatatatcggggatttgagatcttgagatggcacggacactagacaacaagcaaggaaacaaatttcacaattagggtttttaagagataatttttccgctaggcgccacgacggaacgggcgctacagaggtgctcggagccctgcagaggtccgtgattctttgtagggtgatggcccctagccgaaaagtggttcggttcctacctggcgagctagggataccctccacggtggagcgttggccatggcctgaggagtactagctagggatgcagatcctctgcagtactgctgatgcaatagcagacactgactcgtgggtgtactgcagacaatccacactgactagctagcacttactgaaacaataaaactttacaatatttcctaatggtaatacatgttcgttttttggatgaattgagcaagcagattaatctagcgagtgatacatgtttgcacacaacattatggctgtagggagaaatttgatactgtaccattgtctcaacaggatttcgttggatttccactccctaaataggtttcggtaaactgccactttcaaccaagacgtctacgctgaagtgccatttcctccatttcttcccaattaaaatcattctttttccttttttccgttatttgctaaccaaaatacccctgtatgtccactcaatatgtataaacttgtgccattgtgatcaatgctaccaatattttccagccttttcgtatctatttaagatgcgtgcaaatgatgagtacaattgatcacaatggcacaagtctatacacaaacattaagactgaaatcttctataattaaagaaacaataaaattagattattgtgaataatacctctccagcacaaatataatttgttatttttgtttctttatctgtaaattgaatttcgatgtgcatgtttgtatagtggttttgtatcatctttatccatcttatcaaattttatgaaatatttacataattatcttgtaaaaaatgctttcccagtttcgacagttttcatctaaagttgaggaccaaagcacatcccaatgttttacagtgtggtgaagtttctcgatcaatgtggccttctctgcttcgcaaatccatttttctttggagaaagggagcaaagctctcccattttttgagggaatgaacagactgtttaataaataacaaccgacaacatccaaattaagtaaaacaaaactgtcattttgtttgatctaaaccaaaaaccatcacatccagtagacattgcaagtagagtgctgacatctaaccaacccctatcctcttgacttgcattcgtctccaggcaaatcttgagctgaaaacttcagcaaccacctgcagcgttccctcttgcaactttcttcgatcctcttccttgatctgtaggatggaccaagaattgatccaatatatagcatgcatcatgcattagttcagtggaggatccaaagataatttaatcaacgtagtagaaagcaacacatggtttcggcagcaacgctgactgacctgcggctcaggtttgctccggcgagcggcaccggcgccggccgtgcggatcactcacatcgtgtcagctcgcgggtgatgtgaaagagagagaacgacatggagcatagtagagcacggccgcaccgggctgtgatcagctaccatgtgaaccggagcaaatctgtattggtgttgttcatccctgattccccatgcatcccattctcagggaagaatggcatcatatctcgtcgaaccaccgatcgatgcaatgttctgctccgatcctaacagcggatttcttaccaacagagaggaaggagatgatcaggatatttacagttttggagcgaggcgagatcaggatttattgttttgaattgttgattcctgcctagaggattttgcctcaaaaagattctgtctagacgagcagtagctagcctgtgcgaggtagagtcttatattcataattttagtataaatatgtgaaatataaggtaaatttatagtttatcttataataaaacaagccgtaacaaattaaataacattgatctatctttttagtaagatgaatgattaaatgttatgttaaaaattaacggcctcatacatttgaaaacggaggaagtaatagctatagcactttcagtattcagttcagtgccacaccacccagacgagaggtgatcgaaaggaaaacactgcaacgctatgactagctaatagtactatctggttggatttaaagtttggaactgacgaacgatggcaactcgaccacgagcaattaagcagataagtcaatcgtgtcgttaatcatcgacgctaggtgtaccatgcacgagccactcttgttgcgttgtgtctttacacatgcagacagtattaacaaaatcagcatcagtactatctgacgctatttcaacagcaaactttttgttttttgaaaagattagacggcaagggcattgccggatatattagaagagaaatagagtataggctacaagcagctcagttttcctgggaaggagaaaccgaaaggaaccgaaattacataaggtataaattctccctgatcaagaaggctacttgcagcggcgaaagcgatttttgttggaagagacgccaatttcactctagccaaacatgccaccaggaaattagcagcatccctacaattttcttacgttcacttgttggtctgatggtagccagatactccatccaatccgcaattgattgggaatcggtgtgcaagtgttggtagccatgcaacatgactagtagaaacttgtgaggggctaacatgactagtagttcctcagctggagcttctgtaggatcaggttgttcgtttcaaattccccatgcatctcattcttagggcaccactggtttctcacaaatcagagtaagggaatggtctgagatttgcagtttccgaatgcctggtttgtccagagtagtagcagccttaagaccccctgatttatagatgggcaaatggagctgaaggggtactagtacttcattaccacaccaattaacaaataagaggagaaaggaaaacattattagtctctaaatatatactcccttcgtccctaaatatttgacgccgttgacttttttaaatatgtttgaccgttcgtcttatttaaaaacttttgtgaaatatgtaaaactatatgtatacataaaagtatatttgacaataaatcaaatgataggaaaagaattaataattacttatttttttaataagacgaacgatcaaacatatttaaaaaaatcaacagcgtcaaatatttagggacggagggagtattattagtaatgcacatttttttcatgtgtatataaccgaagtatgaaggatatgtatcaaggtttcgtttttgctatatttctaactactggccaaagatgaatgctcgttcaggtgaacaaacatcaatacacacatgtggagatgagtaatagggtgaactaaggctgaatatgggaggtggagttcacacggaaaatggtgttatccattgaggcgtgaatttaggggtggatagcgagccggctcggctcggctcgttatcctaacgagctagaaaaccagctcggctcggctcttttgaaagctcgagctaactcgttaggctcgcgagccaatccaacaagacagaaagaaccaaggaggaggggacctgcgaggctgcgagtgcgagtgtgcgacctgcgccggctggggaagtgcagcggcggcggccctcgcgctggctggggaagtgcgatggcggcggcggtcatagtggcttgcggcggcggcggcgcgagctcctggcgacgccggcggcagccctagcagcttgcggtggcgtcggcgcggtctcatgcggcggagccagagagagagagagagatgcggaattgcagatgtgcggtttcgacttctcgtctcgtgtgctgcggcggatgaggattgaccgagtgaggagaactagggttttgcacttttactattgtcttaggcttgggcctgtgctattgtattgggctgggccttcgcggttgtctgatgaagtcctggctcgttaaggctcgcgagccagctcgagctggctcgttatccctaacgagctaaaatgccagctcggctcgctaggaaaatcaaacgagctgagccgagccgagccaagcctgtcacgagtcgagcgagctaacgagccacgagcttcctgtccacccctacgcgtgattaattaagtattaacctaaaaaattaaaaaatggattaatatccgattttttaaagcaaatttcctatataaaaattttacaaaaaagtaccaattaacagtttgaaaaacgtgcccgcggaacgagagagatgtgagttagaaaagaagtgagaagaacacaacctaagtagcatgtacgctaaccggtcactagttattcagacctgataatcttcatgtatcacataatcaaagttgtgactttgccgtctgttattgtagatgtgaaatgttgtgactgcttgaaaatatggaatgcgtttcttctcagtgtctcaaagacaaacgtaacaaatgctgatgagaagagtcggtatctcaatatcgaccatctcttagcgatacgcaattttcatctacaggtttagaagttagaagtgaagcccatcccaaggttttacatttttttttcatgttatcttcacaaatcctagaaggattgtacataattcctagtttttagaccccaatcaaaatcactggactcgtactttccaacgcacagtacatttcattcatttttcctctatggaagatgaattacatctccgtgtctgcatcatatccaaattaaatcaatagtgagatttttgttttaataatggacatttaaattaacaatgaaatacataagctgtataaagtaaactaagtttgagtttgaagtacaattatagttgtttggcggcttgaaaaacagtacggatcattagcacataattgtacgctgtaccataaatgaagtcatagggtactcaatttgcactagaaattttggtaccacttaaggactttaaaatttctctcaaattttatactattttttttatttgagatagaaaatatgatccctccagaatgataaaattactcctaaagacgaacatagatgcaatgatgcagataaacagccgtagagtggtcggaactgccatatttattttcaccactacagaacagatcggtagccagatctctaatatctactttcaattgtgtcattaaccatgttaattgtatctctaacaatatctctttgttgagacgtgtttttacacatgtagatagtaacagagttggtatcagtaatacctcagtgcttcaacagcgtgctgtttttcatttacaggttcagaagggccacacgctacacggcgatgttatcctcacaaatcgcagaagcaattgagcaacgaggatagactgatacaaggagcttggtggctttttcccaacctgccaccgtttctctagcaaggctagaaattcagaccacacgccgataatttcatatgcttgatctgcagacaaaatgatctaaagcacaacacatgtcgactggatagtgaattggtgagaggctaacatgactactgctgcctcagctagacattatctaggatcaggtggttcgtttcaaatctccaatgcatcccattcccaggatattgcattgcattggtgatgcatagcatactgtcatactgagatggccaggatttgcagttctctactgctggttttgtgtagatgagtatatatataattcactaacttagtataattcactaagttattgatgggctcttggattagagagaggcactcattgccacaccaatttagacaagatgagaaaagaaaatcttacaaccgtgctatacatacgacttcagtgtatgactccatcccgattcacacatctaatgcaccccgtactaccatcagggcataggggttatgggcaaaggattaattaatctacgctggagatgcattgtcgtacgtctcagtcagacgaggcaatcatatgtgtagcattattcaaaatcttattagtctttgaacatattagctcacagtttgtcatgactatataacagaagtataaagaaagtattgaagtatagtttatattcctagagtgaattttatttctctgtgtagaggccctaacgagaaatattactgggaggtgaaaaaaaatacgttcgtttttcctgtattgctcctagccaaagatggatgctgtactacggatttcacagtctcgatcaatttgattcaggcgaacaacatcaattcaggtcctgttttattgatgcaatcttcacttggacaaagtctggagtactagtagcttgctcataggtgttgtgaaggcacatttggacccaatcacaacactggaacctatcgatttattttgaaaaacaaaattacatatgaagtcattgtttgaatattgtcaaatcactatgatttcttctccttgttcgtagcatactccgatcagaaccaaatttatttgtcgatcgaaccaatccacgaagcaactatgaagatttctttttttttaagatagagaggtcgaagcctctcccatttccattaaagaaatgtacggtagttttacagacttgaaggaaagcagcaaacggaaaaaaagaagaaaggttttaattgctaacctctagtggaatgccatcccatcacactttcagctgcaagaagaaaacaaaagaaagtaattaactgaataacagaagctgctacatgcgactctgaagattgcttcatgcacaacaaacgacaaaacataactctctataatggcatcaccaatatatatggcaaaatgatccatatagatgagacccacataaatagtttatctctatgtcaatgttcacaatgtatatagatacaaggtatcattaggagaagagagaggagtaaagatagataatataatttattccatatatatgggtagtccatatgcatatgggtatcttttgttattttttttatatggactagttgtacaatggtaataggtggctgaatggaatattctattgcttatggactacttttacaccacattgtggatgccctgagacatttttgcgacagcaaacagcatgtcatgtgtttccggcaatttttcttctcttgcaggtgaataactgtgaagatacaacatatttctctagattttctagatgatcatgttaagcgtttggaacgaattgaccaatagataatagtctgctattggctattaacaagaacgataccacaaattaaccaataaccatgtcatcaccgtccggtgcaccccgtttaactcaaattcccaatacatcccattcccatggtatcttgtctttcccaccccaaatactcccccacttatatattagctctctgccattacacaatcaatatgagattatttgatgatatcccccttcctacatcagtgcattgatgagctttcacacaatgtaaattctacgtgtggttttgatctaaaatagattgtggattttagatcggctagcagttaggagggatggccatacagcgagacatgcccctctgtcacaggacaaactgagttagcgagtcgtcttcttatctattaatgtatatatactagaaggatctagagcctgattgccgcctgggcggcctacaagcaactgctacctggtccattgatttggtgatttaattttccaacttgtagatgcattgccgatcgattgcgtactaagcgccacaagatcatgtaaccatcggatcgtatcaacttcaagtctggaagctcgctcagctcgtattccacatgcatccaattcttaaagcattgcatcgatcgtcgaatcactgaaataacattctactatttttatttttatttttgcagggaacattcgactcatttttacggctgctttcacatcgtcgaatcatttgaaggcaatcagatagttggggtttatatagttttagagggggcacctagtcggcgcgtgtgcgtccccggtgcacgttttccgggactaaaaggtagttaactaatcaattagttttagataattatagtttgagataatgatagtagtagttaggattttctttttccacgagatttttttaactaataaattgaaaagaaatctatatttgaagtcaaatttttaaaattttaaatccagatttaaaaattttaactcgaaatttcaattttttaagtcaaagtttgaaaactttcaacttttcatctcaaatttgaaaaactttcaatttaactttgaaaacttttaaccctgatttgaaaactttcaactctgattaaaaacttccaaatcggatttgaaaatttttaagttaaaatttgaaaatttttaagtcaagatttaaaagctttcaactcaaaacattttaaaaagccacgtgtgctaaaaagattaaaaaaagtaatcagaaaaacacgaaaaaaagaaaaaaacgaaaaaagcggcgtggggaggagcgcgcgccagcatacgtgcgaattagctctcgcgagtttccgccgagaggacctagtagcatgcagcactcgaggaggtatttagggcctgttcactttgatgccattttcaaccttaccaaatttttgtaaagttgccaaaaaaatagctacatttagtttgctgtcaaattttggtaactatataagaaatcctaccaaaattttggcaagttgccaaaattataccaaaattttggaaatgccaaaatttggtaaagtttttttttgacatcaaagtaaacaagcccttaattaactagtactcggttagcataggccgcttggtttagctatagctcggacgaagtggtgatttcaaattgtagaactgaagtgtttctttttgttcatactgtaattgcgaaaaataaatattataagatgacgataacaactcagcacagtatcatctcggattggctattgggcgaacgttcggtacttgtccatcacgcgaacgaatcaggcaggggaggataaaaacacgtggcgatgcgcaacaggctggtgcggtgtgtcgctacgatatatatttcttttcctaatttcctgttttcttttttatgtgattcttttcaatttcccgttctcctttttttacattaattaattctcccgtagcggtatgtatcaattttctgtttttccattctttttttttcaattttttttcttatagtcatttttagcttttttaatggaaacttttttatatgtactattttcatggaaactctctgcaagtatgctttctatatataaactttctatatatagactttatatgcataaactttatatatatagactttatgtatataatttatatatatatatatagactttatgtatatacgctttatattatagaatttgaatttataaactttataataaattatatttgtatgtataaatttcagtacaaataaaaaaatataagcatcactagattttgaaagagatttttttcaagaaataaaatctagtctgaacaatttgttaatagggaaaagagattggttggtcgctaacagaaataacaaatactactatatacgagctgaaacagtcattagaacgaataacgacaaaacctattaaactgtccgcgagatgcgaacgttcgacgattagacccaccctcgtatcatctccttgacggatgaaaggtgaaatcctatattgggccactgaatttggacagctccaaattagcccatccagttatggctacaacctgtagagctcagcctagtcctgccgtcctggtatgtttgtcaagggaaaaatgtccacttgagatctctcaaataggagccaagttttcagaaaaaccgaatattgaagcatcctcaacttctaaatcagcgcaaattatattaagtcccaccgttattttggacggtggttttcgctgatgtgacgtgttgacccaattatgttctacgtgacgcttacttgcttacaattagggggggatccatgtgtcattgacatctaattcttcctcctccatcccttctccccgccaggggatgcatcaacgatctacgttgtcaatacccatatacatacatacgttggaacttgctgcttgcattatcgcatcaagaacatcatattggtaaggtttgggatttttgcgatgcttgccgtacatcctactccggcgagcggcggcggcaacatgagcagcagcaggagcggcgcggcggcagcgcgagcagcagcaggagcagcgggacgacagcggagtgagcggcgcggcagcagggatggcgtggagcaagcggcgcagcggagaagagagagagaggggtagaagatgtggaagagagacaggcagaagatgagggtattttcatccaatagatgtaaaatacgtaactcgtatctcagtggcaccactaagaatacaaacaagtagcagtggcatcgttacaaatatcaaatagtaatggtatatatatttcaaaaccacaaaatttttaatggcatggatctaattaacccttttatgtattacttttcttctaatgccacataggcatcacatgagatgaagatcagatcaacaagacgccacatcagctaaaaccatccttaatactgtcgacttgatttaaactagtattaataatcaaaagacttactatatccgattttacggttgaaagagaaatgaagcttgaccaatattttaggagcctaaagtggactcttctttttctttgccaaatgaaaatgaggcgcatctagttgacccactgatgatagcacacttatggctcaatacgaggcacatcccatattgctaccaatatactccctatgtggccaaactaggagggcagtcccctcctaatataacaaatctgaaaaaaaaaagctgtctaaattcgttgtaatattggtgtttttagaacggagggagtagctctgattcacattgttaatcgcgccaattgatcttgttgagatgaccatcttacgttacgtgtggtgtcctagtgcctaaccagcacgacgtcggccgccaccgtttcgccagcaaagtagtacgctgaggccgcgcaccaccaccgtacgccgtctccggcaaggtttgctctcgacagtctctgcacgatcgcggctgctgctcgtccgatccaagtacggcaattgccgcgaccgatcaaacgagctaaaccgctgcatttgtgtaggccgtggatcggtgaagggctgacatgagccgtgatgcgtcggcaggagcctctacacgacatggtcgttcatctcgaattccctatgcatcccgttccagattgttacttataaccaaccatgcaccgagagacaacgtatatatgttctagttctacagttctactactgctgcatttccaacagaacagaggaaggggatggtttggttttccagttttctattttctgattctatacccagagttgtagcagcaacactagctagcttatttatatatatgggtacttggcgaggtactacctccatcctaaaatgtttgacgccgttgactttttaaaaaatgtttaaccgttcgtcttatttaaaaaatttaagtaattgttaattctttttctatcatttgatttattgttaaatatacttttatgtatacatatagttttacacatatcacaaaagtttttgaataagacgaacggtcaaacatgtttaaaaaagtcaatgatgtcaaatatttagggaagcagggagtataggtagatatgctaaagttaattactaactagcacttcagcgttacatcaaccagagaggaggaaggcaaacattaccctctaagcattaaccagtccctcgtattttgttacacatttaaaatgaaatatagggaaaaatacagtttatatttcacggccaagagtgaatttatttctctgctttgaggcactaaaaagaaatatcattaggaggtgggaaaacacattcgtctgtattactgttactgggcaaagatgaatgcactggctttcacatcctcaaccagtcaacctggttcgtgtttattattgtttgaatgatgaggatgaagatgaaaattaagtgtttcacgcaaaacgaggttgtaataacatgtgattaattgagttttaattattctaaacttaaaaaatatattaatatgatattttataacaactttcatataggaagatttcgtacaaaacacaccgtttagcagtttgaaaagtatgccacaagtatccaaaatttaatccaacttttgttggagaaaataatagggcacaaattgtcgttcggatagtcaggaggagtggcttcatggcttcatattatcgtattgtatttgatcctacaaggaatcataaattcccaatcttgagttttagtcatggctaataaattcacaactaaaagatgcaatattatatcatgtttaagagttatgatatttggcttaaaattgaaaatccaaatgaaattcctactcagatcaatattgttgctataaaaactgattttaaaatcaattgtaaagctcgccaaattttttttaatggtatttcttattcggattttgaccgtgtctcacatcttcaaactgctaatgagatttggaaggttttatctaattttcatcaaggaacttctaacatcaaggaattatacaaatatgtttttaaaagtagtacatgaaatttgaaatgaaatatggagagactttagatgattattttgtgtgctttaacaaagttttaagcaatcttggatctgtagattgatcttacaatactaattatccctaatataaaatttcactacatcttttgaaccgtcttggtatgttaattaggaagatgaaagttacatcaatttaagagtctgttgttttacattaaactcaaaacccatgacatgaatattctttctcgtaaagttgattttaagtctaatgttttggtttctttttcatcttctttttatgattgctcttcttcatcgacacctactgtttttactgtccttaatgccatgtctaatgaccaactcaagcaattcgttgggaaggacttggttgtgcttattaacaagttgtcttgcgttgtgaataatattaggtttagaatgtgaagagctacatcatacattcggcctgattgcccaaaactaggaagaactaaactgtggggtagactatcaacaagcatgcatggtaccacaattttgactctactgttgtgtgcagatactgtttgacttaaattcccagtacatcccattctcaaggcatattcgaaccccaataatgcgcgcaatgctcaactcatgtcatcttagaaggaaaatatactcaaaaagaagaaggagaaggaggaggaaggagattaccaaacttcaaaattttcatatgttgattctgacaccggccggaaaggagtagggtgtatatatatgtatatatatatggttattggtcggtgtagggaagtacacatccaagtgttttaagtcctaaaccaaccactcaagtgttaaatatagtacagtatgttcatcgcacaaattttgacaatttgaccctttgcaaaaactatttttacaaatgaaccgctgctaaaacttgtttcaaatctgacccttttgctcaacgccaaatcatgtggcgctgagcttagacacctcagcgccacgtcagctagcgctgaatgccgtgccacgacagatgggagactaagtcagcgtgccaacgtacattcagcgccatgctatttggcgctgagatgtctaagttcagcgccacacgatttagcgttgagcaaaagggtcagatttcaaataagttttggcagcggttcatttgtaaaaatagtttttgtaaagagtcaaattgtcaaaatttgtgtgttcatcatagaggtaagtgttctgaatttatgactgcacggtagtctgcactatggaatgtgtttctcatcaaattggtgatctaggtgtgggccactttctcaaagacactaaatggagagatataaaaacggacggaaacaatatatcattttaatgaaaaagattatggtccaatttttttcttgttttttagataatggattaaattaacctagcctctacatcccacatggatgtgcgttgccaaagaatttttatatttaccaatttaactataaagtaacaataggatttggtgttaaaaaaattagaagaatcaaaatttagagatggaaactgtggaaaatggtacccttttatggaaacgagatctgccacagttttaaccctaaaacaaacacggtaaagacggtcggtaattagtgtgacttcgtcaatatatcggtttttcaaatgtgctcttaaagataagatgtgcgtgtgcgcattcaaatgggtgagtgcgcacatgttgtttacgtcttcaacaatactcaattttactttaaggtccagaacaaaagcacaggttttacatggtagcatggtgaatttttttaacgtggtttttgcaaaaccaaaaatcaatatagaaaatgacttgattttggcaacaattggcagttcgtcggtaccgcgatgcaagggttggctgaggtttgtgactggcgagtagcacggtccatggtggcatggtccctcctgctgcagaagcctacggcagcaacactccaaccacctcctagctcttgtgcatagaaaacgaaatgtagtagagcataaccaggaccgcattttcataaagctaagatgaaacggagcatatgcatatcgttgtctttcatatcgaattccctaccccatgagtcctattcccagtgtatcgtaccttatctcgaattgagtcggtgcatcgagctagcttttttgatatgcgtgatgtgtccttactccttacatacgcagacaataacagagtcaatatctatatatcgataagtaatccaccatgtttcagcagcacacaattttcattatatttacagcttcgatgattgtatgctacacatacatatgaccatgcatcatgcgggaggtgtcctcagggcatgcggctttcctgttccctgccatacgcaacaggaacagggaagccgcatccgacacgtcataccatgtgttggtgtacacgtcataccctgtgttggtgtataacgccgcgccaacaaaggtttgtgcgtgacgagcggcaatggtcgcagttgcactgctcatgcgagccaaagatacatatcactgtggcctttcaaatgaactaaagcacatcatttgcttgggccatggatctgcgagaggctgacataaactgcgatgtcttggcaggagacgctcacaagattaccaggcatagggaattcgagatattaaaaaaattgataccccgagttacataatacttagaggtataaccttttacaaattttacatcgtcatacaaatagtaaaattaccctcataaattagagaagcaacgtaagataatcatatgacttaaacctatcatttttttttttaaaaaaaggaaactgcgtgtagagtcattgtagaaatcgtgtctatctttgataaatggaagattcttgccaatgataaatggaagtttagtgatatttgttatctttgtctttaggttagaattctaagtagttttctcttttttcatcaagttaattcgtatttattcgacatgcaaccttgtcttaaagtaaaggccagaataaataaaaaatatatttaaattacttaactagttaaggaaaattcttaaaatttcgaagcaacataaatcgttgtttgaattcaatatatacaagttgaaaaaagaaataaatctgactattagtagtgcttgtactacctataattaaattttattttctcgatacatagattgggtttggaattattaagatagatgatcacttcaaaaaacagagtttttataaactacttttgatgacatttgagagcttagaacaaacatttgaggggatatcccttcaagataagaaaccatctcctacactgtttctcctccaaagcaaactcaaatcaaaaccaaatttgacgacagcatcaatccatcgaacaactctaaagaaaccttcctttcctagatgaaccattctgggtgattcaggaagaactgaccaccgaacaataatgccccacataggactatcactttaaccatgctcttaaccacagtgttgaactcaaattcccaacacatcctattctcaagacatctcatgaacaaactaccaattaatataatacttgactctagtcaccttcaaaagaaacaaaggaaggagattgttggaacaaaatccatcggagatcaagcaaagggaaagaagggatgtagttgttctctattcattcatcgtccccctgaaagggggatgacattcttatatagtagtacacaagtatgggagattacagagatagccctactggacctgagctagggggagaggctgtaggtcaagggattagaaagtgaatatcatatttatatgtgggtattttagaaactactatgaaaattaattttcacatacggttgttgacatgtagacaataaaagagtcaacatccacatcttggtgttcgaacaacaaccgattctcatttacagaatcgaaagcattacacgctaaaggttttctttgatgctatcttcacgaatcgcacaagcagcctagctagagaaaatcaaacgtcattgctagatatatagtaattgacaatatcatcttacaaggcaaaatcgtcttacaaggcggggcctgcatggcagatagcattcgctgacacagctgcatatgcctgcgtatgcatgctatttttgtataggattgaacaagaccaaacaaacctaccagagaaggggtgaattatagggaaaaccaaaaaccaaaaatcttttgcgaaataaaaaatttacttcgaatggagtagatgacgaacccctgtacgtagctgctggtcaaaccgcctcgaagccaccggtttgactgtcgttgtttgacggtcagaccgcgcatacacccgtggttaaaccgccgatctcccgccggttagatcgccgccttgccttcggtcaaaccgtcgggacacagaaaacactggtatatgacaaacttgaagatgtagattgattttacatgttgcgtcccgaggcgaccgactacgcctcctggctgcacatgccagaccggctaaggcttccacgtgacgagctgcacggtgtatgctgatgacccttgcaacccgaaccgggacaacgccttttctttgttatgctctgcacataaaatgaactagaacacagcagttgagtaggtcatgaattcgtcagaggctaacatgacctgctatgcctcaacacgagtctctctgcgttgaggttgtttgtctcaaattccccatacatctcattcttagagcagtagtgcatcatctgttggtttccaaaaaaaataaaaagaatagcgttttactttttcagtctttctcacaaaacctagaaagcagatggttatagtttgcagttttatatatattgctgattctgttctaaggagcagtggctaacttatttatggacacttgaattttgaagaggtactagcacttcagcacaaccagacgagaggagaaaaaagaaaacattactctctgaacatttgtactccctctgtcttaaaatataatttttgatgaatgtgatatatcctataagtatgaatctggaaaagctttctgtccagattcagtcataagatatgtcacattcacttaaaatctcttatattttgggacggtggaagtaacaagctaataagacatagtactaggaggtggaaaaggcattatttatgaccaaagtacaaggaaaagacagtatattttactgtttatagtgaatttctttttactgtctatagtgaatttctttctttctgatttaaggcactaatgagaaatagcactaggaggtggaaaaatattttttctatgatgcttgcaactggtcaaagatggatgccgtggcttgcatagcctcaacttgatccaggtgaacatcatcaattcgtgttctgtccacgcgaaaaatacttctgtgctcaaaatggtttgttctatttttatcgatgcgaggagtggctttcttcatcggaattgtgaaggcgtaggcacattaattgtgccatgccaaaaccggtcgcgttggttaggagcagcttaaggtagattcaatcacccgactgaaaaacctgttgattatttgatttacctcgggcaactgaagaagactgctgcagtcatgcagatcgatagtgtccagaggtccgcagaggccttgggcgacgtaccagccggcaacaattcttcactactacagcagaacgaggtgatcttgcacatgtgcttcattatgcatgacgggctcggctgaggatcgcgcacgacgatcagaatgtccgtagctcctgtctcttgcaagcaaaggcgccaatcgcaacgccgatcaaatgaactagagcgcatcatttgacgaggtgttcaatctgtgagggggcaaacatgactatcgatgcctcaagacgagctttggttggtcactttagttcatctcgaattccccatgcatcccatcctcagggcatcgtatcatcgaactaccgggacaacattctactactccagcttcaattctcaccgctgattttctcataggcagaggatgaagagatggtttgggtttatagttttctactagtgctgggttgcctgagtagcagcgacaactagcttatatatatatatatatatatatatatatatatatatatatatatatgaagtgacctgaaattaccagcacttcagtactctctcaagagaaacaattgagtagtagttagagaaacccatgcaagcattttctctgggtcatctaggctataacctgcagaggccggcccagtttcgttatctttggcaaaggaaaacgaggcccatctatgcccatcgaattttgggcctaccgaaaaagatatgcctatcataaaattgaccatagaattaatccacactgattttagcctacacaagtaatttccatgggaagatagggtgaaaacagatcagattcgaacggatggtcgtaccatattctaaaccatattttttaatggtttcggagctggtacagatagtgtgcatatgcggattgtctcagatgtcaaaaatgatgcggactcagttcagaaacggattaaaattatcgaatgttacatgtatatacaatcaacacgacatcaacttagcaatacaataataaatgaacgatcaattgtaagtactatatgtttaagtgctaaaaaatgtgaatacatgatatacataatataaatatgcagttatgcaagtgaaagacgacatggtgagagtcttactctaggcagtctaggttaattgatgaattataatatttgatagttgatacaaaatcgctaatgcacgatctgtcgctagaatctcagcgtcgtgatcagtttcctttccctttttgccaggcttgtgctcctgaaatcttctctcttttttttaccgctttttgtggttgtttctcttttttttttttgtcaccggtttcgatggtaccaacaagatgtgcatatgtgcagagcaaaatttgtatgcggctacctgcgtgggcctgctttcggccgaatagaaagttcataccatctttttcttttttgatttaaatccatctatggaaacttttcatatctaaagtttatgcgtataaaatttctagatcaaaagtttgtgtgtataaagtttgtatctgtaaagtttatacatggatgtttgtatgtcagaagttcttacatacttcctccgtttcataatgtaagtcattctaatattttccatatttatattgatattaatgaatctggacattcagattcattaatatcaatatgaatgtgagaaatgttagaatgacttacattgtgaaatggaggtagtagaaaatagcacgttgtgatccaaaaccacaacctaattacacttagatgttaggtcaccccagaccactaaaaaactagtacgttttattagggattattgggcaatagacatcaaccaatgcagacaactatatctaaaactgaaaagaaaaacaagcgcgtggatgtttatacaattatacctgaaaatgcattaatgcaatcgtacacacgggcattaggggtacccgtctcccaatgcgatcgtacaagcgggcattagggcatgtacaatgacgtctaataacgggctctcttcattgtcatgccagtaaatttggtgacgtggaagaaagagaggaaaagaatacatcgttgctacacatgacaacggctcagagtcgactgttaacatttattaacgaaaaaattgttgcaagagggtggaaaaaaggaaagaagtataataaaaactatttagtgcattaattaatggtttagaaatcttattatctctactattgtaggaggatagtctctagtgacattaattagtatagagagctcatattagactctacctttgtacatgcccccgtctcctttccctctttgccagacttgtgtgtccgagatctgttttttctttcccgatcacgtattccgtgtgcacgtgatccctcgcatattagagctacccaatttgatgggccgactcatattgtatgcaacatatagaatggttacttatgttaacaattttagattatctggcaaatagcctaccggataatccgcatccagctgattttagagataccatatccttatttgcatccgcaccacactacccgtatccgtatctttatccgccagatttttataaactcataccatatcgtcatttcgaatggattcagagtagatcaaatatcatccgatccgtttaatgtggttatgtgaacagttcgtattgagtttggagtatgatcgtttaaagaaatgtcctaactaagcggagcatctttccatatcacacaagcaaccactaccacagaaaagcaaatacaagtcggtactatagatgccggaagtggtaaaaccggcacatatagaactttacctgcccgcaccaaaccacgtgccagccagcctgcaaaaagcaaagaaccggcacttttaagcgattatagatgtcggttctaaagaaaaacggacacaaataccataggtgccgttttttaaaaaaaatcaacaccctgtaaaatcgagccaagccgcacaggggagggtgatattttcaagccgttcttatccatctggccccacctctctctctctccttccttctctttcttctcctcttctcctcctccatctctcgcatgccctcccctcggctgtcttgcacgtccaccccacccagcgtcagcggcgacccgacggtggaagcggcggcagcgcctcccctctgccagatccggacgggaggggaggcgtcggcctgacacgaggtgccagggcagaggcggcagcgcccttcgccaaatccggtcaggaggagtcggcgatggcctagtggcaccctcccctctatcaaattcggcgggagggggcggcggaggcggtggcggcagcgtctcccctctaccagattcggcctgttataaaagcagccccgaaatcacatcggaaaccaaccgcggaagaaacgccataggagatccacacacgatgacgacaccgaggcacgatatttgataacggagttcagccgaggcctacatctccggggcactgattacgggcgctccttcccgatccagcatatacagcgtatcagagttacaacgactcacagccggtcgccgccggcagccgctccctctcactatgctatgtcgccatgcggttacaacaggcacgccccctctatttatgagaaatcctaggacagaaaccgactcttactctagtcctatacctagtacaactccaagtcctaaactgtaaccgactatgtacacatattcgacataaactctaacaaactccaccttggcgaatatgccatgccaacctgaattcgttacttgctcgaacctccgtgtaccaggacttaagttgatcctttttcgccgctcacaccgagctgcctcgacaagcctccaccaggttcaccgtaaacaagagactccactatacctgcaatttcttcctcctgactccacctgcaacagtgctccaccttctctcatatcatcacagtcgtcttgccaagcgaaattgaattccttcctagctatcacgtcatagacttcccgaagactatgttcacctccatctaccatcttaaatttgacttgatctaatccatggccagataaccgatgtcatcaccaaatagataaatcaaactcactagacttgaagagaaccctttcttctttgtcgtcttatgaaccgaactaacgaatccaacatccacgctttccgcatccatagactgagtatccgataatttgagaagatcattgttgccttgaatcacccgaagaaattaccaccatagcatttgctcttcctcttcagtgacgcagattccatatatccccatcatgcaatccccgcagatcctggatatatcctgtactaccaaacagctcattgacgccctcaacgattttcattcgctgttgcccgggattattttcacccactgaagattgtctttaccgagtcgtaccaacacttggcatcttactgccttgctgcatgcatcaatttcctttgctttctcgcaaatgccatgactccacaagatccaagcatgtgtatttgacacacacgcgtgtccttccctcagatcttgaactggccaaatcaatgcacgaatgaattaacgttccatgcagcccatagcctcgtcacgtgcaaagccacaacagactcaaccataaacagcctaaccagcggaccgaccggtcttttccttctccaaaaaaccaactggtttttctatcggtaagacccagtcaacacagaaggaccagatcgaccctcttctcgctccttcgctcgcgtctcctcggcccaagtgcgccgccgcccagcgcctacgcgcctcttcccagccgccactccttctgctgaccatgagcaccagagcccgtcgcaccttaccactcctccgcgtccccaagaaatagcgccgccgctgctactgccgcagcctaggtttctcttcaacgctgtcgcccgctggaaggcgctgccacgcacgggagctggactcccttgcgccgcctcccctcaggacttcgccggtgagggcaaccaccgttgcttccgccgtgggtttcctgccggtgaggatgccgacgcccacgggagccacctccccgatacaggagcgtcgccgccgccccttcgccagtacctgccacctcctcgcaggagtcggcccgcgtcgaactcgccggcacctgcacgacgactacaccaagccgtgctcctaccgctcgcagttcgtcgcccaaaccccccgccgcccaagaaatcgggtacgatctcttcgttgctttggttggtttgattcgattgcaatctctgcaatcctgtggaatccctgctgcttctattttgggtaaaacttgactccgattccaaaacgaatacagtcctcgtccgtgccatgtgtattgaaatcgaaccgtgcccgactcctataccatgacctccaccaagtcaagtcctgcatgaacccagatcgggcctgctactaccagcgccgcttctgtctccgtcgccggcacgcctcaacgcaaaatcgtgcacaccaccacgaccctgacctccaagcttcacgtacgccagcaacatcctggttccagagcaaacacacacagcacgaccaccgacatcgtcaacgacttctgccgccaatatgtactgattctatgctgacgcttctctgttctaccatccatcgcatgtacgctgctaagtagcaatcctccatgcagtaccttgtcgttaacacctccaaaacagcctgtaggatccacccgctccgactttcgattgaacgccatcaatctagtcgcgaaccgaagccgacaagtcgcgtgtcgtcttcccagccgccgaatgacccgagtgctacatctagccgtctccctgtcgaacgcagctcatcgaaaggcctaggccacccgcccagagtgttcgattccaccgatcgagaacgccaatcacctccagcttcaatcaaccccgagcgtctggccagccgctccctgttgaaaatagctcaccggaaagtttgagccacccgcccgaagtgttcgacccaccaattgaattgccaatcgcttccgccgccatcaacccgagcaccacgtctagtcatctccctgttgattgcagccatcgaacggttcagaccaccgcctgaaatgtccgattccaccgatcaaattccgttgatcgccgtcgtgctccaccttgcgtccatgtccgtcctggacaccctgtgtagtcgtcgcagcgtggagcaccaccctcgtacctctaccatggatctcccgtaggctctgataccacttgttataaaagcagccacgaaatcacatcggaaaccaaatgcggaagaaatgccataggagatccaaacacgatgacgacaccgaggcacgatatttgataacggagttcagccgaggcctacatctccgtggcactgattacgggcgctccttcccgatccagcatatacagcgtatctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataatggtctagcgatggcttcagctccactcccacaggcagctcaactggggtataagccaaacgtcttctccttctggatcctttttcttcaaaggaggttgattgattattgcaagaatgagcatatgacatactcaacaagccacacagcaaatttgcaagtgcacaaggataccaaaggatggcataatataggctcatttgcaaaagcaacatttagcaaaacatttaagagaagtgaaacagtggagtaattaatcagaaattttaatcaacactgaacaacacacccatgctgcacaggcccaaccatcctgaacaaccatacccggttgtacagatctaactccaaaccaggagctaagcaaattattaccaggtataacatccataattattgtgagaggtgtgagactaatcacgaaaaacattgctcaacccgcccataaccgcaggcacggctattcgaatagttttactctggccagaggtgtaccactgtacccacaagacacagcctcaacatcatgtctaccatgcgtcgcgatactggaaagtacccgaatagaggctgtgacaataccctctgcacatcacaactcaccacagtgcaccattcctggatcataatcacccccttataaaacaaggcatggactccccagcgacccccgtgggcttgtctccgccacttctcagtctggtgctccgcaatgaaccatgttatacaaaaggtaaagccgttgcccacgctggcttgtggttggcacggttaatgtttcacaacagtagcttgcgaaccggtccttaattgccatgagcacgaccttcaaaaccatgtgctcacaacccaccattaatcatattttaattaccaattaattatcataacacgattaaccatcgtgagctaccattaaatataaccataaataataatgtactacatatgattcatcccattagtgagctaatgtttcgaagcatggctaagcaattatatctaacatctagttgaaccaatatatataaatctcaactagtcaaattataatatcccaaggtatcaaggaatagagtaatcaatgcaaacaggccataacaaaggaatagattcacaccacccagtgacattcgaaaataaatgcacagttgaaataaatatagaatttaaatataggatcaacatgctcaaaggattgtatttagtatctgtgtgacttgccttgcaataatcggtcttcaattaatcttttgaacactcccgacgcactcacaaaccttcgcaacgacggaaacgacaagctaacatgcaaaacgaagaaaaagactaataaaaaccaaataaacagtacaaaaacaagcataaaaagtacatataaagtaaacaaacatgtggatcatgattttagatgaatttagcaacttgaaccactcaaaaccgagttacgatgatttagttatgaatttccgaagatttaatctattagaaaaactggaaaaagaaaaacgatgatgacgtcatgatacctcatcaatggccggaccaagatggcgacctcgccggagattggatggtcggctgcgactttgaaggacatgtacacgtagaggacgacgagacgaacctaacggtactcaccctcgaaccaaacgacgaacgacgacggccggcgatgaggtctagcggcggcgcggcttcggtcgacggtggcgccggagctgcggtggtcggcggcttcgggggtcaggcggccgggcttctccaccctcccgcgcacctaatggtggtgacggcgaccggcggcgacgacggaggcggcggcgcgacgcggatggagctcggccggcgacgatggcggggtggagcacgtggcggcggcgctacgaggcacgggagatcacgggagagggggcaaacgaaagaggaggactagggggtcctatttatagccttggattgaagagatcggactcctctcgcaagaaatcgatccgggaaatcaaaaactcggttttggagataaactcgaaaacgagttcgattcggataagatactcaacgattagctcagatttttggggtaaagatagaggaggataagaggaatatttcccctcaactaaattgaaaaaaggagcaacggggaggcgagatttggaaggaggaggcggtggcactgtgcacggcacggctggctcgggctctgcctgagttggaagatgaacagtagcgcggggaggggaagtagacttcttgccgggcttttcttttctcagcctgattagaagagggagcataactggactttggctgagagaagaagagaggatgcaggctcgggttggaccggcggaagagagaggaaggaaaggaataggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtactatacaaaattataattagaccatttaatgattaatttaatatgtgggtaattactgaaatgttctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtatcagagttacaacaactcatggccgatcgccgccggtagccggtccctctcgctatgctatgtagccatgcggttacaacaggcacgtccctctatttatgagagatcttatgacagagtccgactcttactctagtcctatacctagtacaactccaagtcctaaactgtaaccgactatgtacacatattcgacataaactctaacacggccgagaggggaggcaccggcccggcacaaggtgcggctgtggcctgacggcaagagagatgacaatggcccgatgggagttgtgttctttctgttcatgcttttctttctgttcatgtgtgttcttgttgttcttgcatgtatataaattaaattgttgtatgcaatctggttggggcgaaggagatttactcgatgcatcgactcaaatcaagccgatgcatcgagccgtttttttattcttgaaacctcaaaggtgtcggttctaaaccagcactgaaaccaacatccattttctcttcataacagtgccgccttcgttgtaccggttgaaaaaaccggtacctatggggtttcccaaccggcatctatcaggtgttctatggtagtggatgtaagaaaatcaaagagatgcatgcatatgcctgctggatggtgaacacgatccgattaacatgaggcaatcctagctaatagatcgtcttataagcaacaacgctccatgtttccaccatcaaatcaatgcactctgtccacacattcaggctcggctaaggcttccccgcaacaattggcacggttcatgctattgtcccttgcaagacgaacaggaacaccatttctgtggagattaccatatacgcacaaggcaatgttattcgactggttatagagaataacttatatgagtagaatatgtatagatcaggactcgagtattatgttaactggcgtatcaaggaaatatcttgtagttctagtcagttatgattgtaaagtatatatagagctttagactgtaagggataaagtctcttgtaatcctgactacttcgcctatataaggaggggtcgggtgccccttgagggcataaccacaccttagatcgtcagatcaataacataatcagcagaatatttctccggacaggagtaggtattacttctcatcgagaaggcctgaacctgtataaatcctttgtctcataacccatccactttcctgcttgttcgctacccctttaatattgccgaaatctagtttcgacagttagcgcgccaggtaggggtagcgtcaagtttttttgccaactagtgcgattggatctacatcaggtattactttgccttccctccagggcaggcgtaccgcttcggcagcctccactacaagaaaaatgctttgtagagacatttttctagtactatagagactcttttcaaatgcctttacaatactatagaggaattttaaaaaatgtctaataagtgtcttatggtgaattgtctctacaaacgaagatgcattttataaaatgtctataaggtggtagaggcattttctagagacattaaattgtaccacaaccatatgaaaccaatgtagaaatgagaaaaaaatattttcccttgttttttgtccatccttgaactcatgatctcttgaacaaatcattcttatcttcaaggcactaaccaactcaaccccatgtcattcattgtatatgtttatgccttaagttacttatatttagccatttagtatacttttattgtaagaagtgtctctacagagtttaaagtgtctcaagcaaatgtctttacatgttagacacattttaaagtgccgaaagaatgcctttacaagataaaatctaataaaatgtgctgaaaatatttctaaagtgtctctagagtaaaagttttctagacaattttgaaagtgcctatataaagtgtctctacgctataaaactcctgatcttagaggcaatttgcaaaatgcctctacaaaagtgtctttatataatgtttttgttgtagtgctcgacttcatcaccgacaacttcggcaagatcactcttctcgactaggattcgaaccagtcgagaagagacggcggcttggccccgtttggtctcccgaactcggccaagatctactccaacatcatctctcccgagttggcttcgaaccactagggcgagacccccaagacttctttctcttcactaagcccagctcaagacacaccggtttacccggtgatcaccatgcgactcctagacgacctcaccaccatattcggatcaaggacatcctctccccgcaggtctcgatctaatctgactttggctcatattgaatctggctccagggaggtcggtgttatcttccagccactcggatcttgctcatctaccgagatcgccagctatctcagcccttcaagcaatggctcttgtgcgaacaccgagaccatcaactacagcgacgtcgacgatgagtacgacttcgacaacttcgcttgctacgacgattactatggtctactatgacagtttcaacgataacttcgcttgctacgactaattctatgacttctttcttatgctctcagcacacaggatgaactagagcacagtatttggcgaggtaggaaatctatgagaggctaacattacataggatgcctatgcacgagcttctctacattgaggttgtttgcctcaaattccccttgcattccattcttagcgcatcacatcgtcgaatcacagagatagcgttctactatttctcacaactgctttctcacaaaacagaggaaggagatggtcatggtttgcaattttatggtgccgatttctgccctgaggagtagtggctagcttatttatttatgggcacttggaattgaagaggcgctagcactttcagtgcctcacaccaaccagacgagaggagaaaaaggagaacatttcgatctgaacattggtaacacattatttggccacatactcacatatatatataaccaaagtacaacgcaaggacagtatattttattttctacagtgaattatttttttctgtgtgatttaaggcactaatgagaacttgtactgggaggtggaaaaatatatttttctatatgatgtttgcctcaacttgattcaagtcattcaggtggacatcatcaattcgtgttctatttgatcaatacaatcatatgtacttggacgatcacaggattgaaacctatctatttaccttgagcaagtggagaaggaagtgtagcgtaggatcgaacatcaagaactaagccaatcaaagggggggggggtgaatggttgatgtacccaaaaaccaaaacttttagcggaaacaaaagttaccctcaatttcgacgaatcgcggtctgaccgaagtagatgcgtcggtctgaccgagattgtatctccggtctgaccgccaagataaactgccgtcgccggtctgaccgctactaacccgtcggtctgatcgctgcgatgccgccggtgtctcgccggttagaccgccgaacccgagtaaacacaaatcgaagaactcttgatgtagatgacaactttattacttctatctgtgtttacaaagtgcaacaatagcactcctcacgaaaatttcgactaaactcgaaaccctaactcaactctcaactcaatgctctcaacagcaatactaggaagtctcacgctccctctctatttatacatggggtaggcagcctaaagccacgaactaaactcatacaagaagtcctaatctatctaggaaaccttgtcgtacaagaaaccaactttacaaactccaattatatcaaatttggactccttccaaattcaactttgcatcccatacacacacaatatgtccatcgtatgccatataaaatcttcaccaaccacgtatattgatcgttagcctaagtatcccacatgatatctgaccgtccggacgtcaccttatctccaagttgactcctgatccatcaccggcaaaactcccccgcgaggcatcaagtcacatacacatgaatcaaacaaataaaccatattcctagaccaagctatctccaacttaactcattattagcaaacaacagtattacatacgtatagtatctatctagaagccataaatacaaaatatccacggatatccaatcaaactacccgaaaccgaaaccgacgcagagtcggccggtcagaccgcaggctggccgatctgaccggcagcacccactcggtctgaccggacctgacaaaacagcagcacctgaataacacttgtaaatccaatcatctccaaaaccacttcaccaataatcctcaaatattaaaaactataatctcatatgccaattgttcatcatagaataagaatcaaacacaatttgattttacatctagtcatgcagatcgacaggtagtggccggagctctggcgaggcaacgagcgacataatagacccagagttcttcttttcctttttctagactagtcaaggagggagtggggaggagcttctcctacctgaatgttggggaaggggtaaaaagtttcatatcacgccatagtttccttttcgggaatacgcaaaaggataacgcacctttgtatcaggaggaataaaattttacaaacgggaccaaacaaaaaggaaacaatagccaagagctgagaaagaaaaagaaactaaaaaccagaggaacttacccctattctcacactacaaaatagatgacctagtgacctagcaccctacataggaagtgcaggctacaaggccctggcaagccgccagagggtggtttcctgcaccactctggcggctcctacgtcatggccatgacgacctcgggccaggacggtgtgcagcggctgaacacatgttattcctttccttccaatccaaatagaccaagcaccaagggtagggtgctaagaaaatcattacactgcttaggaaatcatttaattactgtccaattaagttattctctctccgttttaaaatgtttgacattgttgactttttagtacgtgtttgaccattcgtcttattcaaaataattatttattcttttcatattatttgatttattgttaaatatactttcatgtacacatatagttttacatatttcataaatttttttaataagacgaacggtcaaatatgtgctaaaaagtcaacggtgtcaaatattttgaaacggagagagtacatggtgaaacattttattaatactgcctttgtgaaatcccagaatcaactggagaagacaaaaaaaaaacctaacgagataattatgcacgcgagaagttattctgcccaatgctggtcgtttcaccggcaactccacgcactgaaatctcgcaacgcgcgacgagctctcctgaggtttgcgtgacgagcaggacggccccagaagatccttgcctcttgcaaaggggacaatcgcaacgccaatcaagtgaattggagcactgcaattggcaaatattttcagtctgctaaaggctaacatgacaaatcatgcctaagaaggagccttggaatgtcatcgttgttcatctcgaattccaaatgcatcccatcctcagggtatcgcatcgtcgaactactgacacagacattctatagacgttctcttctcaccgctgcttttccgacagacagaggatgaagatggtttgggcgtacagttttctagtgctggtgatactgccgaagtagcaacaacagctagcctttttatgggcacttggcaaggtaattagggttctgtttggatcgaagggatattttttaagccctcccttaaatagcctaaattgtcaaaaaaaatctaaaaggatgagctaattgagggctatttgaaaataacccaccaaaaaaactattccacccaagaggtgctaattggggctattttgggtagggcccactgaaaaattgcattttctctctatctctctccataggaagttacattaaagaccaaatagctcttaaaataaccgttggatccaaacaacttagggctattttattggagggttattttcttgtgaaaaaaaatagctctcaaaataactctttgctagttctccaaacagggcctagataagatatatggcacttcagtgctacaccagccagagaaaaagaaggaaaacattactctctcagcattagctagttccatgcatttcttttcacacatataaaacactagcgatatcgtggtgctctctctattggtaaaattatactactagtagaagatgatctgaaccgttcattattaagaaaaaatagtaatttactaatactacagtgattaggggtaactttgtcattaatttttttcccacctagatcaatatatggtcatctataaatatgtggtcatctattgctctggcatcattcatattccatcaaaaagccaaaagaagaagaaaaaaaatgtttgcactcgtatgaggagtactaattagcactcgatgatcaaacgaccactaaggcactaattaatcactatcatgcgccaattgaattacttctgaagaagtgacgtttccaaattgcaggtttctggaaaagcaaagacctgaactgtttcttttgcaattttttcttgatttcaatacctcctcaacatctttgctttgactagtatgccatgcgttttgtttaagtgacgtgtctttttttttcttcaatacctcctccttagaacgctaaaattgtttttcggtaattaacttagagtgtctatatctataaaaaaatgatttcgtttggggtggtgtattatattgtttgatttggtatcactttcctagtatgttctttttaacaataaaaatttgtttgatagtccctccgtctacaaatttaaaagattttgcctatatataggcaaaatcccttatattacagtgctagcaaatcgtttactggccaattaaaaattgggttaattggatccataccactataactttactaaaataaaaaaatgtcactattattcgttatatcggctacatgtcactggaaatttctaaaattagaaccatgctactccagtcacttttttcatcctcctctctcataccgtctccgttcctgtctcattccgaccaccgcggcggacttcccgacgagggcggcatcgacggcgaactgggtgaggaggtccgggtgagtcgaatctacgacggcgagggccgcgtcgactgcgagctaggagaggaggccctaccaacgccaccttactgctggtggaactgccatgcccagcttcatcgtcaacaagcaatggccaaagcgaaccaatccgaacaaatccaaccaaatcaaaagaatttatcctttctctctttttgttttctcatcaagaagaggaagaactcacggccaagaaacaaaagtcgagtcgaatcaaatctaatcgaagaaatcatgctcctgttttgcgctcatccagcgatgaggcgttcacgggtaaggccgatgcagcggtggtgccacccctgcatgcagcaacccaagccgtggaaggaggcggaggaggtcctctccggctacggcagcgacgtggaggagcagtggcggatgcagaaagaaatagcagtgggtctgagcaaattagatagagttacagtccccctaccatctacatatggtaaaagaatttagtgggttctttgtgggggctttcatagtcttcacgccagtagcgggggctcgagacccgccgctcccgtactggatacgcccctgcggaggcccccgtgctggatccgcccctacggaggaggtcgtgcaggctcccaccattcacaagggtatgccgcatgttcacaagatcgtgcagactcccctccacaccaactgggggaagaaaaaaagaaagaaggaagaaacggcaggacgacgaggacacgaaggagatgatggagagctcgacagggttgaccatggcgtggaggatcccaacggcacgtgcggcgagcaggtggagggcgtcgattgccgcggtagggtgggcgctggcggagaggagggaatgggcgcggcggagcagggatgcggtgaggacgacgacggtggttgtgatgacctcggcaacggcgtcctggcctcctgggaacgagaggacgggaaggagggaggggatgaggacgggaacggagacggcgtgagagaagaggatagaaaaagtgactggaatggtatggttccaattttagaaatttccagtggcatacagccaatatgatgaataatagtagcattttttcaatttggcaaagttgcaatggcatggatccaattaacccattaaaatttgctaggaagtcgtttattgtccaactaaattttacattgcaaaagcgaagtaagcatggctgaactggttatattccttgtggtggatccaaatcaccccattgcttgtatttacaactaattattctttcagtgataggcgacttaccgtcaacagcaagacatttatggtgatttcgtcaatctcaagatatgccggcctagtattgcgaaggtgcttataaggatagagtgtgcgtgtgttgtgagtgattgtgtttgtactatgtttctaaaaaaatacatggtaaaaaggttaatttttaacacaatcttaacgaatcccataagcaacctagagatgacaaaacatatctctcatgagcaagactgcgcgcgaacagggtgtaacaagatttgtataaattaaaaccatcttatagctaaatataaatattttgctgacatggttattattttgaagctaatagcttactacactattagacttgctctgagctggtcgaccgaagtcccgtctctgtcaagcagatgggccaatcacaaggccgatcaaacgaacaagagcacaacatttgtcagggcatttaacctgtgaggggctaacatgacatgcacttcaatgtggtgatccctcaaatgggctttcagtacgtcacggcgtcctggttcctcatctcgaattccccatgcatcccatcctcagatcatcgctgatcatcgaaccaccgatcgagacaacattctaacacagctgcttttcccatgggcattggatgaatatggtttattgggcatttgggttttacagttttctagtgcccagagtacgtagcagcaacaagttagcttaaatttataacatttgctctggtccaataaaaagtacctggcaagcaggcaaggtacataggtactccctacgttttaactttgatcaaagttaaactactctaagttcaactaattctgtagaaaaaatagtaatatttacaacgccagcataattttattataaatctataattaaataaattttaataatatatttgtcctgggttaaaatatattactacgtttttctataaaactaatcaaacttagagtagtttgactttggtaaaagttaaaacgtcctgtaacctaaaacagagggagtaggagatttgctccggtccaacaaaaaagtagctcgtggtaccatcattatagtaaaggttaatgtttgcagtgtcataattgcaaatccccccacggtaccaaatcgttttcgatcgttgaatctaacaatgcccatccggtcgagctagatccaacgatcaaaaatgatttggtaccatgaggtaccgatacctcgagatatttttaataaaattttgtatgcaaaatgtggtatctcgatgtaccaaatgttggatggtaaaattgctcgtatcatacatatatggagtgacctcaagttattaggacttcagtgctacaccagccaaagaagaggaaggaaaaaaggaaaaacattctctttagttgttagcgtatataacgaagtgtagcaagaatacatgcagtttatatttcactgctcggagtaaacggaatttgctaaaaaaaacgctcggcagatttttccttttcccttaaaacttttgaatttttggccgtctgatgtgcttcaggattcaaaagcgtgatcgttaaagaatacgtctttgatgaccaaccaattttttatccgtgattttattaacggtggtgtttttctgccatggttgttttcactaatgacagtaatattatgccatcgttgtagccatttttgtattaacgactgtgctacattgcataagcaaccaattaagctgtacctaatcaggactgaaacctattgatttaccttgaaaaaggaaattacatatagagtcactatataaatcgtggctgtcatccactgtgattttccttttacccttgatagcatactcaaagcagagccaaacttgaggaccgaactgacttgtagagcaactctgaatatacacaacatactttcctagatgaaccatgcttcgacgttcggaatgaattgattgaagaacaattatgtaactcatgtctagtatatgaatggctaccaacaagcatagtgccacaatttaaccctgcaattctaggtactgaccaactcaaattcccaacacatcctattctgagtattctcagggcatctcatcatcaaaacaacaaatgcaatgctcatctcttctcgccttaggaagaaacaaatgaaggagatcatcaagcgtcacaatgttcatttgattctgcccctgaggagtagggcacatatataggttatgtatttaagtacattcagtggccgagtgacttagcactaagtgctgcaccaaccagttacagtttgatttagggagtgcagtactacgaaacactttaaaaattaaggtaactttaaatctaaataaactttatagcacagtagcacagtagtagaatttaaatctaaactttgattttgcatgagtattgaaaacattttatttgaagctttaacatgagtaatttctatcattataacttatcgtataacatacgaatttacctagggagtagctatatttatctacttgtctatttcaattctaactagggagtagctatatttatagcgtcacatttttcataaaaaaatagtcaaaatcgtttttacactgtaaatatattcacttacattataattacaccgtatttacattaatataactacaggataagtataatgtaactatggtgtaattacttggtaatttctcagtttcacttttcaccgttttctttcttctcttttacctttctgtctccaactaaattcaatggatgatgtgacatgagtttctttgggcaataaaaatgagatattcacatgagtaacaacaaactaaccgtggcaagtatggagaagctggactcgaggtctcggtcaaaaaaggcacgtacacaagttttactgattttaattaacagaaaaatatgtcgacacattgcctcccaaatttttatttttcaattttcagctcgagaatcgatgaacgatctcctggacgggccggaccgcctgggtgcacgttcacttagacgagctgcagtgatatcttgtcagatagtaaggtcgtatgctcatcacacacagaatggacagatccatgttgctgtaaccggagcatgtcaacttcagggtctctttatcactcaacgctaattccacatacatcctattctcaaattaagcatcgtatcgttgggccaccggcacaatgttctactactcttctcatcgttgatttccagcagacagagaggaattggggatgatcgaggtatatagttttaggacttttacggtaaaatatactgctagtacatactgcaagtatatatgatttaacggtgtagattgatttgattttttttgttaattagattgcagtataaagtttgaaagggtaattttatcttttcttcgttattctatcatcaaatcgtgctaccgtcacgtgcttcgtcatcaaatgtcactcaagatgctcctcctctattgcacgataagatctaagacgaggtacttccaattaaattcaatctgaacaaaaaattactaaaatcttatttttattttctatcaaattcctaacatgcccatcaatatactgccagtatatactgatagtatattgtaccgtaaaagtcctaatatagtttttgagttctgattctgtacgttctaatatcccaaggagctagaagcagctatagcttttatttataggcacttggcaagttatactacttaggacctcgctgccatgccaaccagaacaggcggagaaaggaatgcgttagtctatgaacattagtaacacacgattttgtcacatgtatataacggaagcataacggaagtacttcctccgtttcacaatgtaagtcattttagcatttcctatatttatattgatattaatgaatctatacatatatatctgtatagatttattaacatcaatatgaatgtagaaaatgctagaatgacttacattgtgaaacggaggaagtaccgttttttctccttcgctcttttctcctcttcgccggtttagggttagcggcgggaggcagggcgatgagccggcggcggcacagcgcgccatcgtccccggacagcggcagcacgacgctcttccctctgctcactgataaccattcatatctaaccttatcgctgcatgatgttagtttttacccccgtcaaagttgattttagcagtattttgttcgtcttgctactgtgattagtccgaatctatcaaaaacaatcaggcttaggaactatgcattaccttaaccaggaagagacgggtaaaaagaataagtgaattattaagaaaaaagatcattaaattcaagagatacacgcagataaagagtgatttagcctactttgtttgtggacagttccgaaatatttaacatatattatatgaatggtattttatttctacatagtgtgatcttcatatccaaatattatttgtagtgtatacattctgagaggtaacctcacaactaatgtgaagtggtaattctatctagccaacccaccttcatccctccatccaaacaattgataggatcattctaacccattatatctctcaaatcagacaaaaaaaaaaggtatgttctatccccttaaccgaaaaaaaatagaatcatcccatccaaaaatagggatggacctaacccgtcctatcttgtccccaaatcaaacacatgctaggtgtctgagtgtcgcttctatacgtatgcattacaaaatcgtcaacacatgcctccaaaatttttatttttcaattttcagctcgagaatcgacgaacgatctcctaaggacaagttttatagtggaggtgagtgtcacatctaatttaaaccatattatattcttattaattaagagataacaagtacaatatgtcacctctagtacacaaaccccaatattagtttactctcatatcattttatatttttcttagagatgctgtggagattgccccttgtatgaggggtggctcattctctctctcctaatttctctcctccaactcatcacttaatcctatgcgataaatttagagataaaatgtaggggtttacagtacttgccctaaggcaggcaaacggctggaccgcctgggtgcacgttcacctagacgcgctgcaccgacatactgttagatagtaaggtcgtatgctcatcacacacagaatgaactgatccatgttgctgtaaccggagcgtatcgacttcagggtctcttgatcacccaacgcaaattccacatacatcctattctcaaattatgcatcgtatcgttggaccacctgcacaatattctactactcttctcatcgttgatttccagcagacagagaggaattggggttgatcgaggtatatagtttttgagtgctgattctgtacgttctaatatcccaaggagctagaaagcagctatagcttttatttataggcacttggcaagttatactacttaggacttcactgccatgccatccagaacaggcgggagttctggctgagaaagtaatgcgttagtctctgaatattagtaacacacgattttgtcacatgtatataacggaagcatgacggaagtaccgtttgtgcgaatttcactctctgtttcaaggcactaacgataaatattactccctccgtcccaaattatagggcgtcctctttttaagaaaaatcaaacttgataacttttgtctaataattatactaacaatatatatgctaaatattgtgcatgttatatcactagattcatattttaaagtactttcatgttatgctaatttcatatttgttagaaacataacatgagataaattaatggtcaaattatgtcatcgaagaccgtgtaaaaaatatagaccttataatttaggacggagggagtactcggaagtggaaaaatacaatggtgacaacacatatatgtgacggagaagagacttatcaatgaaacctcatctgtgacaagtgaacatccatcattgatgactcatccatgacgggtgataacttatcacacatcacacataagaacttacaatgttatagccacaaattcatgattttttaagtgacatttatatgcatgttatagtgaaatttaaatctaagatctctcaaaacatgcaaaccaatcttaccatctcattcatagaccacttgttgataggtcttttgcatgtcttttttttcactattcttatccaaacatgaaacacaaaattgacactctagataactagaataatttcaactataaagttgcatatctcgtcgagctctacaacttctatgtatggcatgtctccatccaaggtcatttcaaaaattcaaaaaatattttggaaatagatcacatcacttataacacatattcaaatgaaaaatattgtgaattataaagttatatatctcatcgaactctttcacttcgatataggacatgtctccatccgagatcttttgaacaaaaagtaaaatcaaaattatgtatttcaagatagatttcaccacttgtaatgcgggaacatatcctatgcacataagtttttccgtatacactccgtgcacaccaactagcaaatgtcatagaaaattctagagaaaatttgacacatacttccaatagtattacacctatatatgaaattttaccttcaaattcattatattttagccgtaacaaaaaatacaaaattttgacatatttttatccttaaaactgttagattttttattttttatggctaaaatataatgaatttgaagataaaatttcacaaataagtgcaatactattgaaaatatgtgtccattttttttagaattttctatgacaattgttagttgttgtgcacggagtgtgcacgggaagattgtgtgcataggatatgttccccttataatgcatattcgggcatgtaaactatttcaaattcaaatgttgtcaattttaaagttattgatctcctcgagatttacaactttcatataagacatgtctctattcaagtttgtttgaaaattttccaaaaaaatgaattttccctcatccgtgacggcttgtaattaccactcttcacaaataaccattacggatgagtgctctcatctttaacgggttatctcattacacccgtcatggatgacatgttatatgcgacgatgtacggttgtgacctgttataggtcatccgtgatgtttaacatcacagctatatatgatccatcataattgaccccatatcggtgacgggccatccctggtagttatatctcaaacgtgatatcttttatccattagagatgaatcatcctaaacaggtcgcattagcccgtcacaaattccggaatctgtactggtcactactacttcccaaaattagatgttgtggctttctcatgcttcaatttgattcaggtgtacagcatcatttccgtgttgtaacttgtaatgcactccccgctcaagaaacaaagcgtgttctgactttcaaatgatatacctttgatctacaatttattttattgatacaataataatcacttagacaaatggtgaaatatgatcgatgagcaccattaacttcgatccctcgaaagaacagaatgctatatatggattcctcagtgctcgtcctgaacacgaaacctgaaaaaaaattttcagcctcctcaatgcatttttgtggaagcataaatcataggtcactaccacataacacgagaatagtgccggttgggaaacccctttctatgtcggttttttcaaccgacactacgaaggcggcactgaacagtaaaccggcaccaatcctattttaaaaaccggcacctttgacaccactcgtgagcaaaaaaaaaaagcttgatgcatcacaatctctgcatcacaatccctaatccccaatccccaatcacagaactcattcacagaaatcacagaaatcatttcactaatatcaataaacattccctaatccccaatcccaaatcacagaactcattcacagaaatcacagaaatcatttcactaacatcaagaaacattgaagaacatcacacaaatcatttcacagaaatcttttaagaaacatttcgccagatccgacggagggagggagccgccgccaggccgccaccgcctcttgtcctgccgccgcatcccccctcccttccgccgccactggaccgcccctccacggccgccgccgggccgccctccccggatctggcagaggggagggcgcgactgccgctgacgcctccgccggccgcggatagcaagagagagtcgagaggggagggcgccgccgccaagctgccactgcctctcatcccaccgcagcatcccccctcccctctgccgccgcatgtcgcccctctgccgccactggtccgcccctctgcggccgcccctccccggatctggcgaaggggagggcgcagccgccgctgccgcctccgccgaccgagagaggagaaagagaagagtagagagcggagaaaacgagaggagagaacgagagacggagagacgaagagagagaccgagaggagacgagcactgcggagcggccttttctcctcaaagcttcgtggtggggcccatcggctcggctcaattcataggtgttgattttttacaaaaaaaccggcacctataatttattatagattgtaggtgccggtattaaatactaagggttccggtttttttaaaaccggcacaaaatagagtagatgctggtttttatttagaaccgacacctataattacttaatggtgtcgttttttgcgatttcaacccgtggaggtgggaaaacccgaaaaaggcctataggtgccggttttagaagcactaccggcacctatagtgccaacacctatttgatgttttgtagtaatgggtttatcacatgctataggattttatacatctggtactcaaaacccgcagaacattgtggccctagcggcatatttgtaaacaaaaagtaattttaaataaaacttgttagtgatctaaaagcaaaggctgaaaaataaacttcacttaaaaaccctgaaatcaacttgaagtataaggttaaaaattcaaattttagatgataaacatgagtataagtgaaaagatgagactgttagtttgtgcacaacgggaatagcaagatgcctgtctcgggctctcgactaagccacactgtggagccccccgggtgcacctagccacctacaagctaagctgtttgttcatcactgactcaatcacttggtaagagcaaccacagtgtttggttcggccattgtattgattgaagtcgaatggagagtgaaatcgatagctgcagtgtgaaatcaatttgtggggcccataaaaagaatccatcaaccaatcagtgcgtctactttctaatttctatgcatgtatggacaacaaatattttttaactctctagagttcgacttcaacttagagttcgatttttttttctgacaccatgagtcggctgtcacaatgtgtatggttcgcttttctctgccttaaatcgattttactttcacactggagatgctctaagctcatatccgccttgaaggtagatcgagcttaactcaacttcggcctagaactagattgtgatatgctaggttggtaacgagaacaactatggcgttgcaaccatagcatatcaatggcaaatcctagagctcgcgctcgcattcctcgtgcatcccattctcaaagcatcgcatatatcgttgaagcacctaggatactgtgtgttctacactttctggaggagatggtcagggtttacatttttctagtgcgggttctagccagaggagctagtatagcacactagcagctagcttatttatgagggtaatttcaccatcactgaaagatatatagaggtaaaatttaatatttgtaagtactaagtttctcaaagtactaaaaattcttgctgtaaaatttagacacctcgagattcctttatttataggcacttggggagaggtactaggtagcatttcacttcattacgagtgacacacaacaagagaagaaaggaaattgtttactatctaaacattagtagcacatattgtcacatatatatataaccgaactataacggaagtacagtttgtatttcacaacctagagtgatttattttctatgttctaaggcactagggagaaatattgctggaaggtggaaaagtatcgtcctcttcgctagcgtattgttactgcctgaaaatgtattgtcactcaccgccgtcggtgagtgatggagctaggtgaggggagggagaagagagtggattagggaaagagataaaaatgagagaaatagagatcaggtgcgaaactgataggcggggtctatcaatttttttaataaaaaattgctgactggactgtcacgtagaaccaaaaccaccgcggattgagccccgaggagagtggggggtggaggtgagagttatttgtgcggtttgtatagttgggggtgaaggatatctgctttcatgcatggttcgggagataattcaatcgaacgtgatagtttaggaagtaattcgtactttttccttaaaacaacgtacattctttttcacttttcaggttccatcaaacttttatttttcatttttcagctcgagaatcgatgatcaatcgtctgagggtgtgattagttcgcaaaaagaaaatttttgtgtgtcacatcggacgtttgactggatgtatgaaggggttttcggacacaaatgaaaaaactaatttcataactcgcctggaaaccgcgagacaaatttattaagcctaattaatctatcattagcgtatgtgggttactatagcacttatgactaatcatggactaattaggctcaaaagattcgtctcgcgatttctatgcaaagtgtgcaattagtttttttatcatctatatatttaatgctccatacatgtgtctaaagattcgatgtgacgtttttggaaaaaaaattaggaacttaacaagtcctgaggcaaaacggccagaccgcctggagtacacgcgctgcactgatgaactgtcaaatcgtaaggtcgtatgcttatcacgcacagaacgaatggatccatgttgctgtaaccggagcgtatcgacttccagggtttctcgatcgcccaacgcaaattccacgtgcatcccattctcaaagcatcacatgcagggataaaaacggattggaaacggacggaaactagctttatcatattcgttttcattttttttttcgaaatcggaatcggaatcgaaaacttggatacggaaatgaaatcgaatattatcgaatatagatacggagcgaatacgagacggaacgaatacggtagcgaatatttaccggtatataaaaaacccctcaaattgagtttcttgatcaaggaagagatatcgtttattattttagttcaatatctccaacatttatatcgttaattttatagacggtcccacaaccgtatgtgaaaatcaattttcatggttgttcctctaagagatccatatgcaaatatgattatcattttctattcccaagaccttttactacatgtataacttacttaccattgtataaattagagattttatttattttacttcacatcttcgaaacttgtaatgtttgtattatattttaaatgctttcaaatacaaatgttataaactacaaagtggtagatcccgttgagctctataactttgatatggaacacatctccatcagatgtcgttgaattgtagatctgagatttcgtaaaaattaatatggtatattataatgaatatttagacccataaatgacctcaaataataaaatagtcaataataaagttgtagatctcatcgagctctacaatgttgatataaagtttgtcttcatctgattccgtatgaaaaggttatgtatatagacatgttttttatataatttgctcaatgtctgcggatatccgaaacaaattccggatagtttccgactgttttccgatttcgaaggatagtttccttactgtattcgttttcgtttccgagaaaaaatatccgaattcgtttccgaatccgagaatttccggataattccgatcgaaactatccgaatccgaaaaatggtccggacggacggaaactatccaaaccagtttcatccctaatcgcatggttggagcaacggcgtacaatgttctaccctttaacacaataacagcgggttatgtagctgctggatccctagctgctggatccctctctagactgtcagtcacccgggtgcacctacaatcagtgtgttgttcggtgatggttgagatcatttggtaagctctcctcgaaatcttaccaatcgagctgatctcgggtaggggtgtaagtggctaacccgcgaaacctatttatagactaaaataagccgcgagcccgcttattttgatctataaataggttcgcggctgacccacttacacctctaatctcgacctcagactgatggactgtgatacgctaggttactggcgtgaagaactatatggcgttgcaaccgtagcatatcggccgccaactctgcagcttgcgttcgcgttcctcatgcatcccattctcaaaagcattcgcgtcgtcgaagcgccgagacagcgttcgacttctacactatctgactctgctttctcatggacagaggaaggagattgccaggggttttacagttttctagtagcggagtagcagcagctaacttatttatgggcaacttggggagttgctaggtagcaagcacttcactttagtgccacaccaaacagacgatagaagaaaggaaaacattactctctgaacattagtaacacacactgccagatatatataactgaagtacaatgaaagtacagtttatatttcacaacctagagtgatttattttctatgttctaaggcactaataaggagaaatattactggaagatggaaacatatcgtcctcttcgctagcatattgttactgcccaaaaatgtacgttctagctttcacatcttcagtttgttacttggtttcaggtgaacagcatcagttcgtgttgtagtgtgctatccacacctgaaataaagctttgttctgtcctcgaaataacatgttctattttattggtacaatcatcaattgggtgatgaaatagtcgatgggcaacactaacttcctgaagttccttgaaagaatgggataatctggagacctcatagctcgtcctgaatatgaaaccaacagattgaaaatgttactgaactgtttctcctgtacctttggcagttctagagatacaagcaaatggagaagttttgtaacttacatggtagtcatacctacgatgatgaccctgcaaatgtagagaaacaaaataagatgtcagttgtgatggccatcaaccggtgtcatattactgatactagcctatgcatcagcattagcaaattgtacatgtatatggcagttagtggttagcacgcacactacctctacatgtctccacagtgatgatgtctagaattcttacatgttttgctgacagaatgtctattacttttttttcttgctacctatcttttacctgatctttgtaaattttaatacagctatagattttcctgttatatcctaaagcaagcagatacaagctaaaatttttgatagattattatggtcggtgtttgatatattagaggcaacccctctctgaaaggagtaaaaagaccagctgaattgtagaaggaagaaagtattccacatgatagcagggagaagaaatgtactctatatctatccctgtaacggtccctgcctcggtgccgatccctgtctcttcttcgtttctctccttcctctcgtgcacgccgagcctcctgtggaaaagaagcatctgttagcttccctatgaactggaattgctgagtcacaagacccaactcttcataataatgaacaaacagaagagtaaccagtgaactaaaagcaatcacaaacctcgtcttctctagccttcctccgcttttcagcctcctcgaaggcctccttttcagcctacaacacagaaaaatatattgaaatgggggtttccatgacatgaaactaatggcatggataaatttacaaatatgcgttctgtgttgttattccaggtgagcctacctctttatttgcagccctaacttcatcaacaacacttcttgcatactccgggtcgtcacaaatcaaaatgttgtcaaaaactgaaccagctttcacctgcataccacctggaatgttagcttacatagcatttatgccattcatgtaaaggactgtgtcgtttgacacagcctagaagcagcattccaacagaacaagcatatttaaccaagaaatataatacctgccaaacctcaattcccacatactgcaaaggtttcagcacatataggtctgggtcgtcctcaaattctgtgaaagatgcatatacatcacttaatattcacttcaaatttggaaggaggtgaggtccagctctaagtcagatatgcagcaagaaatgaaaaacgctaacatagtactgttaaaaaaaaaaagcccatcatttctcacctggattatcaatccatgggatcttccattttcccttgtagttagggttcttaattttctgcgtacagaagcatgttaaaaaaatgctacaaaatgtggcaatgaggagctaatcagtcaataaaacaaaccttgcgtttccaacgtcccttgtattctggattcggtatcattctaggcttccatacaccatcatcatcatcatcccatgactcaggctgatttagtgtagaaaggaaaacatatgtcatcctgtgttatatttattaacttagcaaacacaccataagagccattgaggtcatgctgggttcaatatagctaatagcagatagaaaatgctaacatgccataggatgtttctaatgaaacaagcttgaacaggtaaaatggaacctttgtctgcactcgggttcttctcataatattaagaacatatgacactatgtccattataaacggatatgccaattaaatgcgaaaatattagaagctggatttacagcgtaattcttaagtgcaaacctttttgtcctttggatcaggaatctctttaggaatagagtcatagccctggaaaattaaggtaaaagattacataacgttctttatttgtattatcaatgtataacaaatatgaaattgcaaacctctggtttaacttcatcaggatcttcaatatattccctgtcatcccaatcttttggctgcaagagaagacaaatataagag

SEQ ID NO: 69991 - DNA, 8910 bp, Oryza sativa
ttctcagtttgcagatcgatcacttaattagagcacatgcaaaatatgtaattgcatatatagaagcagctaatcgattatagaaatgggattgaagcaacaaatcttgcttgttcacggaagaacatatattcagactgaatgactaacttgatataagatcttaattgaacagggagagctcctccctccagctattgtagacttctcttcaacctctttcctcttactgtttgcgcgaattattttactccaactatcttagatttcgtgttctcttttcctagtttggactatatttttaattttcaattactcactcaaagcaaaaaggaactgctacttgttgtattaggtggttttgtagcacaatctatcttaatatattaccaaaagaggatagaaaggagatacatgttcgctccgggtccctataaattacaaagttaatagaagaaaatgagaaaaatgcatcattcgatattggtagaacgaatttataacattagatattaattgatagagttgcatacaaaatgcaattgcatttgcagaaaaaagacaaaattatataccagatacaattagggaaaatcgcattatcagttgcacaggattagctaattatgtacagggtttacactttcggaaatggctgaatttttttgtcatttcagtggtcaccgaaatttcgtgaacctcgggattactggaacttttttgcacgaaatatttgatattgtaacaaattttaattgaatttgactaaattttgacttttttttaaaaaaaatggacaatctgagaaatcctggagagatagttgcttggtggtcggttgcttgatgtatatggacacacatttgaagtattaaatatagactaataaaaaataaattacagattccgcttgtaaactgcgagatgaatctattaagcctaattaatccgtcattagcaaatgtttactgtagcaccacattgtcaaatcatggcacaattagactcaaaagattcgtttcacaatttatatgcaaactgtgcaattgattttttttgtccacattttatgtttcatacatatgtccaaatatttaatatgacagaagaaaaaattggaagtttgaatggatccgaacacagcctagcctatgtaccgatttatcggccttcattttctctctcccatgttatagtgtgatcttgttgcagacttacagttgtggttgcagtagtggtacatatgcatgatggcagtcaagcatgtcgtgttctggataatattgttgaacgccccgatatatgttgaccgctctgtttagatcacgaaaagaatatttttaagtgtcacatcgaatgcttgatcggatattgaaatgggtttttggacatgaatcaaaaaactaatttcataactcgtctggaaaccatgaaatgaatctagcctaattaagccgtcattagtatatgtgggttactatagcatttatggctaattatagactaattaggctcaaaagattcgtctcgctatttaccgtataattagttttcgtttttatctatatttaatgcttcatgcatgtgtccaaagatttaatatgacgtttttggaaaaaaaaatttggaaaataaaacaggcctcagtacggctctacctattgaaagcatatttctccggctatgaagtgtagctaggtttatctgctttaacagtagtttctttgtaaactccgtaatctgttatgaacctttcttttccattaacggaagagggagaagaatagtttcaatgttataaaaaaatccagcgtgaacaagaagcgtcttgtgcccatagtagaaaaaaccggaccgaacaggcagttcaaccggagaaaaccgaaaatagaggttggcatagttcggtcgaatagaaagacaggacatgcaattgaatcgattcagaccactttaaccggcaggttttatgatgaactgggcaataaaccgccttcagtcggaccagactaaggcaagtcattgaatgaatgggcgacaggacagcctagttagttcttaggctcgttttttgggccgcacttgttttttttttagcaaaaatcaaatgaaaaggtgcgttggtggggagtcaacccgtggtcaagggttgcaaggcaactgccgactgccgtagccatcctaccagccagatgtttgtattgtaaaatcaaaggtgtttttgattattattgtgtgatgaacaattgggcattggaaattattggttttgttatttggaatttattcacgaagtggttttggagatgattggattcataggtgatcgcaggattttattattttatgtgaccggtcagaccgggctgtgtatgccggtcagaccggcggtgaccaagcggtcaggccggtcagactgtgtcgttttcggtttcgggttatttgtttggatatccgtgattatttcatgattatggcttctagatggatactatacgtatgtaatactgttatttgctactaatgagtcaagttggagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgagcgtggttgatggagattccatatggcatacgatggaggtattgtgtgcgtatgggatgcggagtcgaatttggaaggagtccgaatttgatatgattggttatgtaaagtttgtttcttgtactagagggttttctaaggtgtttaggactcctagtatgagtttggttcgtggctttaggctctctacctcgagtataaatagagggggagcgtgaggcttcccggtatcgctttagagagcaattgaattgagttttgagttagggtttcgagtttagtcaaaatttttgtaaggagtgctgttggtgcactttgtaaacacagagagaatcaataaagtcgtcatccactttaagagttcttcgatttgtgtttatcgggtttcggcggtctaaccggcgatctaccggcggtcaaaccggcggcaagcggcagttagaccggcggcattcgggcggtccgaccggcggcggcgacaggcgcggcaggcgacatcggtggtcaaactgggtgatctataccagtcagacttacgacatccacacgatcagaccggcagatcgatctccgtcgatttcaagggtaacttttatttccgctaaaagttttcggtttttgggtataccaaccattcatcccccctctggttggcttagttcttgtgattcgatcctacaagtggtatcagagccttgttttcttctttggatttttatcgatctagagtttttaccatggctactcctgctaagttttcaactaagcctcatgtttttgatggaaaggatttttctcattggtgtattagggtgcaatcttatattatggctgaagattatgatatttggagaaaagtttctcatccttatgtgattcctgaagctattaatactgctgctgaaaaactgcttttgaacaaaattgcaaagctcgcaacattcttttgagtggtatttctcgttcggattatgatcgtgttgcgcactttcgaactgctcatgaaatttggaatgctttgagtaactttcatcaaggaagaaataacattaaagaacttcgtcgtgatattttcaaaaaggagtatattaaatttgagatgaaacctggagaagctttggatgactatctctctaggtttaataaaatttcgagtgatcttagatctgtagattcttcttatgatgctaattatccacaatatgagatttctcgtcactttttgaatggtcttgatatgtctatttgggtgatgaaagttacatctatttaggagtctgttaacatgtctactttgactttggattcactttatacaaaattgaaaacacatgagatgaatgttctttctcgaaaagttgattctaagtcgagtgctttggtttcttcttcttcctctttggatgttgatgcttcttcatctaaatcttcttttcttactgtttttaatgccacatccgatgatcaactcgaacaaatcgaggaggaggatttggctttggttgctaacagaattgctcgagctatgaataatgccaggaacaggaaaagaggtggtccaaatcattgctttgaatgtggttcaattgatcatcttcgttcgcattatcctaagcttgggagaggcaaaagagaagacaaagatggtgagaagaccaacatcaacaacaagccgaagggttcatcccaagggaggaagctggacaatcttaggaaggcttttcaacaagtttgcgccgccttcgagccactaagtgatgtagatggtgaaagtggagatgatgataagggaaagaacatctccgatgtttgcttcatggcgcgtggtgaatctgacacagagtatgaagataatgaggtaggtgcttttgaggaagctattaatattttgagtgcaaaaaataagaagtgtgagaagatgtatagaaaacaggaatttatcactgaatctcttaaatctgaaattgctagattaaaatctcttattcctaatgatgataattgctcaaattgttaggttttaatgaatgagatttcaaaaattagagatgttaatgctgcacatgatttgaaaaatagatcttctcttgcttgtagttttgctttgcacacacgcactttggatgagtttttttaactaaaaagttgttgtaaaaatatataattgcttttcatgctagattgatgtttaacatgatttctgctaaaaagttaaaacaacctcatgatgttttcgattgctcaacatgtaatttgaataagttgaaattgaaagatgctttaggtcgtgttgagtacatggaagatgttgtgaaaaacaatgaagtgctttcttgccccaaatgtcataaaagcaaaagtgtcatggtagattgtgaaaattgtgctaatttggaaaaaagaggtttcttatttgaaaaattctttgctaagattttctgatggtaaagagaacctcaacatgattttggatcaatcaaaggttagcacacataaccgtggtttagattttaatccttatgctcataattctagacatcctcctgttgtgttaggtgttggtgctagaagtggtgagattttggttaaacctgatactaacaaaactgtgtttaaatctgctggtatcatgtctaccttgaatgcatcttcttcaaaatctcctgttgttgcttgtgttgctaagtcttctaattctacgaatgtgtctaatcatcgccaaaaatatacttgttccttttgtggcaaagatggacatattgttggtttttgttttagattagcacataaacagaaaaaggagagagagattgcttttgcaaaatcaaagtggcaaaaatctggttttccctcgaggaaaccggtcagaccgcactaggtcctgcggtcagacctgctactgagcatcggtcagaccggcggtacagaagcggtcagaccggcccccggtctgaccggctgctgtacctcggttagaccggcctcggaggaatttttctgaaaattctaaaattgattttgcacatggatatatgcctattggatcttctggtcgtatgtctcagtactggattcctaaatttttattatcatctaaccccagtactgaggcttcaacttctgcttctgtgtaggctttggtggcaagaaaggagaacgtgtggatcgtggattccggttgttcgcggcacatgaccggtgtcacgaccggaattaacccaacgggcgttccttacgtgcgtgtattattccttgtcccaggaggcaaggtacaccaaaagttgatacatttcagagtttatcaagcggaagcgtaaatagttaatttattatatgggcggcgaaggcccagcacacacaaagacaaatgggaaacagcggaagactagggcaatgaccataggcgcttgacggcaagcacgagctagacaccaaagccttcatcttccaggggttcctcttctgggtttcggaaaaattgagcaagactgagtacaaccaccgtactcaacaagacacacccacaagtgcaggataaatgcaagggagtacaagggggttataatataaagggttagggtttgcagtaaacagcattaagagacacttagttgctcaaagctattttgtaaacacgattccagagctatacgatattattaatcaaggccgtgaacccacacgaacctgccttaacccaaggtctacgatgattcagaccgaactggcaacccgaccctgggtcccagctcgtcccaagccaacccaggccaaccattccatattttagttgttaagctggttttaagaattaaaacactaacttgggtacattgctcggcatgcccataaccgagggcgcggctattcgaatagattatactctgatcagaggtgtacatctttacccacaagacacatcttcctcacgtgtaatcacgtgccacataccaccacggtatacggacggaagacgtgacatagtttccaacccatcctagccatagacaagagtaccgacccaaccccacctacggccggaacccccgggacaggtaggcaggactgaacccctagcagcaggacaccggccctgtgccatgacatctcgactaccgggccgcagctcgtgtagccttcatttgtcctagagatatccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctaatatcaaaaccatgcaccccgagcccagcctaaaaccattttgaggattttgaatagagggggaggtgtgaatccaattccacaataatccaaccattccatagtgtccaggtgatatgaatatcccaaagtctagagttgtaaaaccacctaatgttgcctaattaaccagcgaagcatctacctaaaatcatactagtggtactatgagtagagtgtccactagttggggttttgtttattctagggtgaataaggaaataataacaataacaataataaggtcataacaaaggtaaataggcatggctagataaaacagtaataacgcgggaatttaaataaagcgataatgcaataattttaatcaacataattttataaactgggattcaatatgttcaaggatgatgtgacttgccttgctcgctttcccaaacgtcggcttcaacttccacgaagagcggatcttccgaagctgcagcgtctagacgaccaacggaaaagaaaagtcttttactctaataaactccatataacaagcaggaacaaagcacaaaaatgggttcttgacttcttaaggaaaaattagagacttgaacggtccaattccgaattcaaatggccaagttatggccatttgaagtttatatgctctttaaatgaatatttgcgaatttcttcagttaaattttaattttaaaagggtttattgcgttagccgaggggagggggcgcgtggaccgggtccacgggagtggggcccacgcggcagtctcacggtccacggtggaccgggtgcactcgggctcacaccggccggcgccgtgggtcccacgcgtcagccgcacccgagggcgcgggcggctgacggccgggccccacgcggcagccgctcggtgcgcccgaaggcggccacgtcggcgcggccggcgggaggcggcgcgcccgcgcccctatggtggccggcggcggccatgggcacatcggagcggcagccgagagaggggagggaaagggggaaacgaggcggtggtccaaggctcaccctaggtcgacggcgacgacgaaaaggcaaccggagcggaggaaggcggcggcgcggctcgggtcaacggggacggcggcgctccggtggtcgacgagcgaaacggaggggtggacgaggtcggcgaggatgcggcgaagccgaaggaggcagcgccgaggtgggaggtggtctggggcgacgacggcggcggaccggagctcggcggcaatggcggagagagagagcgacggcgcgagctcgattccggcgaggtggaagggcggcgagaggcggaaacggacggaggaggtgcagggagtgtttaaatagggttggaagggggagagagcggccggcggggaaggaataggcgcgggaggtccggccgccatcaatggcgccggcgagatttgcgggggcaaatccacccgtttgaacgcgagagagagagggaaaaatggggggaaagggagaggggatcacggggagtgattttcccctctttattgcacgcggggacggctggaggcggtgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagtgagatgggctaacccgcccaagatgtaagggaggaaaggggactctttagaggttttctttttataaacaattttaactttgttatttgttagaaatattaatttgggctctgaaattgccctaaaattatttacgcattttaggctttctgcgaaaact

SEQ ID NO: 69992 - DNA, 4308 bp, Oryza sativa
  unsure (1)..(4308): unsure at all n locations
gcgggccgccgtcagggcgcgcgcggagaagccgnnatggccgcggganagnaaagnaggggagtannatgnctganccggcccaagagganaaggaggaaagnngnactttttagagtttttctttttataaaatcattttaactttgtttatttcttaataattattatttgtgctctgaaaattgcactaaaatttatttacgcattttaggcttttaggaaatatacaaaaatcctccaagccttatttaacttttaactttgcacattttaattgttggaggctttcacacggattttaattattctaggcataatttagaggatgtattttagagtccttttgggacgtgacaaccggtgataaaaattggttctcctccctcaagaaggcatgcaagactgaatcgattatctttggtgatgcttctacatgtgccgttctcgctacaggtttggttaaagtaaatgaaaattttgaattgaagaatgtagctttggttgagtgctgttggtgcactttgtaaacacagagagaatcaataaagtcatcatctactttaagagttcttcgatttgtgtttaccgggtttcggcggtctaaccggcgatctaccggcggtcagaccggcggcattcgggcggtccgaccggcggcggcgacaggcgcggtaggcgacatcggtagtcagtccgggtgatctataccagtcagaccggcgccatccacacgatcagaccgagaccaatttcggtcagatggatctccgtcgatttcgaaggtggtgaagtggtggagacgccgcaatcggatgcttgtcccagctgcagttgacactccatttcctagaaccacaagcggccatcaatctaccttcctgtttgagttccggccgactgtggttgtgtggtccagtgcaagcagttatcgacttggtcgcagtgaccatctagtcccctcaaactcgtccaaaagatgatcgacttctttacaagttggtggtactgaaactaggaatgaaaaatttaatttgttataaatttgttttccaacctaaaattgttttccgttttaaattttcttagcctatctatactgcagcgtgacaaatctcttatcgaattcaacgctggttccgggcggacggccctgcctcgtggcgtggcgcggttcgaggatgtaaacgcgtgccataattttcgtggcctcgctccttcaatctcgcgactcgtatggcgcttcgtgatttatctggcaggtgcgatagactcatcgaccccatagagtgtcggcgtgcagcccaatggtccaagcagccatacaagcatgtaagccccaatgaaaattttgacagtgcaaggccctttttttttccctttggctatagcagtaattttatacatcagggaaggagatgcatttgtgaaatttctgaacataataagcaagctttcaacagttgattctctatcatcacatgcttaaccttcttctgaaatgcatatggatttcccactctgctaataagaagcagcaaattcacttaggttgtgtttagatccagcggtaaaattttttaccgtgtcacatcggatatacggacacacatttgaagtattaaacgtagtctaacaactaaacaaattacagaatctgcttgtaaactgcgaaacgaatttattaaacctaattaatccatcattagcaaatgtttactgtaacaccacattgccaaatcatggagcaattaggtttaaaagattcgtcttgcattttacacgcaatctgtgtaattagtttttatttttgtctatatttaatacttcatgcatgtgtccaaacattcgatgtgagtgtgaaaaaacttgccagggaatctaaacagggccttatactccatccatcccatttgaagtgcagccatgattttccgtgctcaactttgatcgtctgtcttatttgaaaaaaattaaaaacataagtcacacatatagtgctattcatgttttatcatctcataaaaacaaaaatactaagtataaaaaaaattccaataagatggatgatcaaatttgggcaaaaaaaactcatggttgcacttacaattggacgaggggaatatcacaacataatagtgtttaagaatttcatttgaagtcctcctgacctgaatgtcaaagcatgctgcctttgtaaaaaaaacacaagatttgaagggattgtgagcgtgttggatattaaacacgggacctgggggttgagaccatatacctcctatgaccgcatatcaagtgtatctcctatgttgcctttgtgacaatttcagtgtgtcctaatcagtaaataaggaaaaacatttgtcagttgattgtttgacatgtttacataataaagttgtttcttcagtagcttagaatttaaccgaccaactttattctgttcactttgacaatagagatacataagatagccggataggtgatgatggatcatataatacttgaaattaacaatcaagacacacattacttggcaattgatttggtagcatagaaataccacaggttggaaaatgtatattatatgttcctttcaagaaacagaatgtatcaatgctatcttatttcctgataacttggtttcacagtatagaatgaattctaaaacgtttagataatatcacataaaatgagtattgcacggtttataaaaccactagtagaaagcgcgtcaactagtgtgcctatcttatattctaatgctgatattgctagcaagctttgattaggccacgtggtgcctttcccttagcaaataagtctctagattatttgagagaaaaaatgacgccaagacatggtcactttgccaaaccatctccagattcccacgttcggctttgtggagaaataaaaagattcgtcaagaaaaannnnnnnnnnnnnnnnnnnnnnnnnnnnactatactgcagcatgacaaattagtagactattggcaagcatgcatatattagtaggtgcaactaatgaaattcgagtccaatatcccctacatactccctctgttccataatatagggcgcaactgattttttgaagtgtaccagaatatagggcgcccatgcacatgcaagcaagtagcattaaaacaaaagtatgctctggtcgacttccgtgcgcatgcatgcaaaggttttcaatgcgtggagttggctcttcatttcttgcatgttgcttacggcctctttctttcttttggttgctttaaagctcttggctcactggccggactccatttacaagctcacttgcattagttgtaacacatcggcgagcaccggcgagcagcgatggatatggcagagaagatggtggagtgcccggcgagcggcaagacgaaggccaggagttgccggcgcatgcggcaacaagcagagatggagttcggtcgtgcgcgatcgattcgtgtccacgccatccgaatgcggtagcgtgcgcaaatggagctcagccgtacccgagtgctttgcgacgccgccgtccgcatgcggcagcaagggcaaatggatatagctcttgcgcgaatggtttgtctccacgccgttcgcatgcggctgcaggaggagcgagctaaccacgtcaatgattgcgaggacagcgatggatgccgaaacctgtgatgacagcgtggttgaatcgacgatcatgggcgaaggtctcgcggccagcgctgatcatttaatcaactccgacgatgtacggtatgttattgattcactagcgaacgacactattgttccatattcactcgaacagaccgatgacaaggaagacagctagaattattgtatctgtctctatggaaatggcaaaactaatgttccctgagtatgtgagagagtatgcacattttctaatttgttcaagatcagttctttattttcaaattgttccatcctctattttttaagttcggttaaatgcaagttctttttgttaaagataaaatgaaatcaaacatgaatactccatttttttagttgttggacaaagcacagttacaagagtaaaatcctaagctatgcattgatgaaatccaatgcatcaagatagatttgcttatcacattgcaaccttattggcagcagaccattactttccaatgttcccttcttcagatgtgggatggcataatgttgccctccttttgcacgcataatctctctcacgcaaccctgttgtgtgagaaacacacgattgatagactnctgtnccatctgatagtgcatngcaatcaaaccctg

SEQ ID NO: 69993 - DNA, 784 bp, Oryza sativa
ttaatataaaaaatagggaacttactttattcaattgttgtacaaaaaacaaagaaagaaaagaaccaatacatgtgttgggatgttcactacctagcacttgcttctgatatagcaatgaaagacatgcattgtggttacataacactgatggtcttatgagagtaggttccagctgctagtagttaaggggacacagttacatttaaaggaatatgggcacgtggaaagagagaatttgaaaattgaggcaggggattgctgaggcacccattctaggaacaattatgtgggtcaatcaagtcggtcagctaatgtaatataatccttctgacatcactttgttcgtcagtttcacaaaaactgcctggtttgactttcctcattctgaagtgaaggcaaccagatcaagcagataaagtcactttgtttttgatgaggacatcaacaccctcggtacatccacatctccacaagtccaacttcatagtcctattacccgtgctcgtgcacgtcaagtcaactatcaggtgagttcattcttgagtccatgttcatcatctttataccccagagacacgtgcactcttgttttactcaggaacaatggagaggatccagaggggagaggattcgcgcaggctggattcggactgcaggacagcaccaacttttgacgatcgccacgacttcatacgaactccgatttggcgtgcaagtacttcatcgaaaacttatcaagtctatttcaaatggatccggcctcatgtcaaagatggtctgg

SEQ ID NO: 69994 - DNA, 760 bp, Oryza sativa
cggcccggtgacgcgacgcgcgacgccaggaataacgggtcctgctgccggtacagggggcgcgccgagagggagaggggacgtggcccggcggcggcggcggcggcggcgaagaggggaggaaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggtaggggggaggtgttggggggaggaaggtatttatagggagcgcgcgaagaagaagggaggcggttttgtgcatgtatgtcgccagccatggcatctttctcaccgtagtgaggtttttgatttttgctgcctctgaattattgcctttcttttttcttcttaaaatgtgcatttctttcttttttatatacagtttgtccgctgtgtcgtttttcgatattacaattatttgcgattaatttatggtcatgttttatacataatgctcggttaattgtatataatgcactatcgatccaccatgcacgattaaattcagctataaccatattgggaggacataaatactatgcattatgttaagaaaaggctagtgcttccatgatttgtgcctgctaagggcttgttcggatcacaggataggaaaaagcataggaatagaacggggatccactagt

SEQ ID NO: 69995 - DNA, 521 bp, Oryza sativa
tagttacgtcctctggaatcgctaatcgagttaaatggagtcgcgcgctagcggcgcgtacgcgcgcgttagctttccgaatctggcctggtgtatggagtcccgaacaggcccataaattggcgttcggagcccaaaacctctcgcatttccagcccatcaagtcgcttcgtcctgggcttagcccaccacgtctctttctcagtttctcggcccgtccgccgttggttggctgcttccgctctcctccaatccaaggctccccgcgtccccgcccttctcctcccgcgccgccgttcgcgcgcgagaaaacgaggcggcggcgatatcggatggatgatgccactgccctctctctctctctctctcgccttcgcgcgcgcgtgctaactcacagcattggtaagtgcgaggtgatggtgccattgctgctcgtgcgggatgcggtctcgtggtcacgaggttccctatgatgcccgcgacgtgttcgacggtttgcgcgagcgagggaggcgcggcgg

SEQ ID NO: 69996 - DNA, 1822 bp, Oryza sativa
caccgcggacttgctttagctcctcacctgagagtgtcagaatggaccgcccaatgatggtgttgatcgcctttgtctgggtgaaaatgaggtcctggttgctgaatacaaagtgattggccgccgggccagccataagcaccgtcggtgagccaaaaagtgacatcttgaacacagggccatacttcttgatcctgtcctggtaccactggtaatcagtattactgcggagggcacgaagaagggagatgctctggccaatcactgggaagccaagggaacctggagggagattataggatgagtacttgcgcctgatgacaaagtggaggaggatgggtatgagcaaggcaagcagcagagcaaaaggcatggatgaatccattgatggagtatgttgttatgcactatgaaggttggctgatcagtttgtggatttgtatacatgtatatatgtaggcaaaccagagttgttttctttctccatgatagacaagggtgtatggttgaacaaatttgatattttctcccgaactcagtaaaaggcctagttggtgaagctgaatatatcactttctcaaaagtcatacaacaaacaagcaaagattacaaattgagataaggggacagaaagatcattgtcaccagagtaatgagtctgattcatgataataacttaaaatattagtttataagtaaacaattctattacgccacatgataggagcagcttagcacgacatatgtgaataactggaaataaatggaagccacagctcaaagaatcacatttatgctagccaatataatttctagatttatgctagttaaagaatcgcagttcctcctcaaatgaaagacacaaaaacgaattccctaaaaaaactaagggaagaacatagacacaagcaaataaagagatgaactgaatattcctttggatctaatattagtttgaggaaagatgctacatacagcagcattaaattttgcaaagcaagcaaagcaaaccattgaaaagatctggtgacaacaatttggtcatccctaaggaaacgatccatgtcctatcctatgtaataagaaattttgaacaatattctagatttaattcttctgcataactgcaggactctcgatcaacaagtatagttttagccttagcacaggccatgtatgcaggacagccctttttttttggcatattattatgcagaatatttgccaggaaaaacaggtagacatttcaaaaattagaagcaaattacatacttagtggtcagaaaagtttagctccagttctatatatgtgcctgtgcacaaaatgacacatttaccgtagccgcagttcttctgaaaatggcatggccctgcaatatagattacagaacagtacttcacaatatatctagggtgtgttcagttcttgaaaaaagttggaagtttggaaaaaaagttaaaagtttacgtgtgtaggaaagttttggatgtgatgtgatgtgattgaaagttagaagtttggggtagttgggggtgaactaaacacaactctataagcagacgattcctcccaaatatagcatggccgtttatttaataacgtaggcaaaatcaatgcattatcaggatacaccacaatgacctcgagggccacttagatcctgaaaaactgggcaaaaaaaggaaaggaaaacgacaggtcggataacatattctgaaaatccacatagtcaacttctaagaacaaaaaatgtacacagacagatggacttcgaagggatagactctacccaatatagattcggagatcacatcatgaatg

SEQ ID NO: 69997 - DNA, 530 bp, Oryza sativa
atatatatatatggtttcatacatttccactaaataagttaggtacggcattgttatttctccgaaataggctctttcaaaatagagcaattttacggtccttaagaagtaccatgatgtaccacttttttctattgtaaatttggtacctcttgatatctatgtactattaggtaccaaattttacactgaatttttttttgtaccttatggtacctcctgaaggaccgtagaattgctcatggtcctcattgctcccatgttacctatttaaagaaagttaatttttgttagaaaaataagttattctaacccaaacatggaataaactttacagttcatatttttttccaaaaaaaatacatgtgaaaatattcaaacttgggtaaaataaaaccaaaccaaatataccattagaactgtagttaaataaacttaaattacaaattaagcaccatggttttaggcttgacattgtgtagttcttggtgaatgaaaatctacaaacctttcaagctccctgaaataca

SEQ ID NO: 69998 - DNA, 687 bp, Oryza sativa
  unsure (1)..(687): unsure at all n locations
agctctctcgnacccttgatacgtaagcatagggaaaactgtgtctagagattagagatctagaaaaatgttttgctaatatattttccttttaagaagcccagtactatttggaaagcattatcagttatttcgtccatgtacataacnatctgtgcaaggcttgccaactatgttatcaatgttatcagtgtgttattttcttattttgtattatcaagcacagttctctttccttcctatgtcatggatttctatgcatcctgagggaatgaagccgtgccaattctgtttttatgtttactgctgtcctagatgttctacctttgtaaccttcctgtgcttcatcattgtcatcagtccattcactattgcaggaatccaaactcaacccttgtgctagggtcttctctccttcgtttgcaagttccagaccagtacttgcagctgcaccctctgttaacccaatctacatctcaaactctgtagctggagttccaaccgggttacctgtatttgaaactaactcagtgccaggcggttcatccctgtccagcaaggctgttcattataataacctggctgctgcaaactatgctatttcacctcaatatactcagtcagtaagttctttgattaattcttttataatatcattgttgcttcaatagttcatcactttcttca

SEQ ID NO: 69999 - DNA, 661 bp, Oryza sativa
tattaagtgctaaatcgtattttagttgataatattaaaaaaaaatctccatacaatttcaagaaacgaaggctgcagcttgggataatcaaattacataaagggaatccaggcacggagaaaatgagtacaacattgtatcggtctttagctctgttttctttagatagtgtttcgcttggagagcgagcaaagaaaagaacgaaaatatgatccgcagaaaggctgaagacagcattggcacccaaatacaagctcaatgcttcatgtgctcacaaaatcaataacctttttttaaccttctgttgcatctacaaatccccaaatcaagcatgtatatcacgcacacaccaatctatacaacaatcagcacagcgcgtatgcacaaaactacacccattgtcaccgtgtgtgcgttaactaaccgtgaacttagctcatcttcttcttcccggtgttcacaggctcgagcggcttctgcgagtccgggaggctgtcggcgtacagcgagtgcaccatcttcacatactcgtcgatcctcttcttcacccacccgtccgtttcgatcggcggcagcaccttcacggtgagcggcgccgggctgacccgcaagctgtttttcttcacgccaggtgcgtgccggtcaccaccatcgcacgat

SEQ ID NO: 70000 - DNA, 606 bp, Oryza sativa
cgcggcggcgaagagggtgatgctcttcgcgccgccgccgccgagcccggacctgcccgtcgaggtggccatggagttcctcggctcgccggacatggtggtcgccgctcactaggagggcggatcgtgatgtatttgctgcgatagacctgtagatttggggatctagctctcccttgtttcgatagttttgtggtttatgattttttttttccttgtttggttgtactgatatgtgaaaacaaagacaaaaaagaatacttatgctttgatttgctaaaaaaatacgaaagtgacagaaaagagttgcaatatgactggatgctcttactgtgatctattgaatgctctgtgaattgaagctattttgttcttgatttttctatgggtatagcatgttgtatttttcattgccgtgtgaaagtaaagaggagctggtattacttcagaaattgaaagctatttgtctacagtaagtaaatttgtttggcaactaccctcttatctgacataaatcttagtatgctttcttggttgtaactgctagtaaccaaaatcattagtcagagctgccttcgaattaactttggtcatgtttttctctta

SEQ ID NO: 70001 - DNA, 10042 bp, Oryza sativa
tcatgctcaaatggtcatttgagatctgtgtgacttgccttgctggccttggaactcttcaaagtcttctcctgcaaaatcggactctccgggaacgtcggaatctaagcagaaaagagcaaaatcaccaaaacagcacataaacaatcatgaacagtacatgtggatatttttaacatgtagatctcaattttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggatttattgcttcagcggctcgggtttacggtggaccgggtgcacaggaatggtctacggaatggacggctgagatctaatcctatccaaaacggatggccgagatcaacttgatctaccgcggtctacggctgacgtcgacgatgacatcggcgatgacgtcaccaccgggggcggctcggccacgcacgctcgccggcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgacgacgacggcggtgctccggtgatcttcgacggaaacagaggggtggacgaggacggtgacgacttggcgaacctgacggtggccttcccgagcgacgacgacgacctaagcgacggtatgatccttttgcttcaatgccctgaactcacgcttcttcaaagcaacaactcctacaggtatgtgtgtcttcttgaatgcctcagtgaactccgcccaagtgattggttgtccttctgctctgttcacccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttagtagtactagaaaaggtaggtggcctcacacgaagaaaatcagctagcttgttctgcggcggtggagcattgttgtttccttggttgagctggttctgcatctgctgtatcatcatgttcattaattgagtctgttgagccagaacttgagcaagagttgggttatcttcattgttattatttccacttccactggtgcgagtgttcaccatctgttgcatattagagaagatagaaggagaggggttacactaaagacaagaccttaaccaggttaacactgatctgatgtgtgtagaccattatattgttcaggttgattaagcaagcaacctagtacagttacacactcatcaatgaactactccaatgatgggaatgcaaccatacctacacacaaagcaaacaaacgttctaccctactaactattcttcaaagacactttggcggcataggtttctaaggtaggatccaaacttcattccatcttgaccacttggcacttcggtccttcctcgatccacttgactgacctccataagtagacctcattggcgtcttcaagtttcaacaactagtttcagaactactcaagttgaaagcaggaggggagaggatgataaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcatgaaatcctcgtccaggaatcagccgaggtacacaaattgacaatttaatatacagattcatcaaattaactaaaacgataaatacttacttaagaggcactaagtcctcaccaagaagaaaactgcagcggaaaataaaatctagcgaagctccggctacactcccacaggcagctcaactggggtataagccaaacgtcttctccttctggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagaggaataaaatagtggagtagttaatcagaaattttaatcaacactgaacagcacacccatgctgcacaggcccaaccatcctgaacaaccatacccggctgtacagatcaaatctccaaaccaggagctaagcaaattattaccagtataacatcattaattattgtgagaggtgtgagactaatcacgaaaaacattgctcaactcgcccataaccgcgggcacgactattcgaatagttttactctggccagaggtgtaccactgtatccacaagacacagcctcaacatcatgtctaccatgcgtcgcgatactggaaagtacccgaatagaagctgtgacaataccctctgcacaacacaactcacgacagtgcaccattcctggatcataatcacccccttataaaacaaggcatggactccccagcgacccctgtgggcttatctccgccacttctcagtctggtgctccgcaatgaatcatgctatacaaaaggtaaagctgttgcccacgctggcttgtggttggcacgattaatgtttcacaatagtagctcgcgaaccggtccttaattgtcatgagcacgactctcaaaaccatgtactcacaacccaccattatcaagttttagttggcaagtaattaattaaccaatcacgattgaccatcgtgaactatcattaagccatcataataatgagtcataagttatcccaatagtgtgctaatgtttctaagcatggctaagcaatcatatctaatatctagctgaactaatatatatagctcaactagttaagttataatatcccaaggtatcaaggaatagagtaatcaatgcaaacaggccataacaaaggaatagattcacaccacccaatgacattcgaaaataaatacacagttgaaataaatagagaatttaaatataggatcaacatgctcaaaggattgtgtttaggatctgtgtgacttgccttgcaataatcggtcttcaattaatcttcttgaatacttccggcgcactcgcgaacctttgcaatgacggaaacgacaagctaacacgcaaaacgaagaaaaagactaataaaaaccaaataaacaatacatataaagtaaacaaacatgtagattataattttagatgaattatgagacttgaacggcctcattctgacttcaaatgaatttattatgaattttacaagattaaatctatttaaagcccatttaaaaagaattaaataaatttaattcaatttatggaaaattttaatatgtagatctttattttacacaatttttgcaacttgaaccacattaaactgagttcaaatgaattagttatgaatttttaaagattaaatcggattaaaacacttatatggattttaattgaattatgacgcaataatgaattatttttgaaaaggaaaaagggtttattgcgtcagcgctagggtttgcggtggaccgggcgcacggcaacggtccacgggaacggacggccgagatcaaccctatccaaaacggacggccgagatcgatcctatccaaaacggatggccgagatcgaacggtccacgacgggtctacggcagacggccacgatgacgtcagcgacaacgtcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaagaagcggcggaggaacaacggacagcgccggcgacaaggaagaagcggcggcggagatcgggtcgacggtggtgacggtgctccggcggtcttcggcagcggcgaaggggcggacgaggacggcgacgcgacggcgaccacgatggtgacctccccgagcgacgacgacgactggagtgacggcggcacacggctggagcggcggcgacaacggcggcacgaggcggcacggcgctagggcgctacaagcgacgagaggcgaaggcgagggtggcggcggttagaggagagctcgggggtccttttaaaggggctagcgagcggcggcggaggcccacggcgaccggcggcgagaaggaaagattaaggttagaggagagagatcgatccgaatcaaactcgaatccacggatttccaaaccgaattagctcatgattccataagagaaaagatagaggagatctcaaggatcatttgccctcaatcaatttcacccgatcgggaaagacgcggccgaatttggaaggagacggcggcacggctcggctagggttcgggcggcggcggcggcgcgaggaaaacgaacctgacaggtgggacccacctgtcagcggccgagagagaggaggaaggggcgcggcggactaggccgactgggccggggagggagagagaaagagagaggttttgggccgactttcggcccaaagccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttagacttttaaaatcatttctaataattccttttaaacaacaatttataatttaaggatttttaaacaagaaaaactcttaacaattataattagatcattatttatcaaataattactgaactgttctttgtatcatttaggaattgagctccgaaagatccgagaatatttcagagagtgtaattaaccatggagaatttaataaaaaaattaaatccattcatgctttatatttaggaaattttatttcccacatttaacttcacttgtaaattaaagatcatttaatataaattctattattagtttattaaataatttataaatcctgaaacaaaaatcaggatgtgacagaggcccacggcggccggcggcgagaaggaaagattagggttagagggagaaaattgaatccgaatcgagctcgaatccgacgatttccaaacgaaattagcgagagattccaaaagacaaaaggaagaggggatcccggggatcatttcccctctattaatttgatcggatcgggaaaggggcgggcgaatttggaaggggcggcggcggctagggctcggctgcggcggcgcgaggaggaagacgactctgacaggtgggccccacctgtccgcaggagggagagggggagagcggcggctcggctcggcgggctggatgggcctggcgctagcaggccggggtgagagagaggggttttgggccgactttcggcccaaagccaaaagaggatttttaaaacctttttcaatttaaattattcgtgaaatgcaattctatttattaaaaatacttccttggctcaaataaatcctagaaaaatctaggaactatagaatcaaatgaagtatttaataaaattttatctagcccactttcatattggaatttattatttaaaattagatcttttcttctaggcttttaaaatcatttctaataattccaattaaacaacaatttataaatttggggtttttagggtgtgacatgtatcctttctgaagcaaatcatctacttgcctcttgacctctgctagttcattggctgccattctataaggtctcttatggatcggagtttttcttggtaccagatctattctgaattctatatctctcttgggcggcataccaggtaaatcatccgggaacacatccgggtagtcctgtactatgggaatctcttccaaacttacttggttcagacttgaccttaaaggctcagaaggcaatgcgtaaacagttacaacttgaccgtcattgctggtgagagttacttttctattggcacagtctatcacacctttatatcgggctaaccagtccatccctaggatgacatcaaggtctttggattctaatagaataaggttggccagaaatggtactccttgaatctctattctgacggaggggctacgttgtgacgagagtgcttggttgctgggggtactaaccatcaacggacgtctaagatcttctacctccatcccgtgatttctcgcaaaactcatagacaaaaatgaatgtgtagcaccagaatcgaaaagcactgttgcaggaactgagttaacaaggaacgtacccaaaatcacatctggagcaccttgggcttctgcagcagcaacatgattgacacgagccttggacactggtgcggtggagttgttctgtgcagggacaaccttcacgcgccggggcttcggacacttgtcagaataatgacctggttccccacagttgaagcacactcttggcttgtttcccggctccctcttggcaggctgatgctgggctagagttgcaacaggacgtggagcttggttgcggttgttgttgccagaattgttgttgaagaactgacgctgtggacgggcaaccaacgaagatcctccctgtgacactgcctgaggtcccatagcaagacacggcctctgactattcccctgctgagctttgaagtgagcaatcctgcgtttcttctgctccattcggttgtacttgtcctcctggcgaatggccatatccaccaacttctggaaatcatgataatccccagtcattaatgggtaagagagctcatcattcagtccttccaagaacttctcttgacgctcttcatctgtacgtacatcttctggagcatagcgagctagacgattaaattcatgcaagtattcagtgacagagcgagatccctgagtgagcgtcctgaactccttcttcttgggagacaccactcccgacggtatgtgagttttccgcaaagcagcagtgaactcaagccaagtgattggttccgcagtggtcctgttgagacggaagtgatcccaccactcagaggcagggccatgaagctgatgtgaagcgaaggagactttttcttgattagtgcactgaagcaggtccaatttcttttctatggcgtgcagccaatcactagcctcaactggattggtagtgctagaaaaagtgggcggcctcacacgaagaaattctgctaacttgttctggggaggtgcatggttgttcccctggttctgctggttctggaattgctgcatcatcatgttcatgagctgtgcctgttggaccaggacttgggcaagcgtgggattctctccattgttgttgttgttgttgttgttgttgtttgggccattcccattgctgtgagtaagcaccatttggcataggcaggagcacaagaagagaaacaaggaggaaaaaactacttaggacagggaattgatttttattaacttgacttttattgatcttaactgagtttcattattacacaaaactgaagactctcacacaacttaacttaaactccctaacactcgaaagcaaacaaacgcatgcatttacatcccaacaatgatgtaaaccacatgcaagacccacacacgcaaccaaacttaaacaagcaaactaacacaatgatctagggcaacgacttaacaaggcgttctagatcttccgggcatcggaattgattgaaggctcgttcggcttgcccccatcatcttgagtagctccccactcgacctttgaatgggtgcgcttcgattcttctccatcatcatcacttacgttaacgaccgaaggattcgctgagactgggacaacttcttcttcttccaccacacgaaccttaggcgccaactggtagcgagggacaaatagagctctcttccttgtggtaagacgaaccctggccttttgtggtggtgcttctcccttcaacgcggctagttccttctccaaacgatcaactttgtcctcaagcttacatatcttaccacgattccggtcttcacgatcttgagcagctaacacaatctcagcgcggaactcatccatggcccacagcatctcaaccaaatgccttgtggtagcatcattctcaattcctgcaggttcaaggtagctgccacggtcacttccctggggttggcgaggatggtagcgatactcagtgtcggccaactgatcactgtagcaatcgcgaagctctcctatggcgatccttgccacctcctgacaagcatgaatgtagtttccccctccagcctcgaacatcagcgatgggatgtcttcatgattagtgttcaaggtgaccttgacacggcacttctcttcatcacggtcatgaggaatctgggcatacaaaggggcagtcccaaatcctatggcgaaggacatcgtacgcaactcctggacaaatccctcagtaccgaacaagtactcaggcttgaagcgcggcatctaaagacaagtgaaaggagggagttaagacatttatccaattaatagcacaagtttttggattaatttgaataaagttagaaaatcaaagtaaaaggtaaataaataaagtaaaccaatcttgcaagataagttgaaacagttgaaaacagaatcacaaattttgcacttttgaataacaggtttcaaaagaaataaaataaaagagagttataaaatcaacatgctaaattatattgcaacatgattgaataaataaataaataaatgaaaggttgtaaaatctctgctagaaagtgggccattagtatagtaatagatgtacagtactaacaacacaggaataataaataaattttgaatgagaacaattaaagggactataaactgcatgtgccattagcttggtttaattaaaagagaaagagaggagaacagttctactttttcaatctttttagagggcttctataggtatccatttggcataacctagggtcaatgtggctctgataccaacttatgacgcccggaatttctatccaaaattccaaacgcttacatgtgtgtaaaccctcgtccaggaatcagccgaggcacacaataacaaattgataatagagtgcaataattactctaataaataagcgaatagaaagtcattacagaggtagatagttcctctcaaacaataaaattaggaaaataagataaacggcgcaggcgactccattccacaagcagcttgaccagggctacgcctaatcctccacaccttcagcatcactgtagaactcctatgatgaatgattgcaaggtgagtatatgacatactcaacaagccacgcagcaaatatgcaaatgcaaggcataacaaaggatggtataatatagtctcatttgcataaatggcatttaataaatacttcagaatttaataaaacagtaaagtatttaattaaacaatattaatccatcgctatacaacatacccgttgcataggcccaaccatcctgaacaaccattcccggctgcacagttctatctccaaaccaggaatataccattccaaaccaggagctaaacaagttattaccaattacagcatcatttattacggtgagaggtatgagactaatcacaaaagacattgttagacccgcccaaaaccgcgggcacggctattcgaatagttttactctggccagaggtgtaccactgtacccacaagacacaacctcaacatcatgtcaaccatgcgtcgcgatacttaacaagtacccgaatagagatggtgacaataccctctgcataacacaattcaaagcagtgcaccgt

SEQ ID NO: 70002 - DNA, 6457 bp, Oryza sativa
ttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaataaatttagtatgttgattttataactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcagagtcaccttgaacagcaatagtgaagaggtcccctcagtgatgtttgaagctggaggaagaaactacatccatgcatgtcaggaggtggcaaggatcgccataggagagctccgtgatcgctacagtgatcaattggccgacactgagtatcgctaccatcctcgccaacctcagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgctccagctcaagcggatcctccggtcatcatcataagtagtgatgaagaagaagaatctaagcgcaacaattccaagattgagtgggtagcaactcaagatgatgaagacgagccttcaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaagggaataatcatgcacctccccaaaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgtgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctacgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaggatatacctaagacaacttttaccactaggtatgggttgtttgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaagaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgcattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcatcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcgatagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcaaaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtcttcagatggctccttacgaagcactgtatggtcggaagtgtcgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctagttttaattaataaattccaatataaaatgggcccagataaaatttcattaaatactttgcttaattctataattcctagatttttctgggatttatttgagctaagaaagtatttgtaataaatggaattgcatttaagaaataatttaaattgaaaaaggttttaaaaagtcttcttttggctttgggccg

SEQ ID NO: 70003 - DNA, 17036 bp, Oryza sativa
  unsure (1)..(17036): unsure at all n locations
tttttcgtgattagtctcacactacccattaatggtaataatgtggtaattaatttgatgcctagtttggaatggataattcctggtttggaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaagttggtatcagagccaccttgaccttaggataagccaaatggtaaaccttaagtagccttcaaaatattttgaaaatagaactgctcttctctattctcttataaattaattaagttggcaacacatgcaaggttatgcacaaaatttatttaattcaacttcttttcttttaatagcaaaaagttgttcttctcaaaatatttcttttttcttattgattagtcggcactgtacatctattatggtatcgacataatcatggtagcactagtactactcatctttcttgtggtgacactgtaccgtgcttaaaatagatcataagtattttagttttgttttagttatttgtcaaaaaaaatatatttgtctctatctaaaaagttaaattctaaaaatatttataaaatagctttttatgtgtcttttcttttattttcttcctttttggtcaaaaatcagttaagtctagttggtgcagctaacttagaaaaaatatgcattaattcttctcttccatgtttctttagatgccgccccattcaccgagaaatttgatcgaggtgttaggattcgtcagggagctgaggttgatggcttttgaggtaggttatgaagttgctcctgagtatcgccagatttcccatgaccccgacgaggagaagtgtcgtgttcgtgtgacgttggctagtgatagagaagaccttccgtctattaagttcgaagctggaggaagatcgtactgccatgcttgtcaagaagcagctttggtggccattggagagttgcgtcaacgttttgaagaagagttggattcatcagctttccagtatcatcctcacaagcctcatggtcaagactatggaacctatatctgtcctgatggtgaagagagtgccactctgatgcatgtggtgcatatgcttagtgctatggatgcagtaagtgtggagcgagacaaagcagctcatgacagggaaaactggaatcgaggcaagatttgcaagttggagagcaaggtgtaccgtctacagaaggaattagctgaactcaaaggagaaacgccgccgccaacacccaagcttcgcctcgtcgcaagaaagagaacctgtccgccacctcgtctccagttagcttcgaagattcgcgtgatgggtgaagctgtgcccgatcgtgctgaacctgtcatcgacatcataagtgatgaggaagaagaggaagaccctgaagaaagagagccagctactccagaggaagaagatccatcgcttcgttccgacgcaaggcgggattagtcgcttagttagatcgttgccgtagttcgctgtgttagattgcttgtttaagtttgtttgtgagtgtgtgggttttagttgttgcttacatcattggtgggatgtaacagcatgagtctagttcttttgcttgtcagagtgtaagatagttggtgagatagtgttaatgccacttaaatgtaatcatacacagttaagagcaatatagaatttaaattaattaagtaactccgttctaagggtgtctctctgtcgttctttcctgttgtctctgcttatcatcagatggtgaacacgcgcactggcaccggaagtggaagcggaagtggaagtggaagtggagctactaacaatggaggagatcccacgctagctcagattctggcccaacaaacacaactgatcaatctgttagtgcagcaggcacagaatcagcaggcaaacaatcagaatcagaatccacccccacctccccaaaacaagttggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcagttgcatggacctgctgctgaatggtgggatcattttcgccaaggcagggctgaaggagaacttatcacttggcaggagttcacgactgcttttaagaagacgcatataccgtcaggtgttgtagctctaaagaagagagaatttagagcactcaatcagggatctcgttcggtcaccgagtacctccatgatgtcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttactggacctcaagctccatcgtaccctcaaggaggatcttcatcagttgtccgtccccaacgccagttctacaataacaatactggtaatcgtggcaatgacaaccgcaacatggttgctcgtcctgcagcaactccagctcagaatcagcccgttaggaaggaacagggaagcaagccagtgatatgcttcaattgtggtgatccaggacattatgctgataagtgtcctaagcctcggcatgtgaagaacgctccagccccgaacaactccaatgttctagcaccgaaggcacgtgttaatcatgttgcagcagcagaagctcagaatgcaccagatgttgttttgggtacgtttcctgttaactctataccgcaactgtgctttttgattccggtgctacacattcctttttgtctaaaagttttgcgagcaaacatgggatggaagttgttagtcttgggagacctttactagttaataccccaggcaatcaagtattttcgacatagtattgtccttctgttactatagaaatagaagaagttcttttcccatcctcgcttatcttgctagaatccaaagatctagatgttatcttagggatggactggttatctcgtcacagaggagttatagattgtgccaaccgtaaggtgactttaaccagtagcaattgggaaaccgtttctttctttgtgtcctcccctaaatatcatggtgtgaacttaaaccaagttgctctacaagagattcctatagtacaagactacccagacgtgtttcccgaggatttgccaggtatgccacctaagagagacatagagtttcggatagacttggtgtcacaccctgaaaattcaaaatatataaattgttgtttaaatggaatttttagaaataattttaaaagtcttgaaaagaaaatctagttttaattaataaattccaatataaaatgggcccagataaaatttcattaaatactttgcttaattctataattcctagatttttctgggatttatttgagctaagaaagtatttgtaataaatggaattgcatttaagaaataatttaaattgaaaaaggttttaaaaagtcttcttttggctttgggccgaaagtcggcccaaaacctctcttctctctcctcggcccagctggcccagtcagccgcgcgcgcgccctcgctgtcgctgacaggtgggtcccgcttgtcggtcgtcgtcttcctcgggccgaaaccctagtttcgcgccgccgagctgccgtcgccgccgctttccaaatccggccgttcctttccttctccggccgatttgttagaggggaaatgatctccgggatctcctctaccttttctcctttggaatctttggttaaatcgctttggaaagctttggaatcgagttcgattcggatcggttttccctctctccaagccgcgagtttccttcgccgttgccgtcgccgtgggccttcgccgccgcctccgagcccctttaaaaggacccccggtgtctcctctacccgtcgccaccttcgccttcgcctctcgtcgtcggaaaagccctagcgccgtgtgccctagctttgccgtcgtcgccgtcgctccagccgtgcgccgccgtcgtttcagccgtcgccgtcgctcgggaagaccgccgtcgtgctcgccaagtcgtcgccgtcctcgtccgccccttcgccgtcgccggagatcaccggagcagcttcgccgccgtcgacccgaagagcttcgccgcttcctcctcgtcgccgtcgccgtccgttggtcttccgccgccgtttaggtcaccggtgagttcgccgtgttgtcctctacgtcttggtgccctccgtttgcgtcctagtgccgccgttcgccggcgagcgtgcgccgttcgagccgtcttctccgccgagccgccgccgctgtcggtgacgtcaccgctgacgtcatcggggtcgtccgccgtgagccgccgtggacccgatcgatctcggccgtccatcttggatcggttaaatctcggccgtccgttcgcgtgaaccgccgcccgtgcgcccggtccaccaaaccctagcccgctgacgcaataaatccccttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattctgtcgtttccggagagtccgttttcgcggaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatggccctttcgtacttgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgggcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccggggtggttgttcagaatggttgggcctatacaacagggtatgttgtatagcgttggcttaatattgtgtaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacacttggtacctggaaccaacccaatccataagagaccatacagaatggcagctaatgagttagctgaggtgaagaaacaggtggatgatttgcttcagaaaggatacatcagacccagtacttcgccatggggagcaccagttatctttgtggagaagaaagatcatactcagagaatgtgcgtggattatcgagcgttgaatgaggttactatcaagaataaatatcctctacccagaattgatgacctgtttgatcaactggaaggtgctacagttttctccaagatagatctccgttctggatatcatcaacttcgaatccgtgaggaagatataccgaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtctggaggagtggcagtagatccaagcaatgtggagtcagtattaagttggaagcaacccaagacggttacagaaattcgtagtttccttggacttgcatggtattaccgcaggtttattgagaacttttcaaagatcgctagaccaatgactcgtctacttcagaaggaagtgaagtacaagtggacggaggattgtgaacgaagtttccaggaactgaagaaaaggctagtgactgcgcctgtgttaattttgcctgattcgaggaaaggtttccaagtgtattgtgatgcatcccgacacggtttgggttgtgtgttgatgcaagaaggaaaggtggttgcctatgcatctaggcaattacgtcctcatgagaataactacccaacgcatgacctagaattggcagctgtggtgcatgcattgaagatttggcgtcattatcttttcggtaaccgtactgaggtatatacggatcataaaagtttgaagtacatttttactcaacctgatttgaacatgcgtcagcgaagatggttagagttaattaaagattatgatatggaaatccattatcacccggggaaagcaaatgttgtagccgatgcccttagcaggaaaagttactgtaatatgtcagaaggtcgacgtttaccttgggagttatgccaagaatttgaaaagttgaacttgggaataatcagtaaaggttttgtggctgctttagaagctaaacctactctgtttgatcaagtgagagaagctcaagtgaatgatcctgatatacaagaaattaaaaagaacatgagaagaggtaaagccatcggttttgtagaagatgagcagggaactgtgtggttaggagaaacaatttgcgtcccagaaaataaggagttgaagaatactatcatgaaggaagctcatgaaactttgtattccgttcaccctggaagcactaagatgtaccaagacttaaagcaacaattctggtgggccagtatgcgacgtgagatagcagaatatgtggctctatgtgatgtatgtcagcgggtcaaggcagaacatcagaaaccagccggtctgttacaaccgttgaagattccagagtggaagtgggaagaaataggaatggattttataaccggtctacccagaacgtcggcaggacatgattctatttgggtagtggttgatagattgactaaagtcgctcactttataccggttaaaacaacctatacgggacataagcttgcagagttatacatggccagagtggtatgtttgcatggtgttcctaagaagatagtgtcagatagaggtagccagtttacttcgaagttttggcagaaattacaattagaattgggtactcgtttgaatttcagtactgcttatcaccctcaaacagatggtcagacggaaagagtaaaccaaattttagaagatatgttgagagcctgtgttctagattttggtggaagttgggataagaatttgccgtacgcggaattctcatataacaacagttatcaagctagtttgcaaatggctccgtatgatgcattaaatggtcgaaagtgccgtacgccgctcctttgggatcaaaccggtgaacgtcaagtttttgggacagacatattgcgacaggcagaagaaaaagtaaagattatccaagagaggttgcgcgttgctcagtcgcgtcagaagagttatgccgacaatcgtcgcagagatttggctttcgaagaaggagattatgtatacctgcgggttacgccgttacgaggtgttcatcgtttccaaaccaaagggaaattggcaccgcgttttgtgggaccttttaagattgtgagtcgaagaggtgaagtagcttatcagttagagttgcctccgtcaatggcgggaatacacgacgtgttccatgtgtctcagctgaagaaatgtttacgtgtacctacagaggaagcagatcctgatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgattaaattaaaaatgcatattttaaatcatttttagaaattattttaaaagcctacaagctaaaccctaattttctaggaaaattttcaatataaaaatgagttagataaaattttattaaatactatgcttgctcctctattttctagaattttctgggaattatttgagcaagggaagtatttttaataattgaaacaacatttcacaaattgttttattcaaaaaagtttaaaaacccctccctaagccgttgggccgttttcggcccaacatcctctctctctcgcgcggccgaaccggccaatgccggcccaagccgacgccgcccgctcccctctctcgtggattccgacaggtggggcccacctgtcggatccatctcctacctccagccgccgaccgagcccgagccgccgccttccacctccaaattcgcctcaatccgactccgattccttcgggtttttgaggggttttgttcctctcgttctcctctttctttttccccaagaatcaaagagaatcgttgaggatttgatccgaatcgagttcgttttgattttatccctaaaaccgagttttaatcttttccgagccgattcctctcgtttggagttcgatctcttcaatccgagcttatataaagcttcccctcgtcgtcctcttccgtttgccccctctcccgagctctcccgtgccccgtagcgccgccgccacgtgcgccaagctcgccgccgccgccggccgtcttcggcgtcgtcgtcgcgccgtctccgccgtcgccgccgcttgccgtcgccgccgttaggtgcgccgtggtgagaggaatctcggccgcccgttccccttcgccgccgaccaccggagtcccctcgtcgccgtcaagccgagccgccgccgccatcctcctcgtcgccggccgccatcgttcgtcgtttgaagtcggggtgagtaccatcgggttcgtctcgatgtcctctacgcgtaggtgccctccaatcacccggccgaccgccctagctccggcgagctcgcaaaccctagccggccgccattgccgacgtcagcatgacgtcagcatgacgtcatcatctccttttctttttctttttcccgattttctaatagattaaaacttcggaaaatcataactaaataaccgtatatccgtttcaggtggttcaagtttctaaatttttctaaaatcaagatctacatgttaaaaatattcacatgtgctgtttatgcttgtttttgtactgttttgttgattttgtttatttgctttagtttccgacgttccggaggagagtgtttccgttgaggaagtttctgacgcgtttgtggaagcccaaggcaagtcacacagatcccaaacgaccctttgagcatgttgatcatgtttaaagctattattttattttaactatgcattgttttcgaatgtcatcgggtggtgaacctttcccaattaattaatggccgaagatgactttattttcctatgggttataatttgattagcatgaaccttatatattggattggttcggctaaatgctatatgtaagtttgcttagccatgcttagaaacattagctaacaaaaggagttaaatataaattatattacataattgttattattaattagggttatattcaatggtagctcacgatggtaaatcgtgtgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgcccgactgagaagtggcgagaagtccatgggggtcgctggggagtccatgccttgttttaaagggggtgattatgatccaggaaaggagcactgtaatgggttatgttgtgcgaggggtattgtcacgactcctttccgaggtaccgtggtggtactgaggcacatggtgacatgatgtggggttgtgtcttgtgggtacagtggtacacctctgatcagagtttaatctattcgaatagccgtacccgcggttatgggtgagttgagcaatatttttcgtgattagtctcacaccacccattaatggtaataatgtggtaattaatttgattcctggtttggaatggataattcctggtttcgaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaaatattgttatttaacttttaatcgggtaatatctatcattggaaggcagccgattaggctaaataccaacgttgacctagattatataggatatccaccaccctatgaaacattcaacggcttgattgtctagatattatccttcttttcatacttatagctgcattagttgagtttgaccttataagtcgtgattagaatctcaatctctagcctactttttggttgccgattagggtagtatcggagtttcagccgatcttacctgatttaactcttttatatcttatgtgcttgattgacatgttaaatccgctctttatgttaagatcttgtcacaattaggtatattaagcttcctgtttgatatattttgcttgctttaatatcttaatatagaatagtataggagtattagccgatgcatgctggatctatttgatcggctatgccataaacgtctataatcttcttgttaatatatatatcgatgtaagtgatttatactgtctcgatcacttgatttaagtatatatcgacggaagtattatataccattgatattgatgtgaccatggctactacggacacaaccattgctcacatcatggatgaacagcacgatattaagttcaagtcctccaagtgctggaatccaattcggccaccagctacactgctgttttcaaatggccgccgaatctgcatacgaccttcgtttttggcccgtgagtacttgatggaaagctcttggagccttctttccaacggatctagcctcatcgccagattccatgtcgtttggccgcaatcacataaacaaggtgctgcgtcacctgtcttgtgcctctgggcttgtaactttgtttgggacccctacccaagtggggcccatgtggggtgcgccccaaccaggtggaggacgacccttggcaccccttagtcgtcctcccacccctataaataggtaggtaccccttcagggtttcttgggttttgtttggatgaaagtttagccattgctacttccttgcagcgcgcgtgtcggctagactgtccgtctgcttgtatttgaaaccccaacttatcattcgtattcaactcctatttgcatttcagattgcttttatcttgttcttgcttgtttcttcgatttgcttgcaggaataaggttgatttgcaccggcaacatcaacaacccacggaaaggtgtatcgatcgctaaggcgcaacgcaacgtcttgtatggttgtagtcgggtcgtcgacgtttctcccaaatcgtagttatcatcaactcaccgaaagatcgggccaacaacagccgtgagtgtcgagaggaactcagggttcatcagatatctacagccggtcgaatagatttagttctttcttgcctatttatgactgctgatcaattcaaatatgacatcggctcaaagataaatgatatgtcatcggcggctggccgatcggctatcgtttatggatttaaccactatttttctatcattatttcttgttgattgcaggatcaaatcaactggcacgctgacgaacctaaaggtaagatttttggacctgcactgaagttaagcagatcttccaggccagtgtgtatttttcgtatcaacagtcctggacttgttctggttggtagccatgtcgcaaacgtcgcactcagtcaaaacgagagttatcctctcaccagaagatcgggccacgagagagagcgtcatcagttggtatcagagcttcggtagcatggtgaggatttttttttatagatttattttccatacctatcaatatacaaaattaccgcaccacttttccctttaccaaacataggtttgtgatttgcaaatttcattcagttttgtgtctttgaatgctggtccgttgtcgtctctagtgctggcttcgtttagttcttagttgtggtttgagttttgcttttgattgcatgcagatcgggtcccgtttatcttggtagcatattatttgttctaatcagattgtgtcgtcgtccttgttcctgtcgcttgcacttaagcccagaaaaatagaagatctgtggtttccttctgatcggtggatttgtttctgaaattacgaggttgttgcacgaccgtttccctctggccgcgatctcctgtactgcttgctattttactggacaagcatgtatatctcttgatttatttggttgatctactcgattgtctatgcatgcaacaaatccttgttttcctctccagatctgcatgcatatccactgccgactgcctacatgcatgcacgatatttcctctatccattgccactgataacttctaggaattaaattctatgcgctgcaccagctccactggttttttgagttttagtcttgtttcacgtacagccgccgtttgacgggctgccataaggaactcggcactcaggtgtggcttgtcgaagtaccaggaggacatcggctatagggtattagctagtgtattagttaacaagaatgtatgtatgtatattagaagtatagaaatagatttccttttctaatttctttccacttagcttagataatatattctcagtagctgatgcttgtttatcagtctacatgattttcccatgggataaaataaatacaatacccttggaatactctcgagtgaaatgctacaatggtatatccgtgcgcttgtggatgaactctgtaaccataatataccagaagtatttctgtgccattgctgggaattatatttctagtaatgtcgttaagaaataccaacaaacatttctggcgccattgccgaggaagattcgtaatagagattacctgaactaatagcaggataaccttggttgttttcgcttttattgtgaaaacagggtagtgcatgactggtttcaacttgtcggaaaacttcaaagaaaatccaaaagctttcgtccgaagcgtcagaccgcgagtcgttgctctgcagaaaactctacgacatagaaaccagtcgtaccagcaccaccaactttcaggactatggctgacaagacccttcacgagttcgctgctccctctactgacaatgtggccattgggccgcagatcaacatgggagacgtggatttcgacttgaagtccaatctcatcacgatggcgcaggctagcccattctatggcaagcctaacgaggatgcctgttggtatttcttacgaccacagataaatccgcaagcgcacggaatactgctgtagcacttcactttcgggtgaccccaaaaggatatcgaactcagggaatgtgtgtaatctacctaaggctaagacgatctaaggacaacaaccgatggtcggcaggcttgagaggactttctatgtggcttaactatctaagctaagcaaaggtaatttcctatctgttgcatcaggcaccgacccctgctggtctgccagcgtggtttcggctatagctctatgatgcatccgaacgtggagattactaggacgggattcagggctgtcaccacctgccgtctacctctgacaaatccatgggatacacaacaaacaaaggtaatctctaacctagacaccacgcctaagttattaattactactctaatacttgcgcaggaacttccttatttatctagagtcctagtactagagcacttagtataaatactaaacaatgaacccgcaaagatggaaatctatcttactcaaagaaagtaattaaataacataagaaaggaacacgaatgcttactttatagaagaagttctccgaccccagagcagagtgtatcaaaagctccggtactcctccagaattcctcctacgaagctacactcatcgaggtagaagtcagataagtgccaaacttccgggcactcctccaaagctccccctcactctctaccttattctaatgtataaaagatacaatagagtctcttgtaattcagctcaaagttgtgtgtattggaatgagatgaagatctccttatataggctccaaatgacggttaggggtatgggaaatggccaaaacaccctgcaactgccataggggagaaatccaaaccgtccacatgaagccagatggcgggaggcgccaggattggttcggncnnnntnnnnnnnnnnncnnnnnnnnnannnnnnnntnncgnntntnntttnnncnnnnngttnnttattgggtcccttccatnttgcccatggttttgcccaatccttcagggctttggttgacatatgggccctccaatccgtgttaatgcgtcttgaatgcgcagaggtgcattttgtcgcatgacggatgtgttttctcctcaaaatacctgcatacacatatttcaccaacactagtggaaatgattagtaataatacctaccactaagttggataccatgttttattccattatatgtaggcattgacggtcaaatattatgatttaaggaccgtcaacagggtactcctaatgggcggt

SEQ ID NO: 70004 - DNA, 6424 bp, Oryza sativa
ccctcccctttactactttacctccccttcttctcttactactacaccatataaatttgaattaaaattcaaatttttaatgtgtacgtaaactttttacttataaactttgggtctataaactaatatttgaattcaaattcaaattcaaattcaaatttgaaacgggtatgtaaacttttgacctataaactttgggtctataaactaatatttgaatttaaattcaaatttgaatcgggtatgtaaacttttgatttataaactttgggtctataaactttaggtgtataaactttagatgtatagaaatactatatatagaaaatatttaattcaaattcaaatttgaacggatataattcaaattcaaatttgaatcaggtatgtaaatttttgacttataaactttgggtctataaactttaggtgtataaactttagatgcataaaaatactatatatatattttaatatttgaattcaaattcaaatttgaatcccgatataattcaaattcaaatttgaatcgggcatgtaaacttttcacttataaacattgggtctataaacttcaggtctataaactttagatgtatagaaatcctatatataaaaaaatatttgaattcaaatttgaatttgaatcggatatataaacttttgacttataaacttttggtctctaaactttagatgtgtaaacctgaggtgtataaactttaggttcataaatttactaaaataggaaagtaatacggtgccaaaaaaggaaaccaggtggagggagggagggggaagggggatcgatcgctacccttgtcgccgggcgatcgatcgcccattagcacttccgccgtcaacaatgccaacattcatctgcaacagttcctggagatctgtagcacatataccatcaagggcgtcagtccagacgccgtcaggctaaggctgtttccattcttccttcttgggagagcgaagcagcggttctatgccaaccatgctgctgtcaacacatgggacaagtgctctacggcattcctctcgaaattcttcccgatgggcaaaaccaatgcccttcgtggaaggatttctagtttccagcagacaagggacaagtctattccggatgcatgggaacgactgcaggagtatgtggccacctgtcctcatcatgggatggacgattggctgatcctgtagaacttttacaatggactcaccccgatgtcccgcgatcacctggacacggtgtcacgccctgaagttttcccccctttgcttgctttaaaaattggctaaataaatcgtccgaagaaattatcttaattaacctagagctaattccttaattaataaatgcaattaataattgaattcggcgtggtggaatttttcttgagttccccatgctccaatgcattaacaggatttttagtggaattttcagagccttggaaataattttttaccaattaaaaatcaccaaagtgcaatttttaatcccaggaaaatccttttttctctttttcttttcttttccctcctttttctttgttgggccgtcggcccatccctctcccgcggtcccccctccttgtgggccggcccaagccgcccctccctcctctctctcgggacgccgacaggtgggccccacctgtcggtcgtctcccacctccggccgctagagccgaagctccaaccgcccatgtcgccgctgcctcctccgctcttcccgtgcccacgccgcgccgctcccgcgtcctccccacgtcgccgcctcttcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccgcgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgccccggcatcaccggtcgtcgccgccgttttcttccttcgcgccggccgtcgtgctcgccggtgaggaatcccctttcctccttcctttcctctcccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgccttgccatggccggccggcttgagccgtgccgagcatgccgccgcccactccttccccctagagccgctgccagtggggcccgcttgccagccgccccctctccctcccttagtgccgctgaccagtggggcccgcctgtcggcgccaccccctcccttccgctgacgtcagccctgggctttattgcgcaataaattgattaaggacttttctttattagtaaaaacgcagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtaggtttcggccgtttcgtcgatccgcggtttctcgaagacgttgctgaggtctcgtcagttcgagagcaaggcaagtcatgcaatacgtttgatcatattgtacccaatttacaaatatcccgcatttctattaaatgttgcatccttttacaatgtcatgtaggatgggtcctattcctcagccatttattgtttaccttatgccattgataacttaggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcaacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgttgagtacagtgggtagtactcagtcttgctctcttttcccccacaccagagctgaagatcttcctagttgaagctgttttgtcaaagttggtttcgtcgctgccgtcaaggattgcctgtggagtggagtcgctcgctgcttaagtcaagcttcccggtttatctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgactttgaccgtaagacaagccaactggaaaccctaagagccctctgaaccccttttttcatctgcatatgcctttttgcacctggaattgtttcgggaaaatttggagttttgcctctttggtttgcgggaaaaatcttggtcgttcattcggatcggattttttttttaaaaaaaaattattagctcagtctagggctttagaaaaattttagttggagtttattcgacagtcagtcgggaatttattgggggttatgcattaggtcgtgtctatattcgatgggggcaatgttatgcgcatcattttctatgcaactagtctatgcattaatttattgtttagttgcattagtgtctttatttgagttcatgaaaaatgttctatgcataaaaatcatcatgctcggttatttatttgagtcttcttttgcttggtttaatttggatttgagcatgaattggttcctatcccttgtctactttagatgtcggtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccccctgtttttcctccttttctcatatttctacctatccccttcagatggagataaggaatggttcacgcgactcgaacaacgccagtggcagcgaagagccgaacaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaagcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttctgtctggtcttgatgatgaattgactaaccagttgatctctagagattatgaggactttgagaagctggtggataaggctatccgtcaggaggagcacggtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtg

SEQ ID NO: 70005 - DNA, 664 bp, Oryza sativa
  unsure (1)..(664): unsure at all n locations
agtatgcctcactttttagattagcagatgaacaaccacatgcttatgccaaagattgaaaatagtgtctgaaagattcaatttcagtatgtatgtgccactgacatacatactaacaaggttcactgtcactgattaattactgcatgacctataacagattcaccatgctttggaacttcatcatcgtcgaactcttcgtgcactatatcaaccgccgaagaaataaattcttcgtcaccatccgatgaaaactcatccaatagcatttgaaggagggtgcttcgacgactcatctcctctttttgtttgccacggggttggagcgtttaccacagggatgaagtgcaatggagggaactgatggcaggaatagaacaataatcaatctgcaaaattaattatcagatcaaacttaatattttccaataatatatatccacatatcaaaatatagacatagagattgactacgacacaagagatcaatgggaattgctaacgattaccctcttgatgacacgaattgctacggcatcttcttggtgtttccgtttttaacaaatcgcagcagtcaggacactggttgacttgcttgtgatgaccgcgctaagtcacggccgcgcaagtcccgggaggaagaagtcnatcggcgcttgtgcgg

SEQ ID NO: 70006 - DNA, 620 bp, Oryza sativa
tgcttttgctgtttaattgatttagatcctcgatttacactgtgaacttgaattgcagcgctagaagcactatggatagttaaaatccatgactcaaatagttaaaatcttctgactcaaatatctgtttccccaaaatccatgactgtgttgatctatactgtctaatggtagtacaaaataactattcagtttaatttttctatatctgattacttcctaaacggctcggaaaagggctcggaagttctactagagaatatatgcgtgcatgatattggtgttttgtgcttcaacttgataagctaaaatcagccgcagtaccctggtcaagtttttcattgtttgcatattgtcgtccaggaagatgaggtggagaagcgtccagttacaggaattctaaccatcgaaagtgggctgacttcgatctcgaagattgttatggagatgaaatacctgtatgagaaacataagcagtgggattggaaggttaaacaggtggagcagaagaaatatttggtggaatttccatccaaagatgctaggagggagttaacaagactcaagggctttgactttgaattatccaatgctagagctaatgttagggagactgagag

SEQ ID NO: 70007 - DNA, 513 bp, Oryza sativa
tgtttttgaatcagtcaaccttctgtgcgatgtaattgaagtaatcaatgacatagtatcaaatgctagggtaaagtcagaacacgataattcaacaaaagtgacagtcaaaatagacggttttccaagattaagctgttctacttcagcagatgcatccattgtacatgaggttctacatggagacaaaatgcacgtcgataggtggataactctgagagaatatattcaagatgtagttcgtggagctatacctgatccgcaggttcttctcaagctactctcttctgctagtcagaagcatcaaaattattctcagaggtaacaaaagaaacatgcacagcttgagcctcctcgaaaggaaaggagacgtggagccacagatgaggatgctgatattattattggcgggattgatgttgagttgtctagggatgagcctgaagagcaagagatgggacttggcaaatgatcatactactattctgtgtgagatatggggtctaaataagc

SEQ ID NO: 70008 - DNA, 501 bp, Oryza sativa
cgcgtgacatgaatcggatactgatgacataccatagtttttacaaaaacatcttcaatttttaaatcgagggagagggcgatgcagtcttaatcggacatgcggcagtgaaaaatcacgcgcgcgaggctgttgtgggcccagttgcggcagcgtgcaaaggcgcgtgtggataatggacactgccatcgacgtcgacatcgacaccacctgagtactgtagcttactgccatcgacggtcgttacaccatcgttgtcatccccaacgcccctgacctcattgacatcctcgccaccaacgacgtcgacatctccgtcgtcgagggtgacgccgccggcctgggcgaattcctcgccttcgtaggcaacctcctcttccccttccttgccttcgctagcctcttcttcatcttccgccgcgcccagggtgatcctgacaccagccctggtagcctcggttggcgcttggacttcgaccgctccaagagcaagttcgagca

SEQ ID NO: 70009 - DNA, 606 bp, Oryza sativa
  unsure (1)..(606): unsure at all n locations
ctccactatcgcaaacacttgctccttatctttttaatttcctcctaccattccacctctttccccctctcccttatcctcttcttcacttgctctcatcttctcctctcaaatattgcagcagctaggagcgagcgtggcgggggggggggggggggaggggcnnangcngtggcccggatgagggcagcggcggctcaacgcggtggtgggctgctggcgcggcgcggggcgaaggcgctggcccgcagcggctgtctgcggcggcagtagcctggcgcggcgcgggggcggaggaggcggcctacgtgggggcagcggcggcccggcgcggggcggagccgacggcccgctcgggggcagcggcagccgtgtgtggcggcagcctgatgcggcgcgggggcggaggcggcgacccgcgtggggataatttttaaatgtgatatggtttttttggatgatttaggagttcaatttttggatgaatttgtgatgttggatctgggatttgtgatatgtgaatgttggatttgtgaatattagaaaaaaaactcgatctgtgatttttggtatgtgaatgttggcaaaaaacgacgaaaaaaatat

SEQ ID NO: 70010 - DNA, 968 bp, Oryza sativa
  unsure (1)..(968): unsure at all n locations
cgtttgcattgcagggatcatctaccgcgcgtcacggttggtacgatatcgtttgtggtgtagcgattgcatggcgtcctggactagttctggttggtagccacgtcacaaacgtcacactcgattaaagcgagaattatcccctcactagaagatcgggccacgagagagagcgtcatcactcgttccccgtcgtgggccacgccgctgtcctcctccacatggcgggccacacgctaaaaatctatcttcaaaagtgcatattgaacgcaacttaagataacaaagctaacccaacaatcaagagaacatgtatagttaggcactgttcacttctaaataagatgtaggttttatcttagtttgcattatcacgctatttaaacggttaaacaatacatttcgtacgaaaaccttttaggcaaaagttattttaaaatatcaaataaatcgatttttaagtttaataaaataattaaaacataattaatcacacgctaaagatttttttgttctgtatgcttgtacttaatctttttttatcttcagtaaacttataaacgaaaacagaagcctctactttatataggttcagagagattcattcgccgcctcggtcggtataggctggctttatacagggccgcggtcgcgccgtcgcggccgcaccagccaccacaagcagccgtcctgggtcacacccgacctgtcccggccgaccccaccgctgcgagctgcggcgcgcgcaagcgggatttacagccacccacaccaccaaggcaccaacgcattcatccaaaccgccggccgccggccgccgggtcgtcgtcgtcttcacgcttccttgccaccgcgcgccctcccgggctagcccgccgggccccgctgctaccagagagggcgatggcgacggcgagcggcgtttncacttccctgcagcttccctccacgcggcgggtgggcggctg

SEQ ID NO: 70011 - DNA, 698 bp, Oryza sativa
ttattttgagacggatatagtaactcctcaaatatttattaggttgatgtagtggaggtatgaatctagaaaccgtttggcaaaccaccaaaccagtcaagtactcaagttttgaaaaatctcaagtgaaaatcaaacttcatcgtcaaatttagtctgaaactctgaattcaaccgttttccttggtaactgagcagtaatcacggttcacggttatcgaaaataccgctcacaaagtgttcatgagagtgatcggtgaaaaaacagttatgtaaggatccaggtcctctacaattaaactactaatgtagggtatgatattcagcgatagaacggttctataagagcgagtacaataattgacgataggagcaccacgtaggatttttcactgatgtggagaagagatagttgaagagagagaatgagcggggactaattagtcgctcggctccacgtgcaacccgaggttgtgggcccgctcgccacaacgatggcgcccctgcgctagccacatgccttcgtcttccctcgtcgccacggtcgtcacctgcgtccagcgcccacctcgccccccgtcggccacgtctgcctcagctactgcggatgtcactgcttgcgtccgcctcggccatggccgtcacgtcgtagacatcacccttgtccggtgcagcaacttccctcgtccaccttggct

SEQ ID NO: 70012 - DNA, 1265 bp, Oryza sativa
ctaaccgtctttatctgtgtttaacaagaagcgcatgcgtgtatatatgcagcgctgctgcaggagcaggcagatcctcaataaggagagagaacaattatgaagagaaagcacaacaggagaggggattatataactgcttgcactgtttgattttattttctgccgttactaattcataatacggattgcttggttcaagtggccacacggtatatttgcgtacacaaatttgaccgataacatgatcttgcttcttgcagccaaaataacagtgatggaaatagaaaagctgctctttgaacatcatgtgccggtaattacaaatatatcattatttttcgtacgtatatattaaatagatctgcagaggtaaccaatcagcaagacaatggcatctgcatcagattcaactgaaagctaattactttgctacttgcaaattactttccagtaaacaatggtacatgcaaatgtttatctttgagttacatattattgtttttagccaagctaattactttgctatgtttcttagagcaaaagtttaatgactataattgttatagctatctttatcatgcatatcatgcagattcatttaaggttagttcttttttttcccacaccttttacgatgtactgctccttttgtatcattccaaaagattggctacgcttcaaccattttgcttggttatttcattactaattttatttgccagacaagatgcaatttaatcgttggaccgacatatatatatggttcacgttcaattttcaagatattattaaatttaactaatctatgttatggggcaatttttaactatgaggatcttatatccattgtgtcatccacaggtaattacgattttacttttcatcaatctttgcccgcagattactcagagacaaagccaataacctactcttcacaacgctggagtacggcatgatggaggccacatcgacctccttcgtcttgcacatgaagatcagcagcgtgccggcgtgtgcatacactgcttaactgacgacgtcaattggatacacacaacctcagactctgtaggttcagactattttctccatccagattttgagttgatctttttttttcatcttggttgttttatttacatgtttctcatctgaaatgagatcagaactcaaccacaccatcataacgtctgatactataaaatttaggtattgatccacaaaatagaacaactttgttgcacatatgatgcaaatataaa

SEQ ID NO: 70013 - DNA, 669 bp, Oryza sativa
acatttgcaaagcctctacagatgaggaagcctgttgagaaatctgtcgctaagtgagagaacctgaacttctgtagaaattctgaagtctggagaagttcaaagaaggcaaaggctagtttagattaagggaacagaacctgcggttgtgatttctctgtactgctccatatggcattggacggttggaattgattgatgtaatcactggtgctgtaatctcttttcttaaatactgaggtgtcagcatttatgtctgaggctttgacgaatcggttgccggatctggagctggatgcactagttgcatttacaagtgtgtatggcaccttgtagaagctttgtagaactgtacttaaaggtaactccatattttgtgaactatgatgttcagtgttcgctccacatgatttgtgttcgctccacatgatgttgcggttgaaaaaaatttcacatgatgtttgtgttcgcttcacatgatgttgcgatggaagaaaatttagtttagtggtcgctccacatgatatgttgcggttgaagaaaatttgtgttcgctcacataatggtgcgggtgaagaaaaattagttgatgttgtgtccgctcacatagttgatggtgtgttcgcttcacatgatgtgcggttgaagaaaatttagttaggtagctcc

SEQ ID NO: 70014 - DNA, 703 bp, Oryza sativa
ccaattccacgcggtaggagtccgatctcttcaatccaaggctataaataggaccccctagtcgtcctctttcgtttgcccccttccccgagttctctcgtgctccgtagcctcgccgccgccgccggccaaccgccagccgcgccgcgccgccgcatccgccgtcgccgtcgccctccgtcgccgccattaggtgcgcacgggagtgaggaagcccggccgccacttccccgtcgtcgccgtgcgccgtagcccgccgccgccgtaagtccgagccgccgccgccgcgcctcttgtcgccggccgtcgtcggtcgccgtttgtcgcttcggtaagcaccattgggttcgcgtcgtcgtcctgtacgtgtaggtgtcctccaaaaccccggccgaccaccctagcgccggcgaggtcgttgcccgtgccgtggctgccgtcgatgacgtcatcatgacgtcataatcccctctttttcagttttttttaatagattaaatatattaaaacttcggaaaatcataactaattaaccatagctccgattcaagtggttcaagttgctaaatttttctaaaatcgagatctacatgttaaaaatatccacatgtactggttatgcttgtttttgtactgttttgttgaattttgtttggttgctttagtttctgatgttccggaggagagcgtttcagttgaggaa

SEQ ID NO: 70015 - DNA, 720 bp, Oryza sativa
cttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaagacgaagttagaggaccaaggctcagaccccagttgagttttgcctgtggagtggagctgaagccccgctaggatcgcctttttccgctgctgtcgttctctttcggtgtgaggactaagtgcctcttatataagtattttacgctttatttacgtttggaactgtatattacttgtcgttttgtgtaccctggctggtcctggacagggatttaa

SEQ ID NO: 70016 - DNA, 633 bp, Oryza sativa
ttggtcttccgccgctcttttggtcaccggtgagttcgccgcgtcgcgctctacccgttggtgccctccgtttgcgtcctcgcgccgccgttcgccggcaagcgtgcgccgtccgagccgccgagccgccgccgccggtggtgacgtcatcgctaatgtcatcgtggccgtctgccgtgagccgccgtggacccgatcgatctcggccgtccgttttggatggatcgatctcagccgtccgttcgcgtgaaccgccgccgtgcgcccggtccaccgcgaaaccctagccactgatgcaataattccctttttccttttcaaaaataattcattattgcgtcataattcaattaaaatcaatataagtgttttaatccgaattaatcttcaaaaattcataactaattcatcttagctcggatttagttggttcaagtctctaaatttttctaaaattgagatctacatgttaaaaatatccacatgtactggtcatgcttggttatgtgctgttttggtgattttgctcttttctgcttagattccgtcgtttcggagagttcgttttcgccggagaagagtttgaagagttctaaggcccagcaggcaagtcacacagatcccaaaccaccc

SEQ ID NO: 70017 - DNA, 726 bp, Oryza sativa
actttttatttatcacggcgaacttggcaactgacgcggggctgcatgggtcttcgatctccggcgaaggggtaagtccaatgttctgctggcccaggcaattgtactggctacaatagtgtcgttcaaggctgcatcagtacattcgacctctaggattgctctggtttggttgatatatttgcttgcctatttatcatatgtctttgttaatctagtcttagaatctcaatttagctctatcggttgtctctcgctttagggtttctgctgatatcgactaaattgttttactggattagattagctaaggcatctaccaccctaaaaatcagtcaagggcttgatctactaagttgtctagatattatgtttcttttcatacttagtgttgcatcaattaggtttgatctactaagtcgagcttagaaccataatctctagcctgctaattgattgccaataagggtttcatcggggtttcagccgatgagttatctagacgttgcatcagcttataaggattacatacaagttggatttagccgatcgcaacaaagatttcactgtttaatctaatcttgtggattttatgacattgggactccagctgatgtattctttaacattcggatcagtgcttattctatcatatcattggtagctaattgacttctactagattatattattactatattatcatcagctgatcgcctttatacg

SEQ ID NO: 70018 - DNA, 651 bp, Oryza sativa
aagggtccgatcgatcgaggaagttgtgtgtactctagctgtagctgcactagtatcaggtattcgatcaggtggaattgggatcgatcgatcgatcacctgcgctggtgcggagaatgtttgtttgtagaggaggaggacgatgatgctatgaaggtttggctggccttagccccagccccagggcaaattaagtactatgtaggtgctcgatagctttcgttttcgcaagctgttgtccgaagtatttttttgaaacgtaactattgtccgaaagcagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttttgatttttttctttttttttaa

SEQ ID NO: 70019 - DNA, 43304 bp, Oryza sativa
aaacgggatcaacatgctcaaagggttgtttgggatctgtgtgacttgccttgctggccttggaactcttcaaattcttctcctgcgaaaacggactctccggaaacgtcggaatctaaacaaaaaggagcaaaatcaccaaacagcacataaacaagcatgaacagtacatgtggatatttttaacatgtagatctcaattttagaaaaatgtagtgacttgaaccaactaaatccgagctaagatgaattagttatgaatttttaaagattaaatcggattaaaacacttatatggattttaattgaattatgacgcaataatgaattatttttgaaaaggaaaaaggaattattgcgtcagcggctagggtttgcggtggaccgggtgcacggcggcggctcacggaaacgaacggccgagatcgatcttatccaaaacgaacggccgagatcgaacggtccacgaccgggccacggcggacggcgacgatgacgtcagcggtgacgtcacctccggcggcggctcgagcgcgcaagctcgccggcgaacgacggcgcgaggatgcgaacggagggcaccagcacgtagagagcgacgcggcaaactcaccgatgaccaaaacagtggcgaaagaagaacggacggcggcggcgtcgaggaaaaggcggcggagaccttcggcttgacgacgacggcgatgctccggcggtcaacagcgacggcgaaggagcggacgaggacggcgacgcgacggcgaccacgatggcgacctccccgagcgacggcgatgactggaacgacggctgcacatggctggagcggcggtgacgacggcggcgcgaggctacacggtgctagggcgctaccgacggcgagaggcgaaagcaagggtggcggcgggtagcggcgggcttgggggtccttttataggggttggaaggcggcggcgaaggcccacggtgaccggcgacgcgaaggaaagattagggttcggaggaaagggttcgatccgaatcgaactcgaatccacggatttccaaacgaaattagccgacgattccaaaagagaaaaggtagaggagatctcgggaaacatttcccctcaatcgatttcaccggatcgggaaaggcgcggccgaatttggaaggagacggcggcacggcttggctagggttcgggcagcggcggccgaaggaagacgacgagtccgacaggtgggacccacctgtcagcgacagcgagcgcgcgcgtgagcggctcggctgcggactgggccgacttgggccggggagagagagaaggttttgggccgactttcggcccaaagccaaaagagacttttaaaaacctttttcaattaaattattcatgaaatgcaattccatttattaaaaatacttccttagctcaaataaatcccagaaaaatctaggaattaaagaattaagcaaagtatttaatgaaattttatctggccccattttatattggaatttattaattaaaattagatcttctcttctagacttttaaaataaattctaataattccaattagacaacaatttatatatttaggatttttagggtgtgacattctatcttcagatagagaattcggatcctgtctttgttgttcctgaggaacaaccagacaagatttcgtcttggaccgcaaagcctaccttgacccctgcccttcggttcttcgtcgaggccatcgatgacctccgagtacgaggtttgtcggggtatgaagtcgctgccaacttcgttggtaggcgaatccagccgctccaggctcgagctcatccagcctttgactattctgggccggaggacacgacccgggtttctcctcggggtatttttcttgtgtttgatttgacctccttataggcatgctcctcctggcttaccgaattccggttcttgacttgcaggcttgaacagcgaaacggtggagcgctgcgtcggccaactgatgatcaacagcccgacaacggcaagcgacatccccgtccccctttgtgagaaggaggcggccgatcgtgaaaccgcaatcaacgtgagtgtattcggcgacccctctattcttgctcctggatcggataacgacttcatgcggtgcaggttctccctctgactgacgtcatcggaccgctcgtggatcaccaggcggtggcctcgctaaaagagggtgtcgcgcagggggcatccaacgcggccgctgctgctgcctcagcgactagcgggagctgccccccaaggaggggaaggaagttcacctccgtacttggcagtcgccggaaggcgtcctccccccggtaagtttcttgagccattaaccttgtaatcagaaaagtcgttcctcaaatcatccttggtttactaaggcctccgacgcgtctccgccacctccacgacggcagaagttggtgacgctaggcgagaagtaagtaggtggagattgagttctttcctttggttggagatctggcgactagtctagatattcggatgcgatgatcttttgtaggtaggcgcgagcgaaggcggcgcaggatgggtttggtgagacctccagcgcgtctcctgcagcggtctccactgacgtcgtggtcgccccacgaagtcgggaggcgacaccccacggcctgtccggtgatctcgggcctgttcgcggcccgcctgccgacgtccttagctggggggagctccaagtcgagattgggcgcctcctcgaagctggcgctcgcggcataagttgcgagattgctgaggcgaggacagcggcggcgtcgtcggctaacgagcgcgccgacaagctggagcgcaaactggtggaagttcgcgaggacctccagaagatgagggagctggtggccggcatcgagcgacagcggcggggtcttgaggaccgcatggcggaactcgagagtaacctatcggagctccgtggctcgctgcgagtcactttcactggcctacaccagctcgccgggcaatgtggtgtcacgaccacgatcccggcgaaccccgacgagttctcgctgacgtcttcactcgcagaactggctacggcgatggaggcgataccctccaagcacgcggccaggatcaggaaggagacgtccaacgggatctataccggggcatgtcatgtcctcgcgtgcgtcaagttggcacatccgaaacttgatctccagcggatcttggagcagggggcgacgaacgacgcgcgtagaggcgtgatggaagaagtcggcgatctgggagagtctgttctcccgctctttgaagagtaggaccttagttcccctgtgtcttttctctagttacgctttgtaaaaacatttctcaacctttttgcgtgtgcagtcgtcgctttagttttccccaacattttttatcccgagcacttgttgtcctttgtagagatgtcgatgtcgaggatgtccagcagcgtgggcagcctgagtcatcagtgatccttccggatcttgcatctgaggaacccatgtcgctgaacgatgtggatgaaattttacccgcgagaatggggacggcaacgacttccttaggttggtggtctcttcatcccgtttcgctcctccgacttgattagccgtgttctcgagagagaaaagcagcttgacttagtcgtttccatattaaacagatctcgagaatgcacttgctgaccaagatcatcgtatccaatattggaagacaaaatttgaagtggcggaactcgagagagctatgttggaagtgaagaaggagcaggccgtggaaacactccgaggtcgtgaggtgtggttcaactcgtatctgaagagttgctgcacgtccatggcccgagtttgtagagagctccgagtactccgcggagatcccgaggagtcagcggccggatacatctcatggctgaatggggcctgtactcagctcgaaggcatcggcaagcgcatcgatgaagccctgaagcaggaatgccgtcgatcgagccgatatgctggagggcatgtgttggcttgcatacgagatcatcgtccgcaactgcacctcgagtttctccatgaagggttcgctcgttctcggaggactccggtggagatagaccacctggcgaagtagatggcgccgctggcggagaaggtcttccagtctatggactggcgttggccttcctggtagtctttgtatcctgtgatagatatcttaggaaaaaggtgtaatatagttccggacttgtgtggaattgtaagaagtatcttgtgaaatagaaaagaaatctatcttaatgagtccttcttactctggatgtagtgtgtaagagtgcctcctcagttcccgactttagctagtcgtttgagtcgtacactctccctagcccccagccttgtcgtcgaggaattcttctcggaggacaaggctcttggacctttgacctgcctcggttgagaaagcactgattctagcccccaaccgtgaagttggaaagttaatttctgattacacggcttggttaatacgcacggcgagaactcttacacgaccaggtcttacatggtctttcgtctctacaggatccgacaaggccttatcggctctgggcgtccccagctgaagatcccttaggttcctcggaggccttgtcaggacggcataaagggacatgaggataggtttcaacgcaaggtgtcatctgggtaaggggtcatcaggcaggaacactgtgattgtaatatgcgcctgaaaataggctttattgatactgtaaggtgtcttacaggtatggattgtattgacttatacatagaatttacgtagttggtcaatgttccaagaatttgccaactcgcggccatcgccgtctgcaattttgaatgcgcctggccgcaagacttgtgtgatcgtgtaaggtccttcccatttgggtgagagcttgtttcgccctgcttggctttgaacccgtcggaggatgtagtcgccgatcgaaagtatgcgtgctcggatgcgcttctcgtggtaacggcggagggcctgttggtaactggctgctcgaacggcaactcgttcgcgatgttcctcgagtagattcacatcgtcgtttcgctgctcctcctgatcctcgtcggaatacctctgtattcgtgtactttgatatcgtagctcgctggggagcatggcctcagagccatacacgaggaagaagggtgtttccttgttagatgttgtcggtgtggtgcatacggcccatagtactgatgggagttcttcgacccatttcttgtcgtgtgacatgagcctgtcgtagacacgggtcttgatcccttgtagtactatgccatttgccctctcgacttgtccattgctttaaggatgagaaaccgaagcgaaacatatcttgactcccagcctgatgcagtaatcctggaaatcggcgctgatgaactgggagccgttgtcggtgatgatgcgatgtggtagtccgtatctgcaaaatatccctttgatgaatttgatggcgttgtcggccttgatttcccccgtgggtatcgcttcgatccatttagtgaatttgtcgattgccacgaattggaacctgtagccgccctgtcctcgtgggaatggcccgagtatatctagcccccagcacgagaatggccaagtaagagggacagactggagcgcttgtgcgggtagttttgtgtgtttactgtggaattgacaggctttacaccgctggactatgtcgcacgcatctttgagggcggttggccagaaaaacccttgtcgaaaagctttcccgaccaacgtccgaccggcggcgtgtgacccatagatgccttcatgtatatcaaggaggaggtgtctgccgtcgtcggacgagacgcatttgagaagtaccccgtttggcgctttcttgtatagatcgttgccgatcgtgcaatagattttcgctttacgggttattttctcagcctctgcgtcgtcctcgggcaactcttcgctgttgatgaatttgatcagtggggtgcgccagtcgtctatggtatcgatatcggcaacggcgcgttctgcctctgtggcctccgagctgatgtcgggggtgtctgggttaatttcgccgctgacctctttcactgatggctttgtcaggatgtccagaaaagtgctaggctcgagtggttctcgtctggacgcacgccgtgctagatcatctggctcaatgttgtccttgcggtatacgtgtcggacctcgatcccatcgaaccttttctccagcttcctgacttctgcgagatacttggataattcggggttagagcatttataatctttgtgcacctggttcgctactagttcggagtcccctttcacgatcagtcgtttgaccccaagtgcggctgcagctcttatcccggcgagtagtccttcgtactcggctatgttattggttgccctgaagttgaggtggattgcgtgcttgaattaatctccggaaggagatgtcaagatgaatcctgcccctactccttggctgttgagtgcaccatcgaacgccattgtccacgtttcgtcgtcgatttggttgtctgatttgttatcaggcatagtccaatcggctacgaagtcggcgagtacctgggacttgatggctgttcgtggcacaaagtggacgtcaaactggcttagctctactacccacttcgcaatgcggccgacaatgtctttgtttctcacgacttcaccgagagggaaggaggagacaactgtgactctgtgggcttgaaagtagtgacgcagcttccttgatgtcatgattaccgcgtaaagcagcttttgtatctgtggatatcttgtctttgcgtcatggagagcttcgctgacgtagtagattggtcgttgtactttctctctctcgacagcaatgacggtgctaacagaataaggcgtggcggcaatatagaggaataattcttcattaggttggggagcaacgagtacaggggggtttgataggtagcgcttgagtgcaatgaatgcctcttcagcttcctgtgtccatacaaatttgtcttgcttctttagcagagcgaagaagggttgtgctcgttctcccatcctagcgacgaacctgcttagcgctgccatgcatccggttagcttttgtacttccttgagtcttttgggcgacttcatgttctcgattgctttgatcttctcgggatttgcttctattcctctgccagatacgaggaaaccgagcagcttgcccgacggtactctgaacgtgcacttctctggattgagcataaggcgatatcatcggaggttgtcgaacgtttcccatagatcgtcaatcaatgagtcgcttgtcttagtcttgacaacgatgtcgtcgacgtatgcctcgacgttgttgccgagctggtcgctaagtgcgccctggaccgtgcgctggaaagtattccctacggttatcagtccgaatggcatcttaacatagcagaataccccgaacggcgtgatgaatgctgtcttctcttcgtcctctttcgccatgctgatttggtggtagccagagtaagcgtcgaggaagctcaacagctcacagccggctgttgaatccaccagctgatcaattcgaggaagagggaagtgatccttgggacacgccttgttgaggtcggtgaaattgacgcacattctccattttccgttggccttccgcaccatgactagattggctagccactctggatgaagtacctctctgataaaaccagctttgagaagtttgtcgagctcttctcgtatggcttgttttcggtctggtgcaaatcgccacagtctttgttttactggcttggcatcaggtcgcaccaagagtttgtgctcgatcacctccctagggacccccggcatgtcagacggctaccaagcgaacacgtcagcattgtcgcggaggaaggtgatgagcgcgaattcctatttctcacttagtgatgccccgatcttgacggtcttgtcggggttggcactagagagtggaacgatcttgatcgcgccatctggtttcggcgtcttctttgtcttgctcactttcttgggaggctcagttgtagcgggtgggctgggcatgtgctcgaccatgtcgaggctccgcttgtcgcattgtaccgctagcttggcgttcccttgaatagtgattgttcctttcggtcccagcatcttgagcacttgatacgcgtagtgagatgcggccatgaacttcgcaagtgcagttttcccgatgatggcgttatacgctgtatcgaattcagcgacatcaaaggtgatctgctccgttcggaagttgtttgcttggccgaaagtcacaggcaacgtaattttgcccaatggtttggacgaggactggggagtaattccatggaagggttgatcggtgggtgtcaactcgctttgtgggattcccatcacgtccaaggtgctggcgaagagaaggttgattgagttgccaccgtcgatgagaacccgcgcgaccttgatgttccgaatagtgggttcgaccacaatcggatagcgtccttggatgacggcagtcttgggatggtcttcttccgagaattcaatcttctgttcagactacttcatcttgggtgcagccccctgccatgtcgaacagacttcatgttccactttcttgtattcttgctttgaggagtacactgtggagcctccgaaaatgtgcgagacgtggaggtcagagtctggatatgctgagtccgattcctgaggagtcgcctccgcatccttctcgaccactcgtactcgcttgcctttttccaacgccatgtgcttctcgagcgactttttgaaaacaaggcaatcttccaaagaatgtctgtccgtcttgtgtatggggcaccatgctttctttgcgtcgctaccttgtgggtctgggcgcttgggtgggttcgcgtattctgctgcgagaatttccgcttgagctttccttttcccactcttgcgatttttcttcttgcttgactcaggtgcgtccgtggctggtttcttttctccccggttttcagcttgttgttcttgcatctcagcgcatcgtctacgtgggtgcatcgctcaacgatctcgaataatctccgagtagttgtgatgcgtcttgtcgccaactcctgggtagtatagcgatctcggacaccggacttgaaggcgcgaattacagaagcgtcggtgatttcggggattgtatttctgcactcgttaaagcgccgaacatattccctcaaggatccacctgagttctgtgtcaacgcatgtaggtcgcttcgatcgcgtggcgcttgtaagttccttggaagttggcgacgaactgctgccacaggtttgcccacgaagaaatcgagtagggcgggaaatgcgtcagccatgaacgtgcagagccttttaatgcagttggcagataatttgccaacgtgttgtcgtctgctccggcagcgtagagtactgtggagtagacttgaaggaattcttctgggtcagtactcccatcgtacttctctattgctccgggtcggaatctctcaggccatcggacatcacgcagggaacgaccgaaagctctacacccagcgctaggagcagtgggttgtcggcgatcgtgtgtccttcgtggatgtctgtctgacgatgaggatgaagaagaagatgacgatgatgatggatcgcttggttttggtgtaggattacgaggtcgtcggctggattctcgagaatcctgtcgtcgccctccgttgttgtcccggcgccgatctctgtcgtcctcgtcgttatggcggtgtcctcgaccagtatcgccctgcattcgcctctcacgatcatcatgatcgtggcgattgcgagatgaattttttaagcctaattgtgccatgatttgacaatgtggtgctacagagtacatgtgctaatgacagattaattaggtttaataaattcatctcgcagtttacaggtggattctgtaatttgttttattattagactacgtttaatactttaaatatgtgtccatacatccgatgtgacacgccaaaactttacacctctggatctaaacacagcctttgattattattgacatagtagactgcttaagaaatagtacagttaaacttcaatcaccgcgatattacccggtgcaacgcacgggcattttgccagtatacatataaactttgtatttcagaaatacaaagtttatacgtatgtatataaaatatatacatatttgtgtgtgtgtatatatatatataatttttgtgtatactataaaattgacgtataaaaaatgtacatatatgtgtatgtaaagtttgtatacgcatatataaattttgcatatgtgtatagaaagtttgcatacacgtatataaactttgtatatgtacatattaaaaaccgaaagaaaaaaacacgaatacaaactttgtatatgtacaaatacaaaacttggtatacatactagtacaaacatcgcatacatataacctaaaaaaactggaaaaaaagaaagagaaaccgaaaaaacccggaaaaacccgaaaaaaccagaacataaagagaacagcaaaacggaacaaaaacagaaagaaaaaaaaccggaaaaaaccaacaggaagagaaaaccgaaaaaaaccggaggaaaccaacagaaagagaaaaggaaaaaaaaacgaaaaccccgcggcgcgccgtccgccgccccctctccgcgcgtgacacgtgtccagtcgcacgccctccccgcgcgactgatcgctagataggattttggcccccccccctccccactatctatccgttccccttcctctcctctattctacgccagcatcccgattcaccgccgtgcccttccgcggaggagcaccccctctccagcgccagagaaagagaacaccagagttattgaagtagcacttaatttgtagccaactaattaattagtagcactaatagtactactggatgactatatcaccatactacctcatgcacgtgcagcatgcagttgtgacatgcttgatctgaagtttctgaacttctatctgaaccggccagattttattttagaaaatagattaaaacggggcctctacatataaaacagatgtacacagccaatctaaactaagggtgtgttcgctaacagcagatgggaactttgcacagtgcacacggaaaacggagcagctcattagcacgtaattaattaagtatttgctattttttaaaaaaattagattaatatgtttttttaaataattttcgtatagaaactttttttaaaaaaacataccgtttagcagtttgaaaagcgtgcgtgcgaaaaacgagggagaggggatgggaactttagcatccgaacacaccataaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgctatgctttgcttggctgcaggaatgtgcacgacaggaatctccgtcgtcctcctgctcctcccctgcgtcatctacgtcctcttcgttgccgttccggtaggacgcgacagcgcccgagagggcgagaggtcgacccaggagcggcgtctgggtttgagagtgaaaaagacaaaaataccccaacacatataattttttttggactaaaatatccctccacaattctactaccatcaagtgtggtggtagtagaaatacatctgaaccgttcgatcaaatgcgatcaacggttcagattattctctactacagatagaaagcactggagtgggacttcggaagttcacacacctgacaccttttgagctagcgaatgtgttgattgagcattattagtaggattgtttcccttacaacgaaaatggtggttgcatgggggaacgagatgggaaagcaaccactttgaaaggagagtgccggagagacggcgagatcaccggagttttccgacgatcggggatgcgatagagcatgcgagtcgctgggctcccgcgggctggcggtcggcatgggcgaagacttcgcaatccacagagatttcgtcagatttcaggagggagacaggggggtgcagttcactagaggaacctcaacttaacaataaattttttttaatatcctttaaccacaaaatcagaaatatatacccataaactcactcaaaccgtttcagggaggtcccatggcagtatcgactcaatttttacctttttgttaacataacatcctagtaaaaataaaataaaataaataaatatgtaggacccatatgtaagcaagaaaaaaaaagtgagatcaacaatcctagtcagcaatctccgtagagagggagcggcactggcgcgcggctggaggcaggcggaacggcggtatcgacgagcgagcaagacggcggggcgtcggcggcggcaagcggcgagcaagtgttggtggagcggtggcggcgggcgagcgacggctccgggctcgggaggagcagacgggcttgggatgtggggggcgcggtaggtgagtgcggctgcagagggggagaggcggccggagcaggtgaagcggtggcgtcagagggcgagcgcagctgcgatggcggtgagctcgcggcgcgcggcgagatgcatgtgcggcggtgcagcacagctcggcaggcagcgctgcgaggtgcggcgacgcggcggagacccggcgcaggcgcaacggccatgcgggcagcacggcgagggggcggcggccgtgctggcggcgcggctggcaggcacagacgtcgcgctagtgcggggcacaattggcggtggttggttcttcggagcgatgcaggttaaggcgtgcgaaactctgcgtgggatggcgtcgctgtcgtgcagggtagcatggtggccagtcgatgcggtcgccgactcgccatgcgtaggcgacgcggtggctcgggataggggcgacgtcgtgcgcgaggctatgcggcggccgttcagcggcatcagccaggcgtcgtagtggtcgtgcataggtggctcgaggcgtgacactgtgtagggtgcgtccgagtggcggccatgtgtggcggcgtgacggtggtggtggccatgtggggtgtaggcagcgcgcgggcacggctcgagcgatggtgtgcggcagccatgcgaggcgccgcgcggcgggacggtgcgcacgggagagaagagaaggagaagaaaagggaagaaaaaagatgtgcagctgacatgtatctatattgttataggactttagtgcacgatttgcatgtgtttaggagtacacgtttttggttttgtttaagggactaaaaagttgagggacctccagtgaacttattcttttccaggtcgacaaaatccccctagtcgcgtctctcgtgagcgccggcgttccgctctgtcctcgcgactctgcggcggccggcggctccccttctcatgagccgccgccatcgctgcgtgacgtccccctcccacgagccgtcgctaccaccggcggtgcctcccctcctctcacgacgcatccatgccagtgccgcccccttgtcactagccgccgccggcgggcattaccctcccccgagccgtcgccaccacagggcctctccctcccacaagtcgccgccatcgcagggcctctcgtcccgtgagacagaggtgtgtcttctccttctcttcctctccttagggcttgttcgtcacgtggtgagcattttccccaggggaaacgccacctggggggtattggatgaatcccctcccatcacccaatcccctccatcccagggatttggttcccttggtcattcggaatgcaaatggcggggaaggttaacgttcacttcagacattaactcaggccaagcaacattcaacactgatatttaaatttcatatcactaaaaatacaaagaaaactaaacatatagtcctgaaatttaaaaatagcattaccgaaaatttgaaatattgtaaataaaaaactaaaatttctggagaaaataagaaattctgaagactgtctaaaaagattatgaaaattctgaataccacatagaatgtactaaaaattgcttgcatcatatccattcagtcaccacaatcagtcacgcattcacaatacctgatttactcatttaaacatcatatccatcaccacaatcagctaggataagccactgaagactaattacattcatttcatacaaacagaaactaagagtcccaaaaatccaaattctccgtaagtgcaagagcagaagggcattactgcaaggctattagtagctccattacctgctgcgagtgaaaaatgagttatcatcagtgatctgcattaggcattaatccatgctatgaatagaactagccctatattttaattcaagaggcagaactgttttggaatatagtataaaaagtagcagaattacaaggaggaaatatacatcagtagaagagcatttccttgaacaatcgatgtcagaagggaactatttgtatagaaatatatataaatataagtagatcacattagcagtatagcatcattagcaaaataggatcagtgctcaagcttatactgagttcatggcaaagcacaaagaggccgaggggggctcctgagtatttactccgtacaggaaatgacatcgatctatctatgactagacctacagagattgatcgaaatttttacacattccatgtagtagtgcatccaattcatcccaatcctttgaattagcacatctaattaatgtcagattgctaatagtatggaaaaaagaaagaactaatcaagaattatgaactattttctccatatgtttgtaacattatgaactcttttcagccaatgaattaatcaagaacacactaaagtatccaatattcagtctaatgtaatatgcaggttgcagagtttttgagacaactttttacagaacattatctgaaatcaagaacaattaattttcttttgctagtcaaatcaaggccaaatatgataggaataggctcatgaatcatgataaagtactaataaaaagtgtctaaccacagcacaatgtataaagctgtgccctcctttgtagcaaccattattacaattatattgcaacagtgaattaggaaatttttcataaaatcgagatatccaatatatttgatcataagtcaattgttaatctaataaataagagggcaatgaaattctgttacatcactttgtaaaatgaaaattcatggttccacgtgtaaatgttaaatgagctaaaaagaacaaggatatactaaatactgctagtctgctcatccctaacacaagctctatggagaataatgaccagctattagcccagtgatttctttttttgctttaatacattgcaaacagctattgtgtttccgaagaccatatttgacaataaaatctcttaaaaatctgttaggaaacgatatgcaaacaaacgataaaaaataatagatcaatcacagaagacacgagatttaacatggaaaaccctcccaaaacaggagaaaaaaaaccacgggcgtcagccagcaaaatatctttactatatctgggtgaggttacaacgccgcacggcgacttacaagaggtatatatatggtggaaccctaaaagggatgacgatccgtttcgcgggggctccgccctcgcacccccgggcgtccccaggtgcacgacccaatgggccagcttcagcctccgctccactacggcagaagctggcatttattaagtgcaaatgaatttggatcacaactcaacaaactccaccttgagacaaattacttcttatagcatgaatcaatccttcaccctgaacacaacaaagataaaaaacactttcagcgccaaatagcctcttgggctaaaccactatacaaactaagcttgagcaaagctcaaacttagcaacaggaacaggctttgtcatcatatcagcaggattatcatgagtgcttatcttgcatacctttagcttaccttgcacgactacatcgcgaacataatggtacttgatatcaatgtgctttgtcctctcatgaaacatctgatccttagtgaggtatatagcactttgactttcacaaaacaagttaatgcaagaatcaactccacaaagctcagcaaacaatcctatcagccaaactgattctttacatacttcagcaatagccatgtattctgcttcagtggtagactgggcaacaacaggctgcaatgttgccttccaactcacagcacaactaccaatggtaaacacataacttgtgagtgaccttctcttatccaaatcggcagcaaaatctgaatccagatatccaacaagccccttatcagtcctgccaaacttcaagcaagcatcagttgtgcctctgaggtacctgaaaatccactgaacagctttccagtgttctttaccaggattagccatgtatctactaaccaaactcatagcatgagataaatccggacgggagcaaaccatgacatacatcaaagaaccaatagcactagaatatggaactctagacatgtattctacatcatcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctatctctagtgatttccatacctagaattttcttagcagcatcaagatccttcatatcaaactcactactcaactgtttcttcaatgtagtgatttgttccttgctcttggcagcaatcagcatatcatcaacatataacagcaagtatatagatgatccattaacaaatttaatatacacacatctatcaaattcagaccttttaaagccatgtgacaacataaatgaatcaaaccttttataccattgatggggggactgtttcaaaccatataaggatctttttaacatgcaaacataatcctccttaccagctactatgaacccttctggctggtccatgtatatctcctccttaagctctccatgaaaaaatgctgtcttcacatctaactgctcaagctcaagatcatgcatagcaacaatactgaagaatgtacgaattgaactatgttttacaactggagagaacacatcattataatcaacaccagcaatctgactgaaaccttttgctactaaccttgccttaaaccttggaggctcgctgggagataaaccctcctttctcttgaaaatccatttacaacggacaggcttcttctgttttggcaagtgcacaagctcccatgtgccattcttctcgagagactgcatctcctcctacatagctgagatccacttctcacgatttccagaaacaacagcttcagtgtatgtggctggctcaagagtattctccacctgttcagcacaactaaaagcataataaaccatatcacattcctcaataaggcggactggagctccacaactcctctttgttctgcgatgtgcaataggttcatcttgtggctgcaaaacaggaggtgagtgctgaacagtatcatgaacatcattaccaacaatttcagtttcctgatcatcacgtgctccacctgcacgttgacatattgctgctcctcatcagaaccacctggtatgacatctgtgggcaagctgtcattaaacataatagattcattaaaaacaacactcctactcatgaaggtcttattagtttcaggattccataacttatatccttttactcctgaaccataaccaagaaacagacacttaatagctctaggctctaattttccattatcagcatgagcataagcagtgcatccaaaaactctcaactgtgaatagccagcaggcataccagaccatacctcaatgggagttttcttattaagtgggatagaaggcgacctgttaatcaagtagcaggcggtgttagcaacctctgcccaaaaacgcttgttcatgcgagcattggacagcatacaacgagccttggagatgatggttctgttcatgcgctcagccacaccattctgctgtggagtgtacgggatggtgtgatgccgaacgatgccttccttcctgcagtaatcatcaaaagcatctgaacaaaattcaccgccattgtcagtgcgaagtacttttacctccttttcagtttgcctttctatcataactttccactctttaaaaacagcaaaagtatcatctttatgtttcaggaaataaggccacacttttctagagtaatcatcgataatggtaagcatataacaagcgccactaagagagggcttacgagaaggcccccaaaatcagcatgtacataatcaagtatacctttggtgcgatggactgaggtattgaattttacctttttatgcttaccaaaaacacagtgttcacagaaattcatgttaccctgagtgcagccatccagcaggttcctcttcatcaattctgccataccaagttcactcatatgtccaagacgcatataccacaggttagtcttactaggttcatctttagaaacggcagcagcggtaacagaaccatgtaatgtacttcctctaaggacatataagtttgcagaattcatatcaccaatcatataaacgagagaaccttttgatacctttacaactccacctgaaccggagtatttgtatccttctgcatcaagtgtgctgagtgagatgagatttctcgccattcctggtatgtgtctcacatctttcagcgtgcgtgtcgtgccatcatgtgtcttgatctaaacagagccaatgcccacgatctcatgtgggttatcatctcccatacacacaacatctccattctgcacagacttgtaagaactaaaccaatctctgttaatgcagatatgaaacgaacatgcagtatcaagtatccattcatcatgactagcaacacaaccagcaaaaacgacaagacaatctcctgaatcagagttttcggcactggtaacaacagaggccttaccatcagattttcttttctccttattctgcagcttccaacattcttcaatgaagtgaattttctttttgcaatacttacagaactttttacttcgggacttagaacggcttctactctagctcttgtcacgatcattgctgtcgttgtaggttctttgttcagatctgcctctgacctacaatgcttcgcccttagaggacgaggcatcagactgaaccataactttcatcttctccttgttttggagtgcctcataaacttccgcaagggttagttcatcacgacttaaaagtatggtgtcacgaaaatttgcatatgaactaggcagtgaacataacactagaagacctaaatcttcatcatcaaaatgtacctccatcgacactaggtcggcaacgatctccttgaagaccgatatgtggttcaacacagaaccactctcctgtaacttgtgcgagaacaacttcatcttgatatgcatcttactggttagatctttagatatgcagatcgattccagtttgagccaaagttctgcaacagtcttttcctacaacacttcttgcaaaatatcattagatagatgaagttggatcagcgacagagtcttacgatcttttcgcttctcctcagcggtctattcagtcgttttcttcttcccgaagctttccagcgcctcatcaagatccgaagtttgcgctagaaccatccgcatcttaacttgccacagcgggaatctcgtcttgtagtctagcagcggtagatcatacttcatcgacgccatcgtgaaaccctaatgtggaaacaatgctctgataccacttgttaggaaacgataggcaaacaaacgataaagaacaatagatcaatcacagaagacacgagatttaacgtagaaaaccctcccaaaacaggagagaaaaaatcacaggcgccagccagcaaaatatcttcactatttcggcggcgtcaactttcgccttcttcgttgcccttgtgcgggcagacggtggagcttggtgggaccttgacttggaaggtgccggacgaggagcttgaggaggagttgacgcaggagcctgaggtggagacggtgctggagcctgaggaggagatggcggagccagaggagatggtgcatgagacgccgcttgtcgcctagggaggatgatgtaccgcttgcgccatagtataatggcgtggcttgtgtctcgtagatgcgtctcaccgtctcctccagggtagtccaactcgaggtccttgtacgcggcttccaccaactcaacttcgaccttcgagtatcctgctggaatcggcctgcagtggtaagtccctgaagggtccgttgggatggccattcccgacgccaccttcacgtggtgagaggttatctattagtaatcaacataagcagcaacttgcggaatggacaagtcaaaaatcataaaattacgagcataccttgattgataagttcttgaagggaatatgcagctcacatggtgtccgctgagtgatctcatcaacggggcaggtggtttcgtcctgagtttgcatggcgtccatgctctatgatcctacctgtcccgttgaggcacagctgctacgattgcctgatgggctgaccattgcaggaggaatgtacagctggggatcttgggaccgatgtgcggacatgcgtttatccaccttccttgccacctcctctttcatgctgagctcatagctcgataccctgtacttaagatctgcaatcttcgcctcggtatctctcttgctcctcatccgactcctgtacgtgtggatgtcctccttgaatccaatcttccaaggaatcacccctttccctcgtgttcgtcctggatgctcgggagtctgtagggcaagtgacagctcgtccttctctctgtcgggtcggaacgtgccctgagaagaggcttccactgcgtccgttagtcgactggcagcctcgcgtatctgatcgctgaagaccagggagccatcaactgggttaagcgttccaccatgagcatagtaccagaacttcgatcgatccgaccatttagcggtggccggttcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgccctgtcttgtaagcaacgaactcgtcccagtgatcccttagcttcgggaatatgttgaagttcgttgtctgccccttcaggatgtatttctggtagagatctccctcgaagctctgaaactgttctgccattttctttagagtccaaccttatgtgatggcataaggttgtagaattgagtccaagatctgcttattaattcatttcatctgtgctcattgttttcgagaaagaattatgctcttattataaaagaagggattgctcctgtagatttcttaagactatattatctagtacttctgttgttaaatccaactacaatgtacatgaaaacgcacatggaagttagagaatctatttaattcgtacgaacaataaacatttgactatagtggtctgccgaacccaattccgttctacctatatatgagcagccattaattgttttgcttagtttcagcctaagtggatttttgttgccccatagtccaattattcttgatcagcgatgatcatcaccatctctggttctgtatcctggtttccatttgcgatgatttcggctaactgtcgttacaattgttgtttatttttgttcactgcattgcagagtggaggaagaaactggtcatagtatattaatttgggcgggaatcatggctggtcgattgagggaagattagttttgttttactagcagtagtttcctgtactgtatcgagtaaatgtcctgttttactaatcttcctagacaatccttctttcggcatactttcttcaatttgacaaataatactatgcatgtatcctttctttagttctctctcggaaacttgttgtttcaggaagctatactagctgtagcaaatagctgtcatactaaagctgagttcggcatatggggttgggaactaatcccacccgtacgcaaaacggagtctaattaggtattagctaatatttttgaaaaataaattaatatgatttttaaagcaactttcatatagaaaacttttataaaaaatacaacgtttacgcgtggaaaaagagaaagatgagttgggaaagaagggggaagaacacaacctaagtagttggttcacttcgctatacactgtcatattggttctggttcagtcagtaagtgcccataatctatgttatgacactctgcattctctcttgaaaacgaacatgcttttctatttattttgatgatgccatcccagaacaattattcttgtaatggagaggatgattgggagattcaagatgccttattggatatggttggcacacatgcatttcatcaagtttttgtacctggagaacatttggcagattttgtacatacttttatccaatcgtgatataagcaaacgctagctagcatgggttctctatagtctggtctgtagacttcagccctatttatttgattactcatcattcgttcttgttctagacattataaccttgtatgaaatactatagtatttgcatgtgttgatgcatggatgtcattgatacttcttcgactttgatgatatatagtgttgttacatcataaagctcatcatgagctcgtgatctcgtgatctcatgatctcagtatgttttttttttttgaatcgatctcagtatgtttttagatcaatttcttttatgatcttgtaaaaagtacatcattttcatatgactgtattttctatattcttgttgaatatttttatttttatttttattctagattttctgctgttttttttcaatttatctagattttccctttttattttttctgcgatttttcttatttttcgagattttatgtgatttttatttttttgttttttggctacatggaaaatttcccatagcatgttttccaaaatttttcccaaggtctttttcccttggctcccaaatgagctctcactcgattaaccttggaccacgcacccttcaaattcaagcttccactaaaattcccccatcacaaacttacctccttactggtagcatctttcggtctaagtacaggaatttgtgtgtggttttggtttgctgttatggtggcgtagtgggttgttctgtgcatctattttggttaattgaaagcattttgttcaactaacaccatgtgatgcgatgcacctgttggtatagcctgcgaggaaaaaattcctgataatgagaccatgatttcctgatacaagcatacatgttatgcatgctaaaattaaaccctttatcttggcactacctacgtactccctccataaaaaaaaagtgaatctaaaactagatgtgatatattttaatacaacgaatcaaggcacattcaatactaggttggtttttatgggacagggagtatatttgactttttgtattatccacggatcttctcaagagtaaatcttaatcttctctcttgaaaagaaaggcttatctctgtcctaggtttgtccaagttttggtccggatatcaccaatttaactcttttgagtcaatctccaaagacataggtcaaacccaatttaaagttcaaaatcttttccaaatgccctcgcaaaattccctcaaattcaaatttaagctcaatttcatagatcaaattaaaatccaaattctcttactttaattcttcaagatttgcatgtgtgcgcttgttggagtgagtgtgtgcgctattatttttctagaaaaaagctttttgtaagttcaaatattcctcaattaaagatctttgtaagtgcccaagtattgaagatctttcctcaattcaatttcccatgatgatgatcgagagagccgcaccgacgcttcagcgagcgtactcacgcgggatcatcagacgtacgcacgcggacgtcgcacgggtatcgcacgaccgacaatcggaaatatccttatttaggttacgttattacgagttcgctaattcgtgcgagtatttcataattgcaattggccaatccgtgtacataaatatatatagtgtttaggtgaattttttatcatgatcgattagaatgtttaagtgaaacttttcaacagaatgtttaattttaaaattgaaaattttgaaaactttcaactcaaattatgaaaactttccaacagtaattgaaactttcaactcagaatttaaaaagttaccactcagtatttgaaaacttcagtctcacacagtagcaggcaaattagcgtacagcaaaatgaatcaacactagcacttgagtccctagaaagacttatacgaattgataattgcagcgtcatcctgcttccagctaccaaactttgtggattcacatcttcaccatcgccgttatgaaaatggcgctcagaacagaagctattgcaatccgtttcacgactagctttattctgtcagtaatggacacacaaaggcaggagatgagtttagaaaaaaaaaatgtacagcacgttacatacatatattatactattttagtcagcaaaagaaagaaggcattattaacacgagattacaatcagtagtgcaaatttacttacccgtaaccattaactaggtgcttaagttcacggtatggcggaagctgcctgagtatcctttcgtcctccaggttggagttctcaccactatattccagctgcgatagcagatggaacagctcgattttcttctcctcgacttgtgccctaaggctagcaggttctttgttgctgataccagactccccgttcacagtaggttctgcgtgaggaaaatgccggtcataccaggtcttgacttgtggcctaatgctcgcagggatacgagacagctccagctccacatccacgatatgttttgattgaggcaaatgatcatgctggccatacaaggagttgtcagcatgaaggtagaaaagatatatatgagaaaaataaactaaacatattcgatcaaagttgtcagcatgaaggtagaaagcttgaatgcttggttcaaatttgttagctaaatttctaatgatcaacgagtacatgaggcaatttgtgcacaaggttagagaaggaaacatagagtgcaccttctctttattaccaaatttgttagctaaattttcttctaatgaccaacatgaatagcttaggcagctttgcacaaggtcagagggggggagtgcgtggaatcatttcagtattaacatttaagcaggtaatattgaaatcgatgtcctaaaaagctgtatgcgggtagaataaggaggattgtctcctcaatgtccttatagtttggaactaaaacctaaaactaaaggcggcggagaatgaagaaacataccctacttcaacatttaaagaagagccttgcaggttaatgacaagatcggcttagaaaaagggaacagctctagagataatgaagctcgaagtgctttccgatcaatcagtagcaattaataccagttaaatcataacggacggggcctagatgagtttatagtactaagttttcactactgtcacagggaggtgttgtgaggtagagtgttgtttactattgtcattcatctcatgtgttgttactagaggggcttttagcaagctagctcagatgatttagcttcaattaatataattctgctttctacaatttaatccatgttacttgttactaagctcctaatctggtcacattttttttccttggtagtgatgaagtcctcattgggtggagatggaatgacaggaacatcaactttaaaagaaatagatttgtgaccatgtgttgtcaatagagcaatgttatatgcaagtttgtgtgtaaactgtagttagtatatgatgccaactgctatagatttagtccagttgacgtcaactacagatttagtcgagttgttgcccatggagtaccaaaggttgtgttgttaaattggaggtcattaagtcaaatgtttgcaatggcaagcactaattacttattctgcttgttttaaaagtttgagaagtttttcttgtgactatattggaatggtttactggaataattactaactgaaatattttggtcctattttatttttttcacgcttataagttagtttttagaaatatttttattttctttaaagtttttcaaattttctgtgggttgtaatttttgaccttgtcatactatttaaattcgatttttttgtgtatattaattcaaattttgggtaacattactgctacaatccctgaatgttatttaagttatgaactttacatgagacatttctatgtgatccaaacagtaacgattcctacacccacagtggagatggattgggaggggattaacccaatccccccacctgggtgtatctccacagggaaaattcacaatcccccaccagggtgtatctccccagggaaaattcacaatcagcagcaattaaaataccagttaaatcttaacggacggtgccaatcgtgtcattaggtcttaaaattgttcagttatatttttatttattccaaatcgatagataccaaacaggatagctcgtcatctattgccgagagaggacgacggtaaaagggaaatcagggacaaacgagcacatacctttttattgtttggagcagctccggcggagctgaatgagcggaggagcggcatccggccgccggcgccggggataagcctcggcaacaaccgccgttgttcctctctaaccgccggcgacggcggtacgaaagccgtcgcctgttgaagggcgcgaccgctgaccttcctcgccgcaaatcgaagcgccgccgccatggacgattccgctgcaagatccctgggcggtcggttcctaagctcctatatttactccaattcctcgatccctcctcagatctgaatttggggccgcaagacaccaggtttgctatatatgtacgcacactatcagatacaagtcggatacaaggagccgagaccgacgccgtgtcgtgaccaacccgcattcgacttactacatatccagtccagatacaagtcggaactcggtaagtaattactactatttcgtgaacaacttatcttgttatcttaatactaaatatcaatcttatcttatctccatctatcttctctgtacatgccaatgcgttgcaacggaaaaatctaccacgccttgagaatctcaaatcggtaagaatcaagtctaatttgatatattaccaaattaatcgatagaatcgagtctaatttgatgaattagcataggatttagaattcagccttagatttatttttcgagcctacttagaaatttatccaacggagtttaatttaaaaaatatgaaccatatttgataaatattttagtcaaaccagggaattacattgcaatgtgacggaaaaaaaatcatattatataggtacacacaggatgatgtgacgaacaataacaactaatttcaacactggtgagaaaaatattgacaaattaaaacaacaatctctgaattaaacatcgagtttaaaaggaaaaagttcacaataaaatgatattgcactttgataacatttattataatatactctacaagtacagaaaaggtaaaggaaatcaaaattggctcaaaataatgccaaagaaaattctgtaaatgactaaatgaattaaatcaacaggaattaaataaaatcttatttcagcccattacttccgtaactggcccaaaatatcggcctgacccattcagcacgagcgcgcagcaagcggtgcgcgacccatctaccggcgatagctcgatgcaaggcgaactgagtgcggcctagttatcttccgcggcccaaagactgcgtggcccaacagcagtggtggctagacgcggggccgatctgagccgtctgatctgatggacggctcagatcggtcccgcgtcgatgaaatcatcggccggaggggggatgggtccgaaaaccttaaccctaatcccctttctcacctactctccccgatgcaaactctggcgacgcgagagagtggatggcggtgatggtggtgacgacggtccgttgaggtggagtacgcacgcggcagcgagcggctatggcttcacaggctgggaggcgctcccgagggcagcgccatgcgaagccacggcgtcgggggtccgacgaagcgggtgcgcaagtggcgacgggctccgagagcggccgggcttcgtcgatggagtgtgggggtggggcgccaagccaacgcgaacgcatgggacagaggaggaactcctagatctgcgggctctaggagcttgacgcgaccacgaggaggtgaagtgtgcggcggtgctgcttctcggcgagacccacacagtggtggggtttgccggtagaattagggctccaaatctactaagaatccaaactcgagcttaattttcttactttgatttggttttggatttgattcggatttcggggcttatgattcttttcaatttggggatttcgggaaaattgaaaccgactgatctcattcttcccttcccataatttattaattctactgacataaaacatgaaatttaaaataagtctaaacatagcagtgcattatgaaccctaattcaatattattaacttaatttgaacatgaacaggagctaatctttactaagcagtaaagataagaagctaaacagattagattaaacttatttgactcaaaattgttcatctcgaatcaagatgggaccgatggcttctaatcatagggatgatgtgaataaggaattgagtaggttaaagttaagctctgacagcacaatgttagagttctaattcaagatcttattgttttaacctataagcaatcacctttcaattacgaaaattaattctctgacctaagatgaagccattgaagtcgatgtctggtttagaaataatttcatttagaagctgaaataattttttagcaactttatttggctaagaaggcttataaacaaatttcttaacattataagcattaaaattggcgggatttagttaaatttgcttttggcccacgtcttccgaagccaacccgtcttcgcgcgaatgcactgtgtagcggggacccatcaatttgatggcccgcaagtcaagcaaacaatcgcggcccacatacgcggcgacgacccgatgcacctccgcgctccagtggctgcgtaattagcagcggcggcgatctgacgcggggcgaatctgagctgtccaatctgatggactgctccgatcatcccggcgccggatgaagcgtgactgggagagaggggcaaaaccgtagctcccaaatccttctctcctgatcctctttctctctggcgacgagcgagcggaacaacggcgaaggcaacgacggcggtctggcgagctggtgtacgtgcggtgacgaatgccaagcggctcctacttcaccggctaggaggcgcacccgaggacggcacctagccgtgtcacggcatcgatgatccggtgaggcgggcgcgcaaacgacgaggtcctcgtcggcggggaggggggtgggtgtggggggagggtgcgacaccaagccagcgcttcccgtctccggcaagggacaatggcagggtgctccaggacagcgcgtgcacggggaacccgacgcgactccgaggaggtgaaggtgcggcgatgccgcttcccggaaagctccggttagcttaggggcttcaagtctggtaaataacccgaacccttaccataattgatttggattttgactcttagggttcttacctgaaattaggatcttcgaatttgggggaattttgtcgggaaatttcagtctattttattccctcttctcgagtttggggagtttcaatctcgtttatctcctctttaattttgggaatttcaatctagtttatcccttttctcaatttggggaagctatttgtggacccccgtttttataacaggaatcaaacgtgtaaacagtaccatttccctggatcaagtagtttggtacacacgaattcatacctgaaataccaagtgcacatacatgagtgtctagtacgaattattacatcataagcccacaggcatagttttaaatcatcggaccgagcggtccggaatacatcccaaaaatagaagtagataaggcagcggagttaaggcagcggcacgccattgccacaggcaacgaccgtaactaagacctactgagcgccatcgtcttcatcaccctcctggtagtaagcgtagggatcctccgaagcttcatctctgacctctaattaagtttgtatattgcaagggtgagtaccaaccgtactcagcaagccaccacagcaacaatgcacatgacaggggtattcaaaggatggctatggttctttttgcgcaaagcaggttttgtaattcttttcatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaagaaagataaacggcgcagacggctccacttcacaggcagcttgaccaaggctacacctaatcctccacaccttcagcatcattgtagaactcttcctctgatgaatgattgcaaggtgagtatatgacatactcagcaagccacgcagcaaaaatgcaagtgcacaggataacaaaggatggcatagtagggtttcatttgcaaaagcagcatttagcaaatatttcagaatttaataaaacagttaagtaataattaaacaatattaatccaacgctatacaacataccctgttgcataggcccaaccactctgaacaaccatcccggccgcacagttctatctccaaaccaggaatataccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatcaccgccacttctcagtctggtgccctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaataattaattaaccaatcacgattgaccatcgtgaactatcattaagccatcattaaataatagtgagtcataaattatcccaatagtgagctaatgtttctaagcagggctaagcaattatatctaatatctagttgaaccaatatatataaagctcaactagtccaattatattaacccaaggtatcaaggaataaagtaatcaagaacaaaagggctataacaaagaataggttaattccacccaatgacattcgaaaataaatgcaatagttgaatagaaacaatagctttaaataggatcaacatgttcaaagggttgtttgggatctgtgtgacttgccttgctggccttagaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaattcggattaaaacacttatattgattttaattgaattatgacgcaataatgaattatttttgaaaaggaaaaagggaattattgcatcagtggctagggtttcgcggtggaccgggcgcacggcggcggttcacgcgaacggacggctgagatcgatccatccaaaacggacggccgagatcgatcgggtccacggcggctcacggcagacggccacgatgacattagcgatgacgtcaccaccggcggcggcggctcggcggctcggacggcgcacgcttgccggcgaacggcggcgcgaggacgcaaacggagggcaccaacgggtagagcgcgacgcggcgaactcaccggtgaccaaaagagcggcggaagaccaacggacggcgacgacgacgaggttgaaacggcggcggagatcgggtcgacggcggcgacggtgctccggcggtctccgacggctacgaagaggcggacgaggacggcgacgacttggcgatcccgacggcggtcttcccgagcgacgacgatgactggaacggaggcggcgcacggctggagcgacggcggtgacggcagcgctagggcacacggcgctagagcgctacgggcgacgagaggcgaaggcgagagaggcggcgggtagaggagagctcgggggtccttttaaaggggctaggaggcggcggcgaaggcccacggcgaccggcaacggcgaaggaaacttcgggaagaacgaatccgaaacaaactcgaatccatcgatttccaaaccgaagtagaggatgattccaaaagagaaaaggtggaggagatcccggagattgtttcccctctataaattcggccggaaacggaaagggagcggccggatttggaaggaaacggcggcggcggctcgctagggtttcgggcggcggccgacgcgaggaagacgacgactgacaagtgggacccacctgtcagcgacagcaagcgcgcgcgcgcggctgcggcctgggctgggccgactgggccgagggagagagagaggaggttttgggccgactttcggcccaaagccaaaagaagactttttaaaacctttttcaatttaaattattccttaaatgcaattccatttattaaaaatacttccttagctcaaataaatcccagaaaaatctagggattatagaattaagcaaagtatttaataaaattttatctggccccattttatattggaatttattaattaaaattagatcttctcttctaggcttttaaaagaaattctaaaaattccatttaaacaacaatttatatattttgaattttcagggtgtgacatttcacaagcctaagacctagcacagactgatcaaattttagtaccagtgttcatattaaacaatgacggttctgtccaccatccattgtgatcccaaggatagcttcccgccatcgagtcgtcatggttttctgaggacgtccaccttcccgcctctcaggaagtggctccatcagcatagaaatcattatgcaataccccattccataccagttaagaattttgagtctagccaagtgtaatacatgtcccggtgctcaataaccgcgagcacggctattcgaatagatttggtttactcacactgcagtggatgtacactttacccgcactccgcgactgcccaatacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctcacacacactcatggcagtcctaccaatggcgacaccgctgtagggcacgcctctcggccctacctcaacgactgtcccaccgtagcgcacctgcctcgctcaggggtgaaccatctatacagggatactgcctccgctcggctatctaatccgctaggtctatacccatacgagaagtgcggttgtacggggggttgtttcatgcttaacttcatggctcggtccttaattgaccggggacggtactagccctttccagataccacccaaatcctccgtccgccccagtcgaaaacagttgtttagttttatttctcctttcgcaaatcatgtcatcaatatcatggcaatgtggtgctcatgtctccacatgccgcatctcaattaccttcccaaaggtaattgcccaagcatatagcatttgataaatatgagtatgcataattctagaatagcatttctaagcatttgtcatagttgactaggcactcatacgtaaacatggttacgaaggaataaggggtaaacaataattaaggcatggcataatcgcaagtaggatgttcatcattgcatgcaattttatttgtaaacaaaacaatttcgcaattgagatcaacatgtttaaggaatagtgatgacttgccttgctcaaagtcttgcgggtcttggccttcgcttggatccgcaattccctcgggctctatagttacgtgcgaaaattgatttgaattcggttagaattcaaataaaatccaagtaaatccaagaagatatcaagcgcgaaagtcggtttcatacattatctattttcgttcgtgaaatagagctacttcgtttgtttaactccatccatccccaaactattttgtagcataatcattttactagcgcaagtttttaatttaatccgcccgggtattatatccatataataggttagaaatttctatcgcgagctaaatatcggacgaaatccaagaaatattatacgatttaatttagtctatgactaaatgattaaatataatacatggctaaaatccctagtaattaaatccgaattttctatcgtgaattgattacttatagagattacccaaaaataatctataataatctataagaattcatctatttgtttagttattaattacatctaaatcactaccgcgaattgatttcttatagaaattaccaagaataatccataatctatattaaattttgcaattcttcgactataatcaacctataattaaattctaattattttaaatttctaagcctccttaacctcttatttattttcctttttctttttttttctcttctctcttttcttttctttttctttatcttcctctcttttctttttctttttccttctctttctctctctcggcttctcccttcctctctctctcccggctctctctctctctcccttcccgaggctgcggcggcgacagcacgcatggcgggggaaagggcggcggcttaccgacggcggcgacggcgacggtggtgcaaggcggcgatgcacggcgcggcggcttcgaaggcggcggcgcggcggcacgacgacggcggcacgtggagaagggggagagggagaggaggagggaagggagtggggtggagaagggggaaggggccgggggcttttataggggagagggggagtaaggggagagggaagagagagggggcgggtgacgcgacggcggcacggcggcgcggggcgcgaggcggcgatgggacgcgcgctcggcgacgggacgtcgacagcgacggcgacagcggcgacgtgacgggcggcgacggcgcgcggcggctcggggcgcgaggggacggcggtgcggcgacgcgtgacagggcacggggcgcggggcggtgagcgcgcggcgcggcaacggcgatggcgacggtgcgcggcgcagcggcggcggcaagacgcgtcggcgacggcagaggagaggcggagcgacgcgcggcgcgcggggcgcgaggcagcttggcagaggaggggctgggttaggggaaccgcgtcgagcacctagagtgcaatgaacagtgcattttcctatttttctcattttagtctatttcttttataaatttgattccacaattcctaatctttgcatatatgaattttactcaatatttgtgttatcttaattaatgcattctcccgagactaatattacccatattttatataatttatttgaatttttaattagggttaattcttattccatcgcatttaaatttaattgacacaaatatggtcgtggtaatattttatttatttcaatccacacctaatctttattttaaattataatttatttatttctttaaccaacctaatttcaaggttaattcctaattaatgtttcctctatttgtaatcgatgaactccgagatcaaaatccaataaaatcatcgaataaaatcggtatgatgcaatttatttaaaaagttttcgaaggcccacattttttttagagtttagatttttgtcggtcaaattttcagggtgttacactattgaagctgatgtctggttttgctttttggtttgtcacctcttctcaatgccttttcacatttttatttgtaacttgtgcggctcaggggcaatccagatagaattcttagtttgttaccaccgatcatggtaacatttaaatctatctcttattttcttatttgattcgatctctgatctcttttttttttttgcaaaattttatgtgtgatgatcggaaagttacgtattttatgagtagttcagattgtattatactagaaaacatgcccatgtgttgcaatgggaacaaattttgtaccaattattaattatattgtacggaatgatgttaaatattttaaataatgatacaaaatggaattgctaaatgtccattggtagaaatttgggtcaatatcttgcaaatttctaacattaggatttgcttcatgatttgtgctttggtgatccctggtccttttcccccagcttcagcgatcaacgatggctcgacgagttagggtttaaggtttcgggttagagtgagggtgggaagggaggttgggggagagagaagatcggcgagtataggcctgtagggggatggtcgtgggaggcagtggaatgggcgggcggtagggcaacggcggcgcctcaaggtcgagaatgggtggtgggtcggtgctagcgttaggggcaaagcagaatgacgggataggaggtagcggtctatggtggtggatccgctgcgcgggggcagctcaacgccgctggcttgcggaaaaggagaggaggggagggaaaggaagagggggacactcgtcggcactgttgacgcatttcagccatctagcaaggccaaaaggcgacgtgctagggtgacgacggcggcgcagaagggggagtcatgatcggtgctggtgatagtggcggcaacgtgaggagggggtcaataaagggagggaagaacggggttttagggttttgttgtcttgcacgtatctcaaaacaatccaacggttcaaaattcgcattatttttggggtggtctctagtcaaatgatatgtcatatgggtagacagtaaaaaataaacatacatgggcaatcgcactgctaccgctataacccaagttgagccagccgacgtggacatgtattgcgcaccatttgctgcccatcgtcagtaactgatcaataggctttggttaaaacttcggaaagcaattgagtaataggattgtcatcaatgctttttcaagagcatatggttgtagtcatttagacctaaacttgttgcaacaacgtggtaaaccataaaatacagaaaaataataataataactcctacaaggaatctgttaatccatgatgaaaaatttccgtcacggatcatcaaaaaaccgtcactatgcagcatctgtgatggtttcagagatggtcacggattgagcgtcatggattaacctctatgacgatttaccaaaaaccatcacggattaatggaatcggtgactgttttaaaccatcacgatagagcccgaggcctagttagcccagcccaagttcatttctatgacgaaaaataaccgtcacggattgaatgccacatcatcatggatgcggacatggttgcttacgtagacactacctcaacctatttattaacaggccaaaatcaaagatgggccaatttttagcccaatttcatccattttcgcagctccttttcagccattttggcagctcattttcaatagctttacaacccatttcagcagctttgcagcccaattttgtcaccattttttagtgcccttttcagcccactactacatcgcttacagcccatatatacagcctaatttcacaactaaagcccatatacacagccagcagcaaatcaaatagaaatatcatttttccattcaatatcatatcacatgatttttcatccaacatcagattacaacattcaaagtgcatacaaccttgcagtttaccatggctcaagccaacaacaaatagagattccaagcaatgcatacaagtctaggagcttaatgaatgctgcggcagcaaaatgcaagcatgtatagcttagcttagtcaaaattgacttgacacaagttagcagcagcagcaaaatgcatgtagtagcaaaagatatagcatcatgcatgaattaacttgatcgaacttgactgagcaaaagattaagtttcgcttccatctcagattgagtcctcttcatcgaacttgtagacagcttgttttccatttgagtctagcaagcaaggagcaaacattgttgttgatgagagaattaaaaataagcattacaaagagcaaaaagtttgaaacttatcttacaatagcctcctatacagcagtggtgtagcaatttttttttcttgctgtagtggaactccttgaacaaatcaaatgcattaggttcttcttcattgtatttgtcaccctgaaaacaacatatatgcattatgtccagcaaatgtgtacagtgttgaacttaaaaaaaaggatgaatctagatagcatcaaatcaccgttgagctgatcaaatcaagcatgatccatggtatcccccaagtaagctgttttctgcacctctttttctttttgttggcaaatggattaaaacactattcagttttgaagatctctgaaaatagcagtcgaagttggggcgcttcaccaatcaccagcgcccctctcacagtagcaaatcccgcctccgccctcctgcacatgggtgaggcacatgcgtcaaaactcgccaagaaaactaatgcaagaaacaaagaaagaaaggcataaagcaagaattgaagactggcgcctctcctcttctttttcatccgtgtcaaaccgtcctggcccaccatgatcgcctgccgtgctccctatgctcacgcgtgcagcagtgcggcgtcctcatcgagcagcctctcgatggacggagctcgcgagatgtaggaagcaggcgcgctgctgggaggggatctgcgccctgacctgctgccggagaaggaggaggaggaggactcgtcggagctctctctcgccggtgcttcttgcgcttcgatccacgtcgccggtggctgctccggatgctgcgctgcacgcccccaccaggcccgagaggcgccggcggcagcggatccacagctcccgcgtccggcagcggtggagacggatgccggcacggcaagcggcgaagggggaggaagccggcgcggtgagcggcgcccggcggcggcggagacggaggccggcggtctcatctgcagtagcgcctcgcgtgtggtggcggcttatctgatttggattggctattttactaaaatacccatggtgcatccgaagttaccactaaaatatctggacaaaatggtcatttcacattgaaattttgatcaacatcctgccacactgaaagtttggcgccagctgctccttcgggccgccggcccagcgtctgtttttcctccctcctctcaattaatttcaaaatattaaaactgcaaatcgaattttatcatattaaataaacttatgtgaaaaaattgttaaaaacaaagttatataacttaatgagatctacaacttttgtttgggtcgttttgctatatgactttgtttcaaaattttgaatttgaattttaaattataacaacttcaaacaatattttcaaataataaattatttcaaatgaaaaggtcatcaacaacaaagttgtacaactcatcaatatttacaacttttgttttggtcatttttctatatgacttggtttgaacaatatgaatttgaatttcaaattatgacaacttcaaacaatattttcaaatactacatgatttcaactaaaaaagtcatcaataacaaagtggtataactcatcaagatatataacagttaacggggtcgattgctctgctatcgaagtcctgctgccctgagatcactcaatgtacatatggctaattcagcatacgagctatgataaagaaatataaatttggtttataatatatctgtaacttcgtcggatgaatcaatgaccaaaatataagttatagatattgatgatttatacaacgttgttattcatgactttatcagttgcaatcatttaggatttgaagctattgttcgaagttgtcataatttgaaattcaaattcaaattattgaaatgaagtcatatagcaaaatgacaaaaaaaaagttgtagatcttgataagttatacaactttgttgttgacaatttttttcatttcaaattatttactacccgaaaaattatttgatttttcttatattttaaaattcaaattttatataggttaatcaaactcggatggagaaataaccataataaatttgatagatctcattaagttatacacctttgtttttgatactttttcacaaaagttaaaattcgactcggagttttaatgttttgaaattaattaagaggagggaggcaaaatggacttctcggcgagagaggagtaaatgggcaaggccggcagcccgaagaaggaggaggggatggggaagccggcccaaggatcaggagagaggctgcgggctgagggagagggagagtaacacttgggccgaaaaggcacaaggatagggagagggattttaatttgttttctatttattttaataggttaaatgaactttgtggtattaaaactagttattgagctctaaaaattcacagaaaattttagagaataatttagaccacttagaattttacaaaaatatttctggccatgatttttaaaggaaaattttagtaaggtgatggatttaagtggaaataatattaatattcagtccactttggattctatggtaccttctcctaatactattaataatggtaagaaaggtaaaaaaagaaaaagaataataaaaattagttttaaacgaaaggaatcttttggaattgtgatgggttcaaggacccgaaaaaacataagtttatttcaaacataagtttatttctaacttaaccaaagaacatcaacttgactttattgctttgtttgagactgttaagaaataattttctacaactgctcttaacaatctttgtgctggtgaagattttttgtggtattgtaaacccactagaggtagatatggtggacttctcttgggcattaatttattaaatgctgatattggtttgattgatgagggtgatttttatattaagtttcatttgcgaagtaaggctgacaattttaagtgggccttagttttagtgtatggacctgcacagaatgagtttaaggatcaattccttgcagaattactgcacagtcatgagactttaccaattcttaatggtggtgatttcaacatactttgtagccctaatgaaaacaataatgacaattataatgatagatggccctttttttaatgctattattgatgggttgtgcctcaaggagttacaaatgtctggtaggaattttacttgggcaaataatttagcacatccaacctatgaaaagctggatagggttttagtgttgacggaataggagcaaaagtaccctttatcttctgttgttgctcttaatagagatatttcggatcatactcctttgcttctaaataaaaaatcttcctcttttagtaatgctgaacatagttttaggtttgaacttggttggcttttatgtgatggttttgttcatatggtaaaggaagtttggtctagtgttgatgaaggaaatactcctatggagcgttagcaggcggaaattcgccgcttaagatagcatcttaggggttgggttaaacataccagcggtatataaaaaagagaagacaacatcttaggggttgggctaaacataccagcggtatatacaaaaaagagaaaaagcagattttagataggttggatgcgctggataaaaaggcagaaactgttctcctgtctcaagaggaaattgatattagatggttttttaggaatagattatctgctatcctacgggaagaagaaataaaatggtattagaggtctaaaactaaggatattttggagggtgattctaatacaaagtattttcatttagtggcaaatggaaaacataggaaaactagaatttatcaattacaggatggtgatcaattaataaatggtgatgtcaatttaaagtcgcatgttaccacttattataaaggtctttttggccctcctaatgagtctgaccttcagttagatgagaataatattgctgacatttctcaagtctcacattt

SEQ ID NO: 70020 - DNA, 796 bp, Oryza sativa
cccaagattctcgtattccttcttcgctgtcccaaaaatttcattccccgtgctagattgaatggtcgcaacccctataatctcacgatcctcttccacgttggccagtctctctcgctcacgtgcgcgaaatttccatccaaaactgccaacgatctcatcgggaggcaaacgatgaacacagctaccgtgaatccataatcaataagagctcgttggctttcctgcaaaaaaaaataaaaaaataaaagtagagctcgtcggctttcaagatgtgcaccgcggcgtgagtgcattcacggatggcgacaccttggcccctcgaaggtagacttcgggtgaggtagaatcgaggccatgatgtcgctgtcgtggaggctgtttcgcaatggtgcagcatggatatatgtgcttcttcttgttgtacggcatcatcgcggtaccgcgcaagcaccaccttgcttcagagataaaatacgagccaaaattgatcatacacattgatacaatatgtggactatctgttatttggtgatttctttctaagcagttagctcacatcataacacaactagctacatgcatggatatagccacttttgattgtcaacacttgatatctgaatgcagatttaattgtttgattgataaggtatatcaacacaacagccaacctagtgtactagctagtgctagtattaactctaagatgacatgggagatattggagctaacaaccggatgcactattgaccttgctctgactcatcactgaatgaacaatgtttttggagtt

SEQ ID NO: 70021 - DNA, 636 bp, Oryza sativa
taatccaaatcgacgtatacatgacatgtcgaccacaaaccgcatattctcagtgcttaataagggcccatagtgtgagaacaacactccaacctcaaagaatacgacattgatcacatccctttttgtcctcaaatccgaaaatataaatcacaccctttttttctcccccaaacaagcacacacaccacgcctagaatccaacaacaatggagcttataaagacgggttctgatcactttcatctcttgtacgtaccgtcgtacgggaccaacacaattacacaaagcaaaacaacagttcgatctgtggcagccacacaagtccgggaagtaaggcctcctttgattcaaaggaaattcatatgaattttagagaattttatttctaaaggaaattttcctatatagtcctttgaatcaaaggaatggatcttatggaatcccataaaattcctatggaatgtctaatgctatgcaagttttggagaaattctaatataaggtagaacctcatggaaactttcctttgagtctttatctctcctctaattcctgtgttttttcttcggtccaatctaatggtcattcctgtattttttcctttgttttgtaatcctctgttttacacttgcat

SEQ ID NO: 70022 - DNA, 1632 bp, Oryza sativa
acggccctggacggacgaccgagattgctgctagctagagttttgctatccaatttccggtcattggaatgaacaatttaaattggctgtttaggtttataattttcgcggttaattcgttttatcacccctggaacatcgtgcgtatcacctagttgttcggcggacgtggttaccaacagaagccctaggaattagtgatcacttcgtcgcgcgcgatgaataattaacggatgaaccaattaaaacagctcgacgagacgacgactgcgagctctagctgtgcatgcatcagcaaacaagatagttatactgaccaaaacaagatttctatctaggattctggcaacgcagttggcgtttagatatagggacttaactttaatctctatatttagacactaatttagagtattagatatatactacttacaaaactaattacataaattaaagctaatttgcgagataattttttaagcctaattaatccataattagagaatgtttactgtagcatcacataggctaatcatgaattaattagactcaatagattcgtctcgcgaattagtccaaaattacggatgggttttattaatagtttacgtttaatatttataattaattaatgtccaaacattcgatgtgacctatctaaacagggtctcagacatgcagtttggcgcgcgctctctctctcttcgtcggtcgctttcgcatctctctgtctgatatggctattcgatgtacataccttcctataaattcactcatagatttagccgcagcatcgatcactgacaaccatcgtctttctctggttgagctagctagctaagctagccaggggagagctagagagatcgccggagatgagccagaagtcgtcgtggccggagctggtgggcgtactggcgacgctggcggcgacgcagatcggcaaggacaggccggacgtcgccgtcgaggtgctcccgccgggcgcgcccctcacgccggatttcaacgacaagcgcgtccgtgtcttcatggacgacaacggcatcgtcttcaaaattcccgtcatcggttagcttaaatgctccaatagctagcctatgggctatggcactagctgatctcccatggctgatgcatgcatatttctcctcgtcttatcacatctgttacatatgcagcgaaataatggaataaatggcgccgtgtacgttcatgtgtttttgctccttcatatgctccatctattccaaaataacttaatctaagatacaaaatgacacattctaaaccaacgaatttgaatttatcgttggtctaggatggatcacatcacatcctagattaagttatttttggaatgaaggaaggaaactttagctaaggatgtattcttttctttcctttctagtaacttttattccctcgttttttacatttacgctttccaaactgataaacgtcgtgttttttaaaactgctttaaaaaatatattaatctattttttattttttatttaatacttaattaataatacgctaatttttcgttccattttgcatgccaagaggaatgttgcgaccccaaaaaaaggcagcctgtatccagtgaatttttcgctgtaaatggtc

SEQ ID NO: 70023 - DNA, 1449 bp, Oryza sativa
ccaatgttttgagattctcaccaacaacttctcataatctcagactcctctaatcaggaccatgtggctagaccaacagtagatttaaccagaccgtggataaccaacagcccgtggagaacctagttagactctaattgacaatagtattgtaattcatagtctaaaataactaaaaagtacaaatgctacctgatgtcctatgcatcggggtagttctatggaggaaacttttttattgtttagactttttatttttctaaattttattaatagaccattccaaaaagtatttatgaaaactaaacctttcggcaacgccagccgagtagctggtgtggccaaccatggtggcgtggccgaacaacatggtcacgccaactgcgcgtggtgcgcgtggcgtgacaaagtttcagatttagaatttttttttgaaatggtctattattaaaaaataaaaattttctctatggaggaatgaccctgccatgtagcgccatgctaccgacgcaaaaaatgtttttttttaagtgcgcacatgataatgtgtatcgccacacaaatattcaccttgacattcaatatatatataaatggagatataaaaacatttaaacaaagaaatactgatgcgtgttgtttgtgtgcactattcagggtatgaatttgttttgttttctctatgtatatatacatgtacgtagaattttgagttggttttttgcgaggtctcgtacatgttatcgtgtccacagtatattttagtgtcgataccacagtagcaatgaacgcgctatgcagtagtacacatgagattctgttgctatggtttgagggctacttatgaatcccaaagtagtttttgtgtaatacaaagtgcatccggtcgtaatgcttccgcaataaaagattaaaataaaacaaaaaggatctctatatattattcatgtaaaagctatatttgcaaagaatatgtcttcttggtactcaacaatatgtgtgatttaattatcttccaaattatgtaaatcaagcagagttacacatgcatgaaaactaagtttcgaatttgtcataatagtacagaactatgttaaatgaaagctctctatatatctgcatgttcatataaagctatatatgcaaggaattttactttttcattagtagtatatgcatacataaaagatgtgatagataaaacattaaacaataaaatattgaataaccacaacaacccaatcaaacaaggaataaatacgtgtcgaccaatgattgaaccacacaataaaaaactatatctagccgtccctctcataaatgcaaacataacatatctttaggacagatcaatcatcgtccacacattgaaatgtggacctagtgacatcaatcaatccgtggataggtgttgccgacgggatgcgccagtaatgacggaaaggcatt

SEQ ID NO: 70024 - DNA, 1312 bp, Oryza sativa
ttcccaacccctcctcccgaaagcagcttctgtgtttgctacgggaggatgggaacatgtatagtgcgtacggaaaacggagtaatctattaacacgtgattaattaagtattagctatttttttttcaaaaatgaatcaatatgatttttttaaaacaactttcgtatataaacttttttaaaaaaacgcaccgtttagcagtttgaaaagcgtgtgcgcagaaaacgagaggaaagtgttgggaacacccccttgcaaacacaccgtttagctgttctttctgaaagatacgtggctagctgttccagtgctcctacaagaaatatcgtaagatccaacaggctgtggcaacaaaggagttgcctctaggcaaagatcagtgtgtcgagaagctttcagaccacttcactcatgtctagctccttttggtttcacaacccgataactcctagttgaaatggcagagaagacttgcgagtgctatattgagcaaacatcaaacttgggtacatcttcagggtctcaaatcgactcgctgtggccacattttgcatttcttatttataatataaacaaaagtaggcaaacatggacagtgtttaggccccctttgattaggcttataagccaacttataagtcgaaaagtctaagcaaaaataaacaagtagctttttcatttggcttttttaagccataagccactctaacactattaagcaaaagctaaggttggagagcttttttttggcttatatgagatagatgtatgactccaccactaaacttaggacattaaatcccctggcttataaatcatataaaccattaagctgacttaaaagtctaggccaataagcctaagcctaaacaaagagggccttaagagaccagacatttgtcttgacagtacatatctgactaggtgtaccgaccaatcatgcatacactggagtagctttgagcaaaagctcagttcggcgatgcgcagtgaccccatatgtttctgtaatatctagctcatatatgcctgttccattaggcaaattccaatcaaaatgataaagaaggcttgcgagtataatctccaaacaacaagtttttttcaaaacaaaagcaaaacaagatcacacaatatctcattgaaacgaaatcacacaacaaaatgattggccactcaaactgcaccagttggatcaagatctaatgtgcatactcttaaatttgtagccattggatcaagatctagcatacatagtctttatttcactaatctagatttaactctctcatccgctcttttcctccaaa

SEQ ID NO: 70025 - DNA, 1238 bp, Oryza sativa
cctgaagcttattgaaccggagctaatcacaattgctaggaactgaaaagaggtggaggaaacaactgtaacctgtgtaaggtcttgcaatatctccatatgacgagtcaatgtatgagaaaggacttctgagcctcctgatgatacccatgtctgcatttgagaatttacttgctgaagttgcttcagcgatctttctatatcggactcgatatcattctcagaaccatcagatttcatggaaatcaatttacggtaagcactcatttggtcatctaactgagcttctagcctccttgccttcaatgaaacaaaaggcacaattacttaaagtaaacaagtaatgcaaaaaaacgtcaacgaatctttttaacacattaaaccaaaatccaatattttcagcaaatgaaattgaactaagcaagggaatgcatcagatgattttttttcctcttaaagtggatggaacggagaatgtcatggagagatttaataataagaaacaaagctagcagtgccaatgtcccaagataactgctccaattcgtagatctgacagatccgtttcattctgttttcagttacacagtcagtatcacgggtttacctttctttttccattttcgagcgtgattcatggcaactatatgcgaaaaaaaagaagggtttggtaatgcggtatgaattctttcctaacacaggcttgtattgggccgtcactcgtttactttgtgcagaaacatccagtgtaaagtcagaacaccgaaatgacgctcatcccgcatgcatcatccatgtcaacaagtgccaacacccaacagccaagtcatccaaaactccattggctctatgtgcagtctaaacttagccgttttgaatttcgattgcatcacagtatcacacaccaatgataccccccacacagtaattagaaactacaaaaggatgccacagcctcataagctacagcaactagttgcgcaatgcacttcgcagcactagacagatagtgaaaatacatgccacaagtgcacctcaacatggagctttgtatgaattgcagcaatgttttcgctccgacaccatctagatcacgccttctgctcaagccttcacaggaaggaacaaattcccatggtatacaagtacaaccctctcttcagcgggaaattcgcgcccccgcaccggtcgaattcgcagataaactagaaaaagtacaactccgaggccaaccaaca

SEQ ID NO: 70026 - DNA, 6487 bp, Oryza sativa
cccccccccccccccccccccgcgcaaaagcccaaatgtaacacgcaactccgacgaccagccagatctcgagcttcagcgagcgggcaatcggagccagcgagccacgggtggggaggtcaggtcgacgagagccgagactgtggagagagagagagaggcgggggtggggggaggggagttgacggctcacctgcttgcggagggcgtcccaggaagacgcctccatggcggcggcggccgacggggcgcggcgcgcgggggatctcggtgggagagcttgggcttggctgctgccgctgctggatctctcccctatcggggaaggaggggagagaatcggagagagtaagtaggacgcaacgcagaggggaggacgaaacgggaggggtggttagttggagcgttggacgaagacgacgacgatggacgagcagagagcaattcgggtgccgaactggcgaactgggccgagaggtgccgaattcggccgccgagcgcccgagccgcgcgctcgtgcgccaacaatctccgaagtggactgccgtaaactctttttttttccagttttgctatatatttatcgataaattttctcccacaaatttgacagatgtcgtagtgtaattatactgtaactataatgtaagttgtatgcaactttcaaaaatctctctgtaacatattatttcgataaaatggaggtcgtggaacaaattctttcacatatgtgtgtgctgtgatttttttcttcctcaccagaataaatcttgtaatagatctaacgattcaaaattacgtgaaacttacatacaagttacactatagttacatacaagttacagtgtaattacattacgattgtactataattatatctgtcaaatttttagaagaaaatttgtcgacaaatgtataggtggcccttttttaatctactttgtaaagggagaaggggatctggggttggctagatttcagtcacctaaaattctcattgttttttttcctttaaaagaattctcatttcttctgttttcatttaattttcaccgagacttggagatcatgccctttttcttctccgacgacaatgctagctagttagattctaaagtcgagaaggtggttataagagttagagacagtgttttattttatagggatagcttggaggacatgcacagtagcgacagggcggtggtggcactggagctatgggtgaggagggccaacggtgggtgaggagactaacaaattagaaggtggaggaaaagggtgacacaagtcacaaaaacgccgaagaaaatataatatatgatgtctcaccaataagagagagagagcaccgcggaaaatggtgagacggaggaattgaagaggcaatgaatatcttcctcactagatcattcttggaatcgtattgtttgatattttatagggacgttttagtgtgatattatgtcaatctaatccttccattctaaatcaatggatatagattaatttacatataactaatcaacggattgttagttaatgggtgaaagcgaaaaaaatcatttcactattatcctttgttggtgctaaagcaatatacccgtctctattaggattaggacaccagaaacatcattataatcattattaacaagagtgtcatgctcagaagaaaagaaatattaacacataaaagttgtggcacaaggaaaccaatgcacatgattcatttattcaacagaaccatatgctaatagcagaataacttcatgttaaaatctaaatgttgttacatgctagttgtatttacaattcaactatgtttgtatccttgagctttcacgagaagtccagcactaattataagctgagaataaccgctagacatatgttgtttcgatgcaatgagtgtttgagctgtcaactaattgcatcgagatgatcgttgatacgcgtgtcggccgccaattgcatttgagataattatgatgaatgctgcaccgttgggttgattggtctgatgttgcaccagaaacatcatttattatgcatagtcttacctaaacaaggagctcaagttagcctagtggtgtaggcgacatggttgcatttggccaaccagggttgccttttttttttaaaaaaagttgttcgatccacccacccagttcataccggatggatggttcttaaagaaaaccgatctgatgagaatgttgattatggtttcttgtgattcaatcaatagaccggtccaatttttttttagcaacgggacaatgcatcctcctccttttacaactaaattacactatccttacaaatgtcgcccaagtaaactccaaaaacattgttcattcagtgatgagtcagagcaaggtcaatagtgcatccggttgttagctccaatatctcccatgtcatcttagagttaatactagcactagctagtacactaggttggctgttgtgttgatataccttatcaatcaaacaattaaatctgcattcagatatcaagtgttgacaatcaaaagtggctatatccatgcatgtagctagttgtgttatgatgtgagctaactgcttagaaagaaatcaccaaataacagatagtccacatattgtatcaatgtgtatgatcaattttggctcgtattttatctctgaagcaaggtggtgcttgcgcggtaccgcgatgatgccgtacaacaagaagaagcacatatatccatgctgcaccattgcgaaacagcctccacgacagcgacatcatggcctcgattctacctcacccgaagtctaccttcgaggggccaaggtgtcgccatccgtgaatgcactcacgccgcggtgcacatcttgaaagccgacgagctctacttttatttttttatttttttttgcaggaaagccaacgagctcttattgattatggattcacggtagctgtgttcatcgtttgcctcccgatgagatcgttggcagttttggatggaaatttcgcgcacgtgagcgagagagactggccaacgtggaagaggatcgtgagattataggggttgcgaccattcaatctagcacggggaatgaaatttttgggacagcgaagaaggaatacgagaatcttggggacggaggcattgatctgtgagggcggcgaggttttctcgtgggcaaaagagaaaatccttgcaacggcatgtgtcgaccccgcatgcggcgggcatggaactaacactggagggggaggggaaagcagaacggggcgggagcatgggatcggatgaggttggtgtgggccccataaattgtgttttctatcgcagctagcgtggtaaaccgtgctatcgctgggtggtagattagtcactcgctttcttctctctccttgtttctctcccttccatacaggaatatgatgatatagcatattttggagcccgctgaatcaccctactgtaactgctttcatgaacttcatagggcactcacagtgcgtcctaggtttttgaggagccaaaactgccacctaaaactaataacttcgtaagaaccatcctccacaatgcatgtgacctatttttttccttcccagtgggttctacccgttctctctcctctctttctctctgcctttccccacgggttcggagcgtccttctcaatggcaggagcaagatcggcggcgcggtcgtccttgcggagccgggcggagcagcgaaggcggcgggcgccgacggcctgagcggcaacagcaccgggcgactgtcgctgctcgggcggccgggcaacccgggacggatctagcggaacggccctctccccgcgggtccctgcggccgcctctcccctctggcgcttgcctctccgccccttcatctccccctccggcttcctcatccagcggcggtggaggagcccccagcgacgcgactggtggggcacaggggtaggccagcgaggtccccggcaagggcacgcagcggcggcggtcgaggacgtccccggtgatgcggtcgacaagctccccgagctcacgtggcggcgcggtgccttctctctttcctccgtctcccttccccctctctgttcacaagtggcacggagggggtgtaagcccacttctgcgaggaactggtggcaaagtttgcctccctgttcctctgttggtcacagcagatgctgagatggcgtggaatctcctacttggattggtgaggctgaagtgaaccgtagaatgattccttccccgttggatggtttctggacatgagtgaggaccaccaccaacttctcgccaccccgtcacgacgaagacgtttgctccgcggcacaccccgcgactttgcgtccgcaaccggcaaattcgcctgcgatccgggcccgagaaccccccgaattgaaacgcccaccgaaacacgaagcccttccttcctaacgtatcgcccacattcctccacgtctcccgcaccgccctttatttcccttctcgattctcatctctatccatagttccataccctccccgttgcctcgcctaaacccatcaccccacgccaccacttcgccaccgccgcagccgccgccgccgacgaagacgacgatgaaggtggtgcggaacctcgacctggagcggtacatggggcggtggtacgagatcgcgtgcttcccgtcgcggttccagcccagggacggcaccaacacgcgcgccacctacacgctcgccggcgacggcgccgtgaaggtgctcaacgagacgtggaccgacggccgccgcggccacatcgagggcaccgcctaccgcgccgacccggtcagcgacgaggccaagctcaaggtcaagttctacgtgcccccgttcctccccatcttccccgtcgtcggcgactactgggtgctccacgtcgacgacgcctactcctacgcgctcgtcggccagccctccctcaactacctctgggtacgcatccatccatccaccgattcatacccaattcaagtatttagatcaaccattcaatctctcatctgcatcgctgggtgtgtgttgtgcagatcttgtgcaggcagccgcacatggacgaggaggtgtacggccagctggtggagagggccaaggaggaggggtacgacgtgagcaagctgaagaagacggcgcacccggacccgccgccggagaccgagcagagcgccggcgaccgcggggtgtggtggatcaagtccctcttcggcaggtaggtaggtggtcgtgccagctgccatgccgtccagactccagagcttgatgccaccatgatcgtgtacattattattgcttcagttcaaaggctagttggtgaattctgttcaactcgtcggcctcggggaatcccccaagctgtgaacctgttcgttttctggattagtgtttaatgtgtccgttttgtgatgaattgtggatatctgcaaagactattgtgagttcagcgtgattgtacttagggtgtgtttggttgcaagccacactttgccacagtttgccacgcctaaggttaggcaaatttgacaggtgtttgtttgtagccacagttgtggcaagattcccctccaacaaattgggtcccacgtgtcaatggctcaaaaaagtgtggcaagattctcttaggcttagtaagttgtggctaacaatttgaccacctcaccttaggcaaagtgtggtaatttttgttggcaagtaatggtaaagtgtggctgggaaccaaacagtcccttaatttactagaagtactacagaatcagacgagtatttttgctccgaaggccacatgagtatttgctccgagggctacaggtgtttcgcaggatatttatccatgatagggtatgaaaacggttggagacgatagagtatttctacggagatgattttggtgcaatcaggaattttctatatacataaaatttaactatttggtgctaattttaatatgacacaaatagaaagtagaaaatctaaattttatagtcggaaataattgacaacgatattgtttttaacgaaaacgatatcctaccgttttttcatcctactgcaaaacaccgtggcaccagctcctgccttggtagtttaactgcaaaggacctggatacttagagcaaagttaataatatagtctattgccagctccaaaaaatagccatgtgtacacagtgtagcgctaatgtgtattatagaagcactgtagcataaatattttattatattagtgggacccatatcttcatatatctcattctctttctccatctcatccccttcctttcatgtcgtattgttctccagtaagtccagatgatgttcagtggcgctacggcggtgtggatgcaggagatggcagcagccgtgcgacgatgaggaagatggcggcagccgtgcaccggatgtgggtgatgcccgcagcccggcatgatgagggcgcccatgcggcggacgcgagatatggcg

SEQ ID NO: 70027 - DNA, 690 bp, Oryza sativa
ttgatgatgtcatcatgtcatcatcggttttttcctttttcccgtttttctaatagattaaatcttctgaaaatcataactaaataaccgtagatccgtttcaggtggttcaagttgctaaatttttctaaaatcaagatctacatgttaaaaatatccacatgtactgtttatgcttgtttttgtactgttttgttgaattttgttttttcgctttagtttccgacgttctggaggagagcgttttcgttgaggaaggttcggaagtgtttgcggaagctcaaggcaagtcacacagatcccaaacaaccctttgagcatgttgaacccatttaaagctaatgttttatttcaacttatgcattattttcgaatgtcatcgggtggtgaacctttcccaattaaataatggccgaagatgactttattttcctatgggttataatttgattagcatgaaccttatatattggattggttcagctaaatgttatatgtattttgcttagccatgcttagaaacataagctaactaaaggggttaaatataaattatattattattattattaattatgggtatatttaatggtcgcacacgatgggaaattgtgtggtgttaattaattgatattaaaacctggttaaggtgggttgtgagcatatgggtttgatggttgtgctcctggc

SEQ ID NO: 70028 - DNA, 928 bp, Oryza sativa
cccaagacatcataacctactctcattcttcagtaaaattagcaaccagaaattaaatgtgaatcccacaaaggaatttaaccttctcacatcacaagaacgtgcatataatttcacattcaaaagttgcaaaatattatatccctatgaattaaattcattcttccaatataacaagcaagatgtacacctcagaacaagtaacaatgagtgtaactcatcaatagaggcagtttattaatagcaccgtattgggttcaggaatgatctcctcaggatcctaaggccattcccaaccaaaatgtactgctacattacctgaaacaaatggagagttggcgatgactgcgaatccaaatcagaaaatcttgatgcctaaggtggacgggactggaggacgacaccggcaactacttggtttcgtggcggggccgcgtaggggtgggtgaaaagggagcggcggcgcggtggagccaaagggaggggcaccgcggccgcgcgagggtggaggggcggcactgcggcgtgagaggggagggacgccgcggccacgcgaaggtggcggggcagcgcgccggcgcactgggacggaggagatggaggcgcaacaacgagacgagtgaaggggcaccttaatcggtctagcgatagagattggaacgcgaaaatacggtaatacccttccaccaaaaaaagagaaggacaaaaatacccccaaaaattaacggtcagatgtgattctactacactactacacgcagaggcgtgagctgtgtgtttcttcggtcccatgtactatcaaactactcctgttaacaaatttctgcaatcatatataagttaatctcctcaactcaatgtaaatttaacgaatcttacaccaagatttcaagaacaacaaagatcatgagaataaactaccgattat

SEQ ID NO: 70029 - DNA, 15319 bp, Oryza sativa
tttgacggctaccgcgaagaggagtttgtcattgttgttgcacaacgtctccattcccacccaagcattttctagtgacctccacttgtgccctagctagtgaaggtgtagggccgtcacaaatttctcgaggttgaggatcctcatgcaagttttgatccagttgaccttgcattttctgccagtgatgtctcgagatctggcccagaggaaacattttcgttgcttgtcgagaacttccaaggattctttgttcaccttgagggcggtgagaaggtagacaggttgcgaggtgagcatagatttaaccaaggttgttctacccgtcagacccaggttcctccctatctacccagccaggcgtcctaccgactaatcgaagaggggctagaggtgcactttgtgcaatcgaccgagcattagaggtaggcctaaatatttcagcggaaaggctgtccttgtgacttgggattcccccaggatggtgtcgatgtcaagattgtcacacctgattggtgccaccagcgatttctggaagtttgtgcgaaggctcgttgcttctccgaacttctcgagaaggctcgtgggagcatcaataaattgtgttgataaaaaccacggcgcatctgcatagagagaggttcaaaggtgtgcatgcatgcctctcaaactgctgagaatctttagctccgtagctttgcccataatttttttggagtgggtcaattgcaaggatgaagaggagaggggacagtggatcgccctgacagagtccacaaccatggcgaatctcctcccctgggatgccattgagaaggatctttgaatgggaggttacgaggagggcccctagccaatttatccaccgttgcgggaaaccctgatgctgaagcaacgccattaggtaatcccaacgaacgaagtcggaagctttggagatgtcgagcttgaacagcagtgtgggtcgcttgttcctgtggtagcttcgagctaggttgcgcacatacgtgaagttatcgtggttgctctgtccacggatgaaagcgctctggctagtcaaaaccaaggagtgccgccttaggtgtaaggtcagcagcttggagaagatttggttgtttgtttttacaacctattattcattcgtttgtctaagaatcctcattgtcggtgccgagaatgactagaaatgcaggatcactattgttgcccaaaaggtgctcgttgaattcgtgcgtaacccactggttgtccaaacattttatggttatcaattttttttaaatacgtacattcagacaaggatgatacatgtaaaagaactggtcttttattccctatatatagctaggtgcttaattgcgcagtatgaattgcaaaacgattaaaagtacaatctacaatttcaatgctatttcaaatatatgaaaaataatggtttgaaaagaaaactggtgtgtacctgtgcattgatagctgagataccagagtcaacggtccgtaagccaacaccagaagttaagtatggggcagtagttcaaccacaatccatatcattccggatccggctcctctgtctttaggtgataaaggcatacgagcatagtaatatgtgccttgtgctaaagtgggaaacaatgattttgcagtttattgtggtaacaatggcaaacagtaaaagtgttgtatatatgtaccattcatgtgctactgtagtgggctgtagccatcgatatcgttagttcgctgtaaatttgacagctgaaaatattctaaaggcacagcattgtgcttctcctctcttcactgtgtgaagtcagaggatctccttccctgccgttactctagaatttaacatttcgtatcacaaataatataaacaggtgttatgatcacaaacgagattttcgatcacagttagaaggattcaagtgatacataccaagaaatcgagaatgaggtcatgatgatcttgtcgctaattacttttccgcaaatcctatctacaccgatgaaatgtttcgtaggagatttaggatgagacggccgttgtttctgcttatcgtacatgaacttagtgagtggtctccttatttcacccaacaagttgatgcaactggtaggaatagtctttcaccgcttcaaaagtgtacagcagctatcaggatgttaggttatggaaccgcggctgattaacttgatgaagtcttgaggattgctccaagcacttgtttagaatgtttgggaaaatttgctgaaggggtgattgaaaagtttggtgacgaatatctacgcccgccaagagccgatgaattggaaaaaatcttacaagaaaatgaggctcgtgattttcctggaatgtacggaagcatcgattgtatatattggccatggaagaattgttcgaaaggttgggcaggcatgttcactgtggtaacaaaggcgttcctactatgattcttgaagcagtggaaactaaagatcttcgtatatggcatgctttttttggtaccgccgggtctcaaaatgacatcaacgttctaaacaagtcgccactgtttattcaagcaataaaagaggaagctccaacgatacactacaacggaaacggaacacaatatgacatgggttactatcttgccgatagactaaaggcattgtaatataattattatatttatggttcataaaaattattgtaatcatatatcttattctatgcttgatagtattaatcaaatatatagccacacaatggtatacataaatgcatttgcagttgatcaaagctacatgcaaagcattaaacagcttacagacagaccctctatatgtgggttgtatgagctgtctttatatttatatctgtctggatgataacttcgaggttcttggagacacacccctgtctgtgggttgtacatgcccttaggcttcatatcacataaaatttgtatgagaacacctacatactgccatagcgcaatcaatacattgcagtgcttttagcaattcagaaagtgagaaatcaacacgaaacagaagcagtgcagttccaaattgtcttcagctaatatattgatgattcaaacagatgctaacgatgcaacttagatacaagagacgttcataatccataacaactccaactacaacactgaaccatcaaatatagctgattctggtcaatcttagccaaaggcgtttggacattactaagagcgacgtagcaaagagacaatcctggatacaagaccatataactcatttcgggttcctgagcacaatgatgaccgaatccccacgtaggaacatcttgctaatgaacctgtccttgttcactggaagagccttcttcttgcctttaccagtctttggtacctgcagcaagagaaacccatgttactgaaaaatagcaggaccggaaaatggaccaaaggtttagaacttcagataacaccatgtacctcagtccacatctccctaacattctcaagaaccatgttgcaatggcgatcaaatgccctcacacgaccaagcaacttcttgttgttccggcaattgataagcacctagaaagaagagtaaatagaatcagaacagtgcatatcatacaaagcatcaactatagtcagaacaaccgtttatggtgggctaactatgtaggcaactcctaaagacaacatttacactaacactacaacagaaggactatggtcaattattcatatacattcaaaaggcttcattaacataacgggctgtaggtaactcctaaagacagcatttacactaacactacaacagaaggactatggtcaattattcatatacattcaaaaggcttcattaacataacgggacttagagagcatccttattggctaacagagttgaggaaactacagttcattcacctatcaggaaaagaacacttccttttttcagaaatccagagttcattcacccatcaggagaagggcacttccttatttcagaagtcataagcatggattctgatgttccttattcctccttcaataattccatgtaaagatgtatttttctcttccattttgaatatcgcggtgtgttgatgacttttagttactaatgatgtacataaattttagccatgtgcatatgcttgtgattacttcatacattattttcaatagctgcacaatgtatgactaagctgtatgatgttactgtgttttcttatttctacacacattcaatttttacatcgattaactttcacagtttgtgtcaaaagtagtgatacattttcacaaaaatggttaaatttagcgaacttattttatttttgtttccaatgattttacatgcatgcagtgcaaagctaatagtatggaagcaaatcctatacaggactccacgataagtactaatatttactgcataatcaagatctcaaggatatttggttggttcagttatttattttttatttagacgtaattttcttcgaagatttgatagatggccttatatcaccctgtacagcatatatatgttcaatgttaaattgttaatagaagaactacaaagtatatgttgaactttctctatgaaataccttcagtctagagcaaaaccacctcaagtcgctgtgtaatttgtatagtgaagtgatcaaatcaagtagtagtcattgcacatgcacgataactagtagttaataagttagtaacattgttcaatatttccagtttgaggatgtaaaatctttaaaaataaccattatactaatatgatatggatttatgaacatagctaacatcctggacaacttgatctacttgggatgggtaagaggcaactctaactattccacgtcatataggtagggaacaagaattctataggcatgatgacaccgttgtaatattcttcatcccctcaatccaattagttggaacatgtaaggatgtacttttgcagaagaatacgtctaagtgaggaaacagagtaactgagctaggttttaaactatatttgactaattggctagtctgccggcaagaacacgtagaacaaacgaattcccggctaggggaaacccacaagtaaagcaacagtagcaaacaccacagtaaacagtaaagaagtttggctgaatcaaactccagaagaagaagaatcccagcaccaaccaacctgggtgttgttcttcacgctcatcatcagcacggacagcggccccgtactgaattcctcctcctccttcttcccctgctgctaggagagagtaagaaacaagagaccaggtaaggttagtagtttccccagaaaaccacgcgaacggagagaagaaactttcgagggttttgggaaggccgcttacagtggcttcctccgccatcggcagcgaaggcgggcgggcggccggcgagcctggaggcgggagaggcctctggatctggagctcaggagcggagacgatgtcgacgacggcgagtggcggcggctagggcaaactcgcggcttgggcacaagtccaccaagatatatcggcgcgacggctcacggcttcgtgggctgggtttggctggcctgttaggtatatatgggctttgggccttggaggtcgctgccaagtgcaaaccccgccccgccaggccgatgcaattattaaggaggcgactccgggggtcagtcgcgcgtgtccctccccgcgcgattggacatgtgtcgcgcacgaaaaagggatggcagacgcgccacgcgggagaacgagtttcccttttttttttttgcgtttttcgtttctgttcgctttgcctttttttccgtttttccctttctattcagtttggtttttctttttttgtttctcttctgtttttttttcggtttttttaaagatgtatgaatacaaagtttgtattcgtatgtataccaagctagtttatattcgtacgtatacaaagtttttatacgcgcgtatacaaactttgtatacatgatgtaatttctttttttttattttttaatatatatatatatatatatatatatatatatatatatatatatatatatatatatatatataaagtttgtataatcgtatacaaagtttgcatacatcgtatataaactttgtatatgtgtatatattttttatgcattaaaaatatattcatatatatacacacacgtatattcatatatatacatatgtatatacgtgtgtatatgtaatatatacataagtatagtagaaacagagaagagattagaggcatagaggggggcgattgactgcgcgcgtaggggcgcgcgactgatcgcgtatcagccgccccccaactccggctcggacgtctgatgtttggaggaaaatcggacgctgacgtcagcgtccgatttacatgtaaaaactactttaaaccgatttttctcttaaattacttatccaaatcatgattcgattgcatcattaaatttgttgcaattaaattttcaaaacaagaccacacatggatatattccgatgaattttttttagcttattattgaattatttttaaatgttgcacgatgttccaccaggtatatcggaattgtagatcgaaaatatttcactcgtttaaatcgggtgttgtttcaccttgtataaaaataatgtttcagcaaatagcgaaagaacgtttcaattcactgcaacatttgatccatacatagtgaaacattataagtacactaggtgaaatattttttggtggaacaaaaaaatgaaacgaattccccttaatagggggtttctaaaatatgtgggttttttgttgcaatagaatatttcagctcactgcaacattagatctatacatagtgaaacattgtgagtacactaggtgaaacatttttggtggaacaaaaaataaaccaaatttccttaatagggttttccaaaatatgtgggtgattttttgcaacggcgcgttccataatatcaaaatccactgcaacatttgatccgtacatagtgaaacatcgcaagtacactagctgaaacatcgtaaaattactggttgaaacattgaaagagatcatatgcaatattcaaaaaaaatatcaatagaaaggctaaaatatttttttatcgaaatataatcatgtgtggtcttgttgtaaagatttaattgtaacaaatacaacggtgtgatcggatcatagattggataattagtttaagagaaaaatcgttttaaaactacttaaagtaggagcggcagaggcgcgggcgcccgaggcgtccgatatttccttctgcagtcggacgcccggcgcgcagcattctccaattattaacgtcggtaagttcgagtacatgatttccctaatctctaatcccagaaatgtttacccctcaggaattcaaaaccatataaaataggtcccatggcagtatgcataagcggtttagctgacgtagcatcttagtaaaaaaaaaaagaaaataaaaaaatagtgggacccatgtatcatcacctactacttttactgttccttttcccatgccggaccacgcacgcgccagctgtcacaaccgccgccgtgctgcagcggcaaccgaccccgcttgcgtcttcacggtgaacaccaccgtggcggctgtcgcaccgcaccacgctgaaccacctccgctcgctagcggcgatccttgtgcacgcgccttttgccatagcctaccttgttcgcgccttttgcggtgaacaatgccaggagaatgcccccacggcagccgtcaccgacaatgtactggcaccacccaccgcaaccgcagctgaccccgcccgcgtcttcatggcggtggtggcggtgaacgccccacgacgaccgtcacaccctaccgcgcatccgctcgccggtggcaaccctcgttcacgcgtctcccagcacagccatagccgatccccacccgcaccttcgtgacggaggacaaccccgcagtagccgtcaccaacccgtgctcgcgccacccactgcagccgcagccaaccgtacccgcgtcttcgtgacggaggcgacggcgaacgccccctcggcggccgtcgtaccccaccacgctagaccggcttcgcccgcaggctgtgaccctcgtgcacgcgtctcccgtcacaatcacagctaaccccacacccactccttcgtggcgaaagaccctgcgacagccgtcgccgacgtcatactcgcgcatcccaccatagccgcaaccgatcccgcctacgtcttcacgacggaggcggaggcggcggcgaatgcccccacggtggtcgtcgccgacgtcgtgctcgccatcatcagatcaacagaccaacctctgcatcttcttctcctcgccatcatcagatcaacagcttcgctcctcgccatccaatcgattttcctcttgttgatgcatgcgcagacttcacagctctactcttctataaatcaatcaatgcccacatccacaggggatgtgggcacggctggcggcatgccggaggagggcggcggcttcgctaccacgggcgggggtgcccagtggcggcttgctggcatggaggaaacgaagagaaatagatggagaagagaggaagagaggaggaagaaggagaagtcacttgacacatggatccaatatttgtttttattctgccttgttgattaaaatgccacgtcagttaaaccacctatgcatactgccatgggacctactttatatggttttgaacatttaaggggtaaacatttctggtattggagattagtgatatcttacaggctcgacgtaaagttgagggatggcaagtgaacttattccttcgttgccacaatcttgacccagcctttgtggtaatgggccctcgcgtcggccacaatcttaccacggtccaacaaataatgggctcccatttgtacgcaaacaacgactgtttgccttgttatttggattccactttgggctcattttttgtatggtcctgtcatcggtgtcatggagaaaaaagttggcgccaatttgaaccttcccgcgcgattgccactccgtgctgaccgggcgtaagatcagcaagtagtaacaaaaaagagggaggggggattttaattagtttgctggttgaaattgcaagtgtttggtatttaaaatcaacatacagcacaacaccgtccttgttaaaaatgtatgtatacatcgtaaaaatgttgtggtcggaaacacgtcatccacctcatcgaaaacttcctttgtttaaaaaaaaaacttaaaattctagttatgagtttgaacagattttatttttttagagcaagtataatagtaggctataagccggctaaatgctgaggtggagaaaagaagagaggagagagaagagaaacgggctgtaaacttacaaccggcttggacacaggaactaagaaactctgtgtgagagacaagtgggccctgtattaattataaagagctaactattatataggcaggctgagagaagtctaaaaaaaacttatagccagcaggtcagctgtattattagcctttcttatgaaggttgtatgttacaacggtgtcacgggtgcggcgcccgcggccgggctagccaaaccgatcgatccatatgcaatcagggaacaaacggtgcgcgggtgcgacttgcgaggtgcctgcaaggctggcctagcttgccacgcacaaactatactcaagggagtagtagtagggtcgtagggaccacatgcatgcgcacgggcctgttttttttgtttaatttgacacgggtgaaaaaaagaataaatataattcacaggaataaatcatcgacctaacaaattgaaatacatataccatgtcccataaaaaaatacatataccatgtgcaccatcatgtacgtcgttatagacatcacgtcggagcttacatatttaatgaacatggttgatcaagcatgtatcgctggcctatatctcgaatacatataccatggcacgatgtaattaatctttgatattgtttaatagaaatggcctatatcactggcctcaatgaatattccattaagtaatgaaattacatacggccaggatgtacgtaaaatgaaaaaaaactaaacagcatgaacacatcatatatattgtcttgtggcagctttttctctctaaatagcaatatgcctataactatccaaaacaatgtcttcaaagaagccgacatttgtccgccaatgttgcccaaccaaccaaactattagttttgagctttcattctcccatacaacactttaaacaaacaaacaacaagcaatctcgaacaataccgaagaagtcatagctttcgcgcgcccggtcggagataatcatcttaagaatatcaccatttattacagaggaaggttgtgcctcctatcaaaaggacaactagagacaaaccacacactttctcaaaaaaaaaaaaaaacagagagagaccaaccgcacagggtaagtcatggtcactgctggagaaatccacaatagtcctggtttgcaatcccctttagtcccgagttgcaaatcggaatcatgaatctgggaccagagatgccgattggtaacaatcgacatattgattttttttattgttttttgctgtttgcatattgattttaaaccaaactcaacaattaaatcatccacattcacagaaacatcacaaaattatccacaaattcacaaatcgaatgaacatattcaatttgacataaaaaattcacatcacaaatttacagatccaaatatatcgcaaatcaacaaataaatcaacaaaaatcatccactcgtcgacatcggagcaaagccgcgtgggccgccgccgcccccgcgtaggccgccttcgctcattcctcgctgcaagaaaaggagaggataagagagaggaaagagagagggagagagagaagagaggaggaaagggaggaggaggaagttaaagatgaggaggagaagtttgcgatcgaggaggagaggataagtgtgagggattatatacaatgcattgatttttagtcccggttggtaaagatagtagggggccagactctttttgaatcgggactaaaaaaaatctttagttgcagttggtaacataaagtggcgttgggctttttaaccgggacaaggatgtttattggaaccggaactaatatgatatttggccgacccacgaaagatccgttatccagtagtgtcaccaagccgctttgaacttccactgcctaatcttcccgattaaaatggagtacaccacctatgtagccccttccacttgatcgccatcaacttaaagcttaccatgaacataacctatgagtttagatagaataattgagaactttgttttttaaaaaacttcatatttgtatattacttctcaaatttatgttcataaattttcgcttcatgacacataaatttgcaatttatcacaattttggaataaaaaagattctggcctgttgcattttattttttcttggaggaggcctcctggctcgagccttgtttcttgcgtcacaaaccaggtgcaccaccactataacggcttacaagatcaaaaagacatccccgcatcgcccgcatgttccagaacccaaacacaacgaagagacatatagcaagcaggagccgataaaggaggaatccatcgccgcagctgcttactcaccgacaataccccccaccccccgtgtctctccaccgccgctgctccctccttcgatcaaccgccgctgcaacacgctccaccgactccacgcgctgggccatttcgtgcgacgacgacttccacggccgccgacgcagtgacctcgccgccgacaaccccatctctcctctccagcgccgcggttccacgaccccccctcccccccgcgctgagaaaatggacattaagccattctcaaaacgcggtttcgttggaatgccatcccgaaacagcgattcgcgaaaatgccaatttaggccacgcgcactgctactttgccattttctcccttttagccattttccgttccattttcgaaaatgcaaaggatggggagatgattttgcccctttgtcctgatgttgaaatcttgtgtgcatcgagctggtcgagccatttcagctcgccaccgtgggtaagcgccaccgctaccgtcacctgcatcgccgatccacctcgcctgcaccaccagcccacctccacagcctccatccttccccagcagccgaagatcgtcgtccgcagcagagagaagaactcaactccaacccaagcccaaaccctaactagggttagggttatggtgatgcaacgagaattcacggcaggcaaggacaacatgtctcaaggtagttcctttcgtgtttccggacgccaattttacttgttttcagcttggccccagtggacttcctgttgtcaagtgcccaagatgtgggagatgcagtagtggagtgcaaatcgtgaaggcaaggtggtcaggtgtttttcaaatgcgagaagaacgaacaatatgttactaaattctccaattttgatttgatatgagatggctggaatttcagaatggtatcagaagtaattttcttaggttttgatgttttgacaggttccagaaccttgcacattcttcaagtggtatgatagttactagagaatggttgaaggaatggaactggattatattggacataatccaataccagttgcaagagctgtggcaggtgaaggtgacatggttgatgaaggcaagatggataagctaactaagtggatccagcttcttgtgttgatgaacatagggcaaggcctactagtgctgtttggtgtgtttgttatgcttatgaaatgatgtaattgatatgttggatgtaatagatatgtagtgaatgagctgtgatgtaaaaagaatggttaatgtgttgcttttggtaatatatgtgctctgaaccatttgtattagaacctggaatgagtttatgaaaagatgcagtgtttatggctagttgatgactctgaacaaaatatgtgttattgcagtgtttaaacctgtgggcagtatgttggtagtattttgccaatattatgtcaaactattggcagcattttggcagagtagttgcatttttgaatttatcagcacaattgtaggcatagcaattttagtgtcaacacaaaacaaaatgggcagaatgtgtgcacatatgccatcagatctgacattactaatacataggttcaaattaagctggttcagtgcacataggttcaaattaatacataaaccactgatcaagctcattacacttgtcattcagtgcacatggctgcatacagtttgccaaccaaatcagttcacatagctgtagaaaagctagatccaaaagctactagatcaagcacattttcagtttcttggctttttcttgggtgtaagtttccttggtgacctgcttggctctggcacaattgcaggctgggatctagcacctggattcagtggtgccttccttggtgacctcctacttagtcctgcaactggagctggctgtgagctggagcctgcctacaattgctttccttggtgatcttctgggtggtcctgtcggctgggaggtagagcatgcctgcatagatggttgtgatggtgttttgaagtgttggctaggagctagagcatagctgtagggatggatgtgagctagctcctccatgcatgagatgtgccaacctgatgctgaagcaaacaaaatacaatttttaacaacatttctaacctaagaaaacaagttacaaaaggtcccaggttttacctccttgtcaatctgccaggattatcttcaacatttgtagccacaacaggattatcttcttgccaccaccttcaagacaacttttgaacctaagttttctatttctaccagcagtctttcatggaagtggtgcacttagtacccaggtaaatcaacttctggccggtgtgatctgtcaccaaaggttcaatcactctcttgtatgcatttttaaacatctgcactaggtaatagggattcacaaagtcttcaatattcacatccctactctgttgtgcagtaatcaaagcaagtgcatgttggaatggcttccctatatgctgccattcttcacatgaacaatactgcaagcaagctttcacaatgtacttcccatgagttgtgctattgtcaacaacttcagctgtgaaacaataagctttaaccactcataggtggcccagacccctagtcattgcctttaactgttgtgtcactgcaggtagtattttcccctgctttttttttctgatatcctcattctcttgttccataggaccatgactagttccctatacttgtcaactaactcacatacagacaattctttgtaatctttaatccagttattgaagctctctgcaaggttattggtgatgtagtcacacttaattgcagggttgaaagcacttctcatccacttcaatggatggtatgtctcaagccactctagcacacaagggcatgctattacatgctagatgtgttcttgccacactgttctcctatatgatctagctgttgggtacatgtgagagtgaccatcaccaccaaatcttttcacaaagtttttcattaaatgccagaaacattccctctgctcagcatactcaaatacaatatgtacaactttctccaaccctttgcaagcatcagtacaaatagctaatggattaacatctcctatagccttatgtaactgtctcatgaaccattcacaattatcttcagtttctgcatctatgaaaccaatagctaaaggatacatccaagtatgcccatctatacttgtagcagcagctaaatgtccaggccacttaccattcagagccgtggagtctacactaatgtatggcctacaaccctctaagaacccatcaatgcaaggcttaagggcacaaaaaaaaatctattgaagtatgctttaccatcaacctcctttatgtaattatgtcaatctctacaacactaccaggtgaagtgcttaacacttgtgccctccatctaaatagcatgtggaagctttcttcccatgatccatacaactccaacattgccctttgcctacccttacatacagtgtcataattaattgtgcatttgtgatattcttgcaacctagtctataagcttttagggcccatacctggattattcttcataattttaactgcctttgaagctacccatttactagttgcagtagtggtc

SEQ ID NO: 70030 - DNA, 2211 bp, Oryza sativa
aaaaaaagggacgcagttaaacaaaattaaatgatgcacaaactacaacgaactcgcccatcaatcgcagcaagaaaatgcaaatcgaccaacaaattttaggattgaatcacttacccgccgagtagctattgccaagtgcactccatactcacagatggccggcgacgcctacatgcgggtgacgccgacggtgagctccttctacgccgcaccctctgctcctccacagtctaatcgactccgtcgccgacgagcaaggatgaaagagagcagacggagagagagatgaactcacacccagctggatctcgatcccctttagccactgagcaggggcaaaatcttctccccatcctctgcattttcgaaaatggaatggaaaatggctaaaagggagaaaatggcaaagtagcagtgtgtgcgcggcccaaatggcattttagcgaattgttgtttcaggatggcattctagcggaaccacgttttgagaatggcttaatgtccattttctccgcacaacagcatcggccttcaccatcggcaacgcgcgcgacacgctctccaccaactccgtagctgccacctcgccgtcgacaactccatcggcgctatttcctgtttcgcgtgcgaggacgacctccgcgcgtgattgcatcaacaaacgcccccattcttggtcgttgacgcctccggttcttcccgtgcacctccgccactgccgcctcttcaccgataactccgactctccacccgcgcgtccattgccgcgacgcctctccattgacgcggctgtgcctccttgtctgagcccgttcagcaggtgatatttcactgtgtttcccacctttcctcggtagcagtagaactcgtacgccgggagttcattgttgacgatctgttcttgaaatcgtttgttattctgatgatttattatggagtagtcaagtggatgaaatcggtggtttatcctgatgaatttttgtatagtatgttgacggctgttaagtgccaaaataacgtcgtcaatacctgcataaaaccataaatgtgaaacatccaacatagtggtaggatttatttctaacaattttcacgagtgtttgtgtatatttgtatgcaggtgatcaaccaccaaagttgggagagaatgagaataaagaatggaaatatattttgcgctgatggactcacatggttttgagctacaacatataaaatgtgcaatcatttggagccaaaacatggagtaccataaagtggggcccacatgttagcatcctgaagaaggatgtgggccaggggagccaaccagggttcggccgaacccctggttcaggggttcgaccgaacacccagctggcccagtctagcccatattcggtatgacggttgtactcctcatttcaatgacggttgtggccgtttctaccggtggaaactgtcatagagaggacacttgtcaagaggagatgaagctagaaggaatatgctcaaaggatgcttggagcatctccactctcccaaggtaactctccacctataaatacccctttcctctccctcattcacacacagcaaagcatgagctgaattacaaaaagctctagtgtactttattgtatattagaatagggagatagtaaggtagaaggaatctgaggaatcccggagttgtcggtaatctcctcttacttttgtatcttgttaattactctgctttaataaaaataacattatgagtaattaaggtttgcttagtgagaattacttcttggttagttcctaattagcatacggggtcattgttcactatagtccatttatttatagtgattgttttagtgtttgatcggcactagagtagtttttaattgcgttgatgtagtgtctgggtaattaatctctagtggttgctgcgtatcccacaatacgtttgaggtgggtgtagaggtggtgatagccctcaagagcacttaaatcctccctgtccgggtacgtagtagagcgacatctgagaacagcgggttgccagtgcctgaagtattgcattaggattaaagttaagctttccctatacactgtttctcattaggaaatcctctctgccctctgcccacattaactttgtatccttggatgaacctgacgagaagataatcacacacgttcccttggattagatacccttggaatactccgtaggtgaag

SEQ ID NO: 70031 - DNA, 12788 bp, Oryza sativa
ttgccagatctaacctagactcgctgatctagccttgggtggaggcggtggtagctcgacggtggagatggtacgacgacggccatcctgcgccccctccacggcgggggcggctcaccctgagggagggggggagatgctcaatgttggtggcgatgggaccattgcttcgcatttggggacatgtcctttccaaggcggtttcgcccctctccttgtgcatcatggagattcctcctgacaagttctgattaggtttgcatgaccaaatgaagctccacgttcttcacagggactcactccacaccgacgtggatcgaatctccgagctggcgaggtgaggccgaatgccatctcaccgcactgtgaatgccctaatagcgccacgcgccctacactcttccacctaaaatcatatttattactccctttgtcccaaaataagtgtacctaatataggatatgacatgtcctagtactacaaatctgaaaagacagatatccagattcatattcatagtactagagtactaggatatgtcatattatatacaatgtgtatttatttttggaacggaggaagtaatacatttccttctttacggtttatatataaaccgttagatcacacaacacaatgaatctcaagcactgattgactttaaaatgcattcgtgcagccaaagcatttgcagaaactggtaaagttggaaatgggaatatccagaagagttggaaatgggaatatctggcaaagtagtagaattaatctgagccatttattttttttaaatcgaagggatcagatctatttctactaccaacttataaatggtagtagaattgtgcaagctaaaacctaaacctgggttttcttgttctccatggtgattcaaggcggcggcacgaggctttttgttcctggtcgaggacagatcaacaatcttgtggcctgcaggctacccattagcagctcccgtgttggttttgatgtgaacatgtattcatgcatcttcatccaaacaaatcatataggaatagtaaaaaactgaatagcgctattcaagtgcatgagttgcttgacatatatggcaagtgatcctctcgccgcaaatcaaaggcaagagataaaagataatttctcgttctacgcgagatctaatcatgtgaatttctcgggaaaagaaaaagaatagaaagaacaaatcatacaaagaaaaattaccatcatagcctaataaatcaatggctaagattgtttctactggtagtatggtagtactatactaccaccagtagagagcactggagaatcactctattcagaaaggcctttggaaacaaacgacggatgcaatgaagcagatcttcaaggactgtgtggactcaaaaaatccctaagacttttttccttgtgagattatttgatcatattgtggaaggtggagcaaagaagcttcagaattatccacttgattggagtgaaaaggataaggcgaaatacctccttaagatcatggcaatggacatgtcgcatgtacagaagcttcaaggcataatgcaacaagcttcaagagagagtagtaaggagtagtatttgtcgaaacaagatttcggcaataataaaagggggtggctatcaagctaggaaagtggatgggtttagagacaaggaattttatacaggttcaggccttcttattcaagaagtaataccttactcctgtccggggatgattccgccgagtgtgttattgattgtatgactgggagaaaaagaatcgtcccgagaggaacccggacccatccttatataggggaagggatccgtattacaaagtacagtccatatcctaacagaacatgggattacagataaaatacaatcgtaaccgactaggatcccgggtattttcttgacatacaagtttagaatctaacccgagtcctcataaagatattctatctatatttggtaccatatatccagctggaatataaccgccatgtagatatggggtaaccataatctccacagtagcccccgagaccttcgcagttgaccaaaatagtcttctcgaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagcgattttatatcgaagcatgcatggtactcaataaaatacccagccgactgcttctcacttgaatatatcaaggacaaaaaatatgaaaagggccgaatgataaacattcaaaaggtccaaaaatagatatatttggtaggaatccgagtaagaaactcttaaaatgatccaccaaatatgataaagatcatggtaattaagaagttcattagcctaggctataacccttactataatcaaaataagcatataacatgctaggagaatgactactaataaaccagtcatctcaaactaacccaacagctttcgtagcctaaaaaagcttacaaaaatggtataacacctttctgtcgggcaccttttcatgtgcatcataataattccaaagaattattaaatcgcgttaaaaaggattttaatagcatcgggccgcatcattgtgagcacatattgccaaagcaaaaagcgcctaagtccctagggatcacaatgagccacgctgaaaacataattgggctgaagtactatacaggcccaggcccattagtactcccgataccctaaaaacgccgaagtccaaacgtcgtttcgtcttccccgccgagactctcgtcattccccactccgtgctacagtacagaaccgcgccgacgaagctagggttcatcaatctgctccaacccaccctcaaaaacttcacgaaatttctccccgcgtccaccgctccgattccccattcctctctagccatatcccggaccaaattaaaccatccagctcacactcatggcggaagaaagagaaagcttcgagagtcagtgggcgccctccgatgtgacagaagacaatctgaaggagatggtggcgcacggcgttctcccagcgaaggagatcattgggtggcgaccggcgttcggcgaagcattcccgacccccgacacacacgaaatcgtggtatttgctcatttcttctatggcggattttctcttccaacctcaagattcttccgggggattctgaacttctacgggattagcttgcatcatttgaatccaaactccatagtgcatattgccaattttatccacgcctgcgaagcttttctgggcattaggcctcatttcgccttgttccgccgcatcttcttcctcaagccccagccaaacaaaagcaaaccgtgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgccgtcttcctccggtttactaggacacatagaactcattgcccatgggagatgaagctgctcaggcaatggaattgatggaacgcatgctaaaactgaaggaacaaggtttgcagggagaacagatcgctcggcacttcatcaaaagccgattagctccaatcaaagagaggtcccgcacagcttttgagtttgacggcaagcatgatccaaatcgggaagatccagattctcttgactttaaggtcatgaaagaaagaatgtacaagatcttctcaaacgctattgttgtcagctattcacatctgctgcctgttgtgccattcaatgcattcaaccctcctccaccgatacgtattcatatacttcaacctttctcaaaatatgatcttgttttcttgttgaatcagttaacaatgaaggatattacacctaggaatttgctttgatgaagtcggatcccccaatcgctcaactccgatctccccgtcaccaaactgggcaagggagcggaggaccaagaattcggtctaaaactcaaccaagtgcttctgatccagtcggccagttagattctcgaaagaggaagctggttctaagcgacgacgaagccgatgataccatcaggaggcctgaagaccgagagacaaccaagaaactaccaaaacaggctactccaaggaagaaaacatccagtcgccctgcgccaaagatcaggaagtcttctaggtgcaactcatataacgacctctcttatattgatgcgcatccatcgcggcaataatactgataatcaaatttgcaggaaaccatctgatatagacccgtctggaaaagactctgacccgaccaacatggacacaaattcttccaaagaaaccgggccaactgcagagaatcgtccgagtgacaaacaaccggcaaccgacaatgtagaacctagcaacgagcccccgactgggaaccagtcggccgaagctgaagtaggtgctaaccaggagcccccgactggaaaccagtcggatgcagggccaagccaaaagattcccgaggttgaagctcaaacgaacagttctctcgggaaggatgctgacattgaatcagaaaccagatctcttgtgaagacaccaaagtccactcgtccccgaccaggaatcatcacaggtagacacgctatctgaaatcattttgatccaacagactttatttggctgcttcatcttcactcatgaatacactagggccaatgattggtgatgaggaggaaattctccggatagaagcagctgaggattcgcgccctcccattctagtcaagtggtgggatgacaacatgcatcctcaaggaaatgtaataaataagcaaaaagaggacgaggaggtatgcttgctgaaaaaggcgctcagccaagccacccgcattgtaaatgtaagctctttggtgcttgatctcaaccatctcgtttgccatttaatctaggcgctaattaaactgtcttgtagaggattcatcttaggaacgaagctaaaacggcaaccttagagaggctagtccctcatctcgggaccctcgaagccactaggagtcagctgcacgagacaaaagagcttgccaggaaaaatgagcatgatctgagggaccgaattgctgagctccaggaatccaattttaaactgagtggctcatcaaaaggtttgcgcaaactctacccaactgatatgtgctgttatctctgtaatcctgattaaccgaagttaatgtagtgcaagctgccaaaatatctcaattggagaagcagatccaaactctggaaaatgacaaggctgagctagaaagacagagggattcggctttaaaagaggttgaaggtaccaataatcaacacttcaaaagccattatcttctatatgctgattcattaatgtgaatctgttgatgcagaccgcaagatcaagtctcaagcacagtttgatgtcttagttgacaagatcaaaaaacttgagggagcccgggatgaggttgctaatgctgctgccctaattgttcaagcgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggacgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgttgtgcttaatatcttaacttagttcctgatttcttaaaagtttttgtcaaaccttgttgagcctaaaacccgcaaaagttgttaaaaaactttcagtcctcattgactaagccaagaaattaaacagggcaatgatacatcaagtaagcaaattgaattgataaaaatcacactccattattattatagtagccccctgactgaaaacttcaagaaaaaacttgaagttagcagtcaaagaggaaagatacaaacgaaatgcctaagcgtaaaatcgacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaatttttcgcagaaccaggtcaccgactaaaaaggctcgcgatcgaacattccaattatgataacggcgcaacccttgcaaatatcaagtcgactgaattaaagctgcttctcgggcttcttctagtcggttgatgtcgtctactcggccctcttcatagccctcctcattgaagttccgaaatcgtagtgattcaaattccacttcactcggcaacattgcttctgcaccataaaccaaaaagaacggcgactggccggtagcccgactaggagtagtgcgtaaagaccaaagtacggatggcagctgatctacccacttgccaacataggggcgtagtcggtcaaaaactcgtgctttgatcccttgcggtattatgccgttagcgcgctcgacttgtccgttactcatagggtgtgccacggaggcgtaacaaattttaatgccgaagtcttcacaaaagtctttaaatgctccgccagtgaatactcggctttaattccacgtgaggaatctgcatatcgtccagggtcttagcgaaaaggatgttgagcgcgctgccaccatcgatgagagtccgtcgaagcttgacattgcgaaccactgggtctagtaccagggggtaccgccccgggtggaccactcggtcgggatgatccgagcggtcgaacttaattgctatctctgaccaccgaagatattggggcgtgttaggctgaaccgcattgatctcccgttctgtcagcttctgctttctcttagactcataagccatgggtccgccgaagatgtgattaagttctttgcgatgatcttgaaaaccagtcggggcatcgtcttcatcatctttcttctttgttgtgccttgatctccgtctgaaggtttacgtgcgttcttgacgtattgctccgcgaactgtttgtagacgaagcaatctttggccacgtggttggagttcggatgatgcggacattaggagttcattatcttgtcgaaggtgttgacgcggggacgttgtcgggaagatggagaggtggtcgccacaagttcttcgggcttacgcttgcgatccttgtggttgttacttccactccctcctgcagtcggcgtgtccttctttgtttccaagtggtgcccgactgtttggacgcggtgatagcatcttcggctttggcatactcgttggctttttcgaacatctgcttaaccgtcctgggaggtttacgtccgaacttgctgactaggtcctcgtggcgaatgcctttagtgaaggcggcgatgatgacgtcgtcagtgatgtcggagatcttgttgcgttgttcggagaagcgtcggatgtaatctcgaagggattctccagacttctgaacgacgttgtagagatcaaactgtgtgccggggcgttcgaaggtgccctggaagttggcgatgaagtgatcacgaagttccgcccatgatccgatcttgccacggggtagtccgtggagccaggatcaggcggagtccgctagggccacaggtagatagtttgccatggccttgctgtctcctcctgctgcgcggattgcgagtctgtagacggtgagccaagactccggattagtggtgccgtcgtacttctcgattctagtcggcttaaagccggctggccaatccactcgacgcaggtcattagtgaaggcagctactccatccacctcgtcgtcgtagcgatttggtgaatgacgatgacctcgtgctgcacggcgctggttgattgtgtcgcgaaggtcaacgggacgctggtggggtggagagcgaggccatttgactcggcgctccctgtaacgttcgggaggcgagtgaacagatcattcgtcgtgacccctgctcctgcgactagatcctgtgccgatgatgctgaggcttggctgatgataatcatgagatcggaggtgagggactcggctaccagtcggggtgcgggtgcttgcggagttggttggaaccgaggcagcgatcatggttttcgtctggttcaagatgttgacaacatgatcagcttggttgagcgcgtcttccttgaggagggtgtcgaggagagtgattgctgcaactgcgttctgctggggggtgcgaaagaccgctgttccatcgacgtcttgttgcccaatgagctctctcgctcggcgcccagattccaaggcgcgttgccgtcgatcttcagcctcctttgcaatccgttcgcgatcttgttgctcacgctgtagtcgttctcgctcctgtcgctgtcgctcttcctctagtcggcgacgttcagcttcttgccatgcgcgatcttggtccgcttctcgggcttggcgctgttcctccgtttcgttgtcagccatgaatacgccgaagaagaggggcgtgtagttgtcctcatagctgtcgtcgaagttgtcgaggtcgccgtggtcgtagtggtagccgaaatcgtcgtagtcgaggatctcggtcggtcgagaactgacgccgggagagctaaggtaactatccaactcttccgtcgagactgtcccaagaggttggagtataacgccaacctctctggatatagattggatcggggccgaagccggagctcgcctagatcttcgagtgggagatgtcttggcagtgaagacagtggccaaatcatcaggaagtttcatcaggattgagggataggacccgtcgtcttgatctggtcgcggaagagtagattggatctcgtccgagtggtttgaagtcgactcgggagagatgatcttggagtaggcctcggccgagttcggaataccgaacggcacagggacctggtctctccccgactgatttgaatccgagtcaaggagagagatcttgccgaagtcattggtgatgaagttgaggctgccgaaccggaacgcctgcccgggagggaagacgaagtcgtcgatgctagaaacgggacccatcgcacttagttggcaaaaacttgacgctacccctacctggcgcgccaactgtcgaaacaagatttcggcaataataaaagggggtggctatcaagctaggaaagtggatgggtttagagataaggaattttatacaggttcaggcctccttattcaagaagtaataccctactcctgtctggggatgattccaccgagtgtgttattgattgtatgactgggagaaaaagaatcgtcccgagaggaacccggacccatccttatataggagaagggatccatattacaaagtacagtccatatcctaacggaacatgggattacagataaaatacaatcgtaaccgactaggatcccgggtattttcttgacatacaagtttagaatctaacccgagtcctcataaagatattctatctatatttggtaccatatatccagctagaatataaccgccatgtagatatggggtaaccataatttccacagtattacatcaagtaaatttagtatggtttaaaaaaataaatcagcaattagaatgtagtaagaactgaaatatatttttggatgttaccctctaatctatatactactattagaagacagtagtggtgggccaccaccaccatcacggacatgtttttttttaaaaggaaccatcgtggacatgtgggccacaatattaggatttgggggagtcgtctgtaccatgtagactgtaactctttaattttctaagcatgacaattttgttttttcagagatgaaaggttgcgcttcaaccaattaaaagtattgttttcaaggacttaattttcccattctcaattattcgttgcaacacataggcatcttaataaaagatgaaatccagcagcactagaagcaacaagcagtcgaaggaaaacatagaactaacagataaacacacttagaaaagaaggaaaacaatggagagagaggtggcttgggcacgcacagcagcgcagcagaggagagggcagtgggcggaagaatgaaacgcgtagagccaggttgacaattggaggagccggagggagagccgagcgcagtggagacagcggcacgggcggtggctcggaggagcagcgacgcagggtgaggccatcggctgccgtcgttgtttgagaggaggaggtgggtgtcggccgggtgaaggaagcgcgtgcgtagggttagcggggtggacgactgggtgggtgagcgggcccctccccaccatcgggcctgctccccttcgccaggcctgctctctgctgccggtccagcttgccgttgtctagatggcctatcatagatgcctcctgctccccccctccaaaaaaaaaaagaaaactagttgggccaccaatgtcgccttctcctggctaggtcatcgccgccaccaccgtagcttggcctagggttcggggatagggaaaggtagagaagggcacgagacgagtagaggaagagcagtgacgtagcgactggtgtgggagggagggcattaggtggcggcaaagtggacattagccacggacggcggtagcggagccgatgcgaggcgtgcatggccaggattctttagttgtcatgatttattcggtttccaggctcctgatagaaaagattgtaattgataatgttttgcgataggaaacgtataggaggttttgtgctcatatggtttgagaaaatgattcgaatttctatctagagtacaaatagatagaaattcgactattacttgcattaatttatgtacgagaaaaacaaatttcatttatattcatgatacaagctgactaattttaattgacaaacttagtacaagacaacaaatcttttgaaattttttgagttgtctctaaactcttttattttgcctcatctcaaacgaattcacttttgtccctcattttggtccaattctatcaattgaaaatcgatgtttttctgttggatgtaaaagatgaaaaaggtggcatgtgtgatgtgggaaatatttaatttgttactagttagtcaaggaccttggccactatggtgatgaaaaaatagcaattagatcatagcagtattctctcttagtctctttttaaacggagcggcacaaaatacaaactaaggttgtactaatttcattgaatataaaacgtcaccatctgtactataatgtagtaatttgagcaaatacgttaaatacggatcattcgatcattagacccaacggtccagatacatcccacgatcctccggatgaaatcattcgtgcaactcccccaaacccattcccgtcatttgctcaaccacgatgcacactctcccccttcgccgtgcccggcctccgcctactaccgcgcctcctatgccgcgcccaatggccgatctcctgatcccctttgccgctttgcacccactgtcagccatccactccatctcgccgtcgtttggatcccctcccacactctcacgactgatagccctgcaagggacccatgagggagaaggggtgtggcaatgacatctcccatcaccgccattttcgtgctcgatcgacaggtgcagctccctcgccagcatgatgcaacggcataggtgaaaactacaggcaatgcccatgcccatgtcatggacatctttttacatcctttcacatgtcgagctcactctcaccatccatttctcgataattctgttgttttaaccatagatttggtttttttttttttgaacgaaagacacagcgtgtctattcgttgaatatagaaggagtgttatttacaggtaaaaaaaaacaaggagatatttacagacaaagcggcattctatggcaatatcttagctaggcgtttggctcccaccagtgcccaagatctggactccttaatttttgcaataagatcaggggatagctccttgttcctaaagattctctggttccgctcttttcatatttcccaagagattaggaagactagggatcgaataccttttctggggacaccctagtgtgttgctagcttttccaaccagtcgtggactgatgtcgcttgtacccagttagtcggcctcatgtggttgcaggctatccaggtagtgatcgcttcttaaactctccttgtgaatatgcactccaccattaggtgaagggcagtttcccctgtgcaatggcataatggatagtaactgttgttttgccatcctcaagtttcgagtctgtctgatgtccataccctgttttgaatgattagtcacgcgaaggttttgcatttccttgaggcctagtctttctagattaaggtatcgaagtttgttttgagtgatccgaaggattgcgctttgtaagctaaggaggcgg

SEQ ID NO: 70032 - DNA, 4135 bp, Oryza sativa
attttacttgggcaaataatttagcacatccaacctatgaaaagctggatagggttttagtgttgacggaataggagcaaaagtaccctttatcttctgttgttgctcttaatagagatatttcggatcatactcctttgcttctaaataaaaaatcttcctcttttagtaatgctgaacatagttttaggtttgaacttggttggcttttatgtgatggttttgttcatatggtaaaggaagtttggtctagtgttgatgaaggaaatactcctatggagcgttagcaggcggaaattcgccgcttaagatagcatcttaggggttgggttaaacataccagcggtatataaaaaagagaagacaacatcttaggggttgggctaaacataccagcggtatatacaaaaaagagaaaaagcagattttagataggttggatgcgctggataaaaaggcagaaactgttctcctgtctcaagaggaaattgatattagatggttttttaggaatagattatctgctatcctacgggaagaagaaataaaatggtattagaggtctaaaactaaggatattttggagggtgattctaatacaaagtattttcatttagtggcaaatggaaaacataggaaaactagaatttatcaattacaggatggtgatcaattaataaatggtgatgtcaatttaaagtcgcatgttaccacttattataaaggtctttttggccctcctaatgagtctgaccttcagttagatgagaataatattgctgacattcctcaagtctcacatttcgagaatgaagcattaactaaggaatttactgaaaatgaggttaaggatgctattttccaaatggagcacaacaaagctccgggtccagatggatttcctgctgagttttaccaaattttttggaatgtcattaaatttaacctattagaactgtttaaagactttcattctgggagtttgcctttatattctctgaactttggtactatgattcttttgcctaagtgtgtagaggctatgaagattcaacaatatagacctatatgcttacttattgttagctttaagatttttaccaaagttgctattaatataattatggatgtcgctcaaaaggtaattactcccacttaaatagcgttcattcctgggagaaatattatgaaaggggtggttattttacatgagacattgcatgaattacatcgtaaagataaaaacagtgtaatttttaagattgattttgagaaagcttatgacaaagttaaatggccttttgtacaacaaacattgagaatgaaaggcttttctcctagatggtgtgagtggatagcatcttttattcaaggtggtcatgttggtataagagttaatgatcaaattggtaattgttttcaaacttacaatggtcttaggcaaggggaccctttatctcatattctttttaatatagtagctgacatgtttactctattgattaagagggctaagaaggcgggacttttgaatggggttattccccatcttgttgatgatggtttgtctatcttgcaatatgcagatgatactatcatctttttggaccatgacttgcaactggcaaagaatctgaaattgattttatatgtatttgaaaagttatctagcctaaaaataaattttcacaaaagtgaattattttgttttggtcagtcaaaggaatgttatgatcaacattctgatatctttggttgtaagttaggttcctatccttttaaatatctaggaattccaatgcattttaggaagctttctaataaacattggaaagttactgaagagagaattgagaaaaagcttagtagttggaaaggcaagcatttatctgttggcggtagattggtgttgattaattctatacttttaagtttagccatgtttatgacatctttttttgaggtaccgaaaggggttcttcgtaaaattgattattatagattgcggttcttttggcaattggatgatcataagaaaaagtacaggctcactaggtgggatattgtttgccaacccaaggaccaggggggtcttgggattcaggagatacaaaataaatgtattttgagtaaatggttgtttaagttaattaatgaggaaggggtttggcaagacttattgaagaggaaatatctttataataagtctacaacctaagtaggcaagaaacaatatgactcccatttttgatctggtcttatgaatatcaaaagtactttcttaaatatgggttcttggattgtcaatgatggggaacaaattagattttgggaagatagatggctaggcaacttggctttcaaggataaatatccgtctttatacgctattgtccgaaggaaaacatcatctattgccactattatgggatctgttccgcttaatgtttctttcaggagagctttagttggtcagaatcttatttcttggcatgagttgtgtgcctctattatacatatccagttgaataattcgtttgatagttttagatggaatttccatcagaatgtcttgttctcgatgaggtctatgtacatagctttaattaataatggttatattgacaggaataagtgcatttggaagcttaagatgccacttaagattaaaattttcatgtggtacttgcttaaaggggttgtgttaactaaggataatttggcgaggtggaactagaatggcagcttgaggtgttctttttgtttgaagaatgagtctattcaacatctctttataaattgtcattttgcgaagttcatatggagagcagtccagttctcatttggttttaaccttcctattagcatatctcatatttttgataggtggcttttgagagttgataagaaaacgactaaattgatacttgttggagcttctgccatttgttgggcaatatggttgagtagaaatgatatggtttttgataaatcaccattattttcctatatgcagttaattttcagggcaactcattgactccagttttgggcacaattataaaggtgtgatgaagatgaagagtttctgaaagttgcatgtcgcaagttggagactacggttatgcaactttttaccaaatatggttggagatttacaaatagacttcaatgattgtgatctctttacgttagtttggattctttgttatcctttgtggtatgttttattcgtttagaattacactctggtctttagtgctattatgcgataattggctgtacctcttttgagcaaaggctggaattttatattctattatcttaaaaaaatgtgttaatccaccgtttgattcagtgtgctaggtgggaagggttcccaaccctttttaccgaacacagtgctaagtggtaagggagttgtaaggtagaagatgacattacgacgccgaggaccacgcgccagcctgccagacgaggcaagaaatatggcaaaattccgagccagatcgccacccgcgcacatcgcaggtcactcgatcgcttcgctatcgcccccgctcactcgctatcatccagtggttggcggcaacttggctttatgcgcagcggcggatccatcgatggggctgattggggctccagccccagctctggccggccatagccccataggtgctaacaggtatctgcgtgcagctagccattgtgacaagaaacgaaatagctggctatgaagcattaccgcctagtgctttcggtcatatatgttggaaataatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgcctcgcctcgccgggcaggacgtacgcgtcgaatggtccgaaaaattggcttctcacccttgcgcagatgcagcctccttttgcagttttgttttgctgcaaattcggattcgtttttgttttggaaacgttccgaaaaatccggtgcgt

SEQ ID NO: 70033 - DNA, 21356 bp, Oryza sativa
aacatcgctcttgttaaggtaaaccaattttttttgtggaatttccagaatttttacttttcaacacacagctctatgccttatttgtatgcactccattgtagaatcagaatgatttaatcactgctgacttttattcatttctcttaagagcatcatagggaactggattcactgtcatgtaccttgtttttgtgcaccgtataactattttagacaagcttccatttgcttaagaggtgggactggtcctttctcaataagcgagagtctgatatgaattctgatgaattattgattgggcaaggttagcctgaattcattctcattgaaactaatttgaggattaagaatcctatgaattaagaaatacttgaagcagacaacagtagtgtaaagattgcatcagtggaatcagaaaaaataatatgatcaaccaatctaaagttgaatttttagaagactttgaatttgcacgatagctttccagctagaatgtaaaatggaattgctggggaattcagaatatttgattgcagataaaatgtcttcatacataacttttttttaaaaaaaagaaaacgagtaactaattgctgctgtgctgtttcagaattggacaattcatggtttgtactggggaagctacttcactcatcggccacctgtactcattgactccctcaatgaactcttttcatggctttcaaaggggttgataaaaatccagatttcccacacttacaggctccctgaggtaagcgacaacattttaacaaaccttattataattacagttcttgtaacactaaccacatgtcacatgaaacgtcgcatggcccaatcaatcttgaagacgacacataagtcttgaatgcaaaaaacttacataaatttcattagagacagctctgcacaatatttatatataactcccatgttctgaatggatctttcatttgtaatgtgagcttttcatcagctaggatagcttaaagttgcttggcactttttgcatcatttggctgccatattggtttttgagattacgatccaatcttgttgatacttataaagtcaaagtagttccagtatactaaaatgtacttatgaagcaactaggcgtgactgcctgagcatgtcaacacggacacacgtggtaatatatgccagtggtgcatcttatctaagaaaatggtactgattttagtcaatttctggctttgtatgctgatcaactgcccagattatactgtactgtcagccagtcagaataaggaccaactacgtgggttttttaccatttgtaactactgttcatatcttcaagcttgtaaatggattactgtgtatattgaaaattctcttatctttgtgttttgttgccttatcatttataagtgaactatgtgatgttaacttctctacaggcacatctcgctttcgcagccctgagagacaggaaggccgttggtaaagtgatgattgtgatgggctcaccagcaaaatcaagactctaacgcccttcagggttcatcagggttctattcaaaaccatacatctatgcacatgtcatatgtatagaccatgacggtattatttaaagcagcggtagtccctttcaataatgtggtttacaagtactgctagcttgcaaactaccagagacatgaattattttatgtatgtagattagtggagaataaatttgaaaaataaaatagagttatctgtaggttgggccgtcccctgtaatgtctggcttctgcaatgtaaccgacactgtgtaccaatgctgcaggatgtatgagaagagaaaatgtgagaaatatgtgaagttattaattgtagtataaatttcagaaagcatcaggtttggagtcacccgagaagatctcatgcatgtaagcaaaaaatcacccttcgttgacagtccaagcatgattgtgttcttattttccacgtgcatgtacaaactattaaatgtatgtttgttttaaacaaaatccttaaaaagattgttcccttaaagaaaatcatattaatctatttatatgttttaactaattttaaattaatcatccacgaaatttgcttcccctcgcgggccaagccctcggcaagggctgggctgggcccatctattccctcctccttgggccgttgggcgcctccaatgcaaatcccctcattttcgctacgccgtgacggggcggccggtggccggcggcggcggtcgaggctgaactgaactgaaaaggtcggagggtttcaccggtgcaccggcggcggatagctccacggttcgtcgccggcgatgatccgcatttcctcctcgccggctactgcctctgcgtcctcctcctacggtcctacctcgcctccaagctcctgccgaaatgccgctccctcgccgccatcaagcaactccacgcccacctcctccactacgcccaccgtgcctccttcccttacaaccacttcctctccaagctcctctccctcttcacctcctcctctgccgccgctacaaccgactccaccgccgctgcctccgactacgctctcctgctcctcgcatcccaccccgcctccaccgccttctcctacaacgtcgccatccgcttcttcgcttcctcccgtccccacacctcgctccgcctcttcctcgaaatgctccgctccgacctccgcccagactcctacacgcttcctttcctcctcctcgccgccgcccgatgccccgcgccatctctcgcccgtcgcgcacgcgctgcttgagaagatcgacttgaatagccacgaccacactgtccattctcttatcaccatatactcctaccttgatgatcctggagccgcacgaaaggtgttcaacggaattcccagccgggacgtggtctcttggaacgctatgatgaaggcatatgggcgggtggggatgaacggtgaggtaggcaggatgttacgggacatggtgaaggacggtgcagttgtgcccaatgccgtgacgttggctgtcgtgctagctgcatgcagggatgagggagatttggtgcttggaaggtgggtggaagagtggtcaaagtccgcagggatggaaacggactctcttgttggctcggcacttgtgggtatgtatgagaagtgtggagagattgcagaggcgcggcgtgtgtttgacagcatcattgacaaggacgtagtcgcttggaatgccatgattactgggtaagaatataaaactctttgattattacctgaaataagctaattagtttatcccttttggcttgtttatttatatattgcatttaagattatgcagatatgcgcaaaatggcatgtcaaatgaagccatttccttgttccacaacatgaagaaagcaggcgtatgtccagataagataacattggctggagtcctctcggcctgctctgctgttggagctctggagctaggttctgaactggacggttacgcctcatgcagaggtctctacaataatgtttacgtcgggacagccttagtggacatgtacgctaagtgtggagatcttgacaaagccatagaagtgtttaggaagatgagatgcaagaatgtagcctcttggaatgcccttatctgtggccttgcctttaacgggcaaggtgatgaagccattcagcattttgaactgatgaggaacgaggatgggctcaagccagatgatatcactttcataggtgtcctttctgcttgtgtacatgctgggttagtgaaagatggcaagcgctggttcaattccttgacatctgagtttcagattattcctaagattgagcactactcatgtatggttgatccattggcgcggagtggacatttggaggaagtgtgggacttcatcgagaagatccctgacaaggtagatgcagtgatgttgggggctttgcttgcagcttgtcgaaaatgcaagaatgttgaaattggtgagagggtcatcaacaggatcattcagctggaacccacaaactcgtggaactatgtggtgtcgtccaagatatacgccagctcaggtagattggatgactcagcaaagatgagagggctaatgagggaaagaggtgtcaacaaaactccaggttgcagctgggttgagattagtgggaaagtccttgaattctatgcaggggacgaaccacagcatggtgcagatgatatgtatcaggtcctagacctactggttgatgagatgaggttggaaggatatgttccaaatcttgatgtggtgtagcaaataagtttcagttgttgccgtcttgctgaaagttgcttctgcattggtgtttacgtctctgaggctgtgactttgtggatatgtgatacaagttacttcatgataccaccttcctaactgaaatgttgctttgctacagaattgggatgggcaaacacaatttagaacggcatcacactagagaaaattcttggcacaattattcaggaaagtgactcaaggttgccacctggatatatcaacttgatcaggtaattattttgcagttccttatttacttattcaggaatatgtcatgtgccattcagttcttactaacagaaatattccagaaaagtagaaaactaatttgttgcaccctcaaactcttcaccactcggcaccctcaaactcactgtggaagatattttgctttgtctgttatatcaatgttcagttaacatgcaaatcctagctaaattagcacccatgtgcgcaagtatcttgttttctcttcttatgttatatgcatcagtcaaattcttcttaataagcatttgcctcatgaagcatcttgaattaacattttcactttgtataaagcatgtatgggtatgctgcttccagatctcatataggccccaatgcaatcgcgaccaactgttccattgaatcttgcttagaggttacacaggagatccagaatttgcgatgacggctacctacaccctacgtgttgacgaagcaggcaagattgttgctgttgaagatcacagaattgtatttgggataagcaatccatcaatgtaccctgcaagcattggcttcccaaaaccagagaactctcacgaaggcggtaatctgaaataggggcactgatcatcctgcactacagatgcaacaatttttgctatgctgcttttcaagtggcaagcagcaatgttatctttgttattgaggcatttgcttctccttctctgtgcatgcagtagcatcctctgtttaacacgattgtttctcctctattctgtttattaacatgtaaaaatgctgttcctgctcctcacttttgcatcagctgttttatacaaacatgtgaaaactcagaattctgcgtacaattgaaataactaggaacacttgcctaatgcaattctagtcaaatcgtcatataacagaccagatcattaatcagagcatgaccaatgtgacaagaatcgtccctggaaatttctattttataagaatctacagaagtagataaatcattgacaaatcctaccctgctgtagctcgtcaacactctgctggcctatgtttcaggaagaagctgagcttctgtagcataaacataagcccaagcgtacaattgaaataaggttgaaacaattgtttaagacaaatcatatcacattcatatatcatcagaataatgtacagtatacatatgatggggctactgccagcacaagttggctgcaaataaatcaatggcttcaagtaaattacattaaacagatttctaaggttcaaagcaggcttgacaagcaaccaaagaatcgaacagacagcagaaacagacgagatcatggtcctattcctactctgctctagctcatcaaaactctgctttcaggaagaagccaagcctctgtagcaggccgcctccacggcgacgcaggctgtccctagatttcaccgggctgacaatgtactgcgcctcgccggagatccccagctgcttcatgtctctgggatcgatgatgtcgaagaccggctgcgccgtcctcttcatctcctgcagctgctcacgcgccgcctttctctcgagctcacgcgctgcctctctctcgagctcacgctggagtttctgcctctcctgggcccttgcaatcagctcctgcatctcagtgcgaggagatgctgccctctcagtgatcagctcctgcatctcagtgtgaggagatgctgccctctcagtgatcagctcctgcatctcagtgtgaggagatgctgccctctcaatgatcagcttctgctcctccattggcttcacttcagcttcggtgggatgatcagcggtggtgtctggcctgctgctcgcactgtcgtttctttccgacgaggaggatgaaccgctgcaagatgaactgctggaagagtcgctgctgctcgagcgaggagtttcagggaacttgctgaccgatacaggggagtcgatgccgccacagatgtcgatcaactcgtcatcctcctgttgctgcttcgggagcggcgagaactgagccttgtccacgaccaggggagagacgccgccgcagatgtctatgcccatgtccgtgatgcagagctgagatgcaggagatgctgctgccctctcagtggtcagcttcttgtcttgctccatgacctcgtgctccaccattggcttcacctcagcttcggtgggatgatctgtggtggtgtctggcctgttgctcgcactgtcggcgtcggcgtcggtgtcacttcccgacgacgaggaggatgaaccggcgcaggatgatgatccagaagaggcgccactgctggaagatgaggaggagccagagccattgctagagctggaggatgatgaggagtcgctcctgctgctgctcgaacgaggagaatcagggaagttgttgactgatacaggggagacgccaccatagatgtcgatcaactcgtcatcctcttgttgcttcggaagtggcaagagctgagcactgtccacgatgaggggagagacgccgccgcagatgtccatgcccatggccgcaccctcatcggctatctcaccgtcctcgaggaggtcgcagatcgacgagctgctggtggcgtcggatgcctcgatcttgggcggttcttgctcctcaataatcttggtggtctgctgttgagcgaattccacgagcaggttcagcaactggaacaaggcagcatccttcgcggagctaagatcgacatccatctcttcgccgttagggtccacgacgcagcagcattggcttcgcatcaggccgacgatgtgcggcggcaatggcgtgtccgccgacagcgaggcgaggaggccgtagaggcggtccctctgcgccttgggcatggtcggctcgatcacctcaacctccacctccacgatcgggctcgcggccgtcgtcttcctcctcttctcggggggagagacatccccgtcgatcgcggtggcggcctccggtggggtctcctggcggcgcaagaaacgaccgctcttcttgccgcggctagggtgatcggggtgctgctcccccgccgccgcggcgccgccatgggcgcccttggcgcgggccgccattaccaaggcctccgccttgtcgaggagggcggcgaccacctggtgctccgagtggatctgctccgtcaggcggcgcccacggggcgccatgtcgcacagcgcgtaggccgcgtgaggtccgcggcgcgggggaggagatgaagatgggaggcgcttcgcgaatccgcgggagatggagatgggagggggaggcccgcgcaggcgcagatggatcgaggtgaggagtgagtgcgatggaggatgggagagaagtgggggaaggacgagacgaggagcgcggcggctatttatggtcggctatacgtgacagactcggagtccgagtcggagtcccctgcgctcggttcttgtgcatttgatatgcgcttgaattgagtcagggtcgttgaagccaaaaggtgccatcctacttcggatacatacacaacacgcctttctttttttttcttttttttttagaacataaacaacacgcctggatgctttcgtcttcgaaaaggctgatgtggagtgttcacgcgcgtatggacatcagcgacaattcaatcctgggttgggtctggggtgggagggagaagagaggaggtcaagctaggcttagagggatggatgtaggaagtggtggatataggtggacgatgccaaagctatggagattgagaaaagcgagatggaccggtattggtggctagggcgaaccaaagcttgcggtgaggaggtggtgtctaagtggtgggaagccaccggcgggacaaaggcacctcgtcgtaacctgtttgagaaagacaaagaaagcaggggaagaggatgaggaggtcaatcgaagggcctcgctcatgcctactagctagccggtgagaccgggtagtggcgaaggtataagagtaaaggaatcgagcagcggtgaatggcgatgcatgagtcgaggcaatggtggagtgaggagggatgagagaagttaggcttatgtggtatcacacaaatcttaaagcaatctaatagtatgaaatttgcaagatttccttggatgttttctgtcaaattagaaatagagagagtgcctttatttcctgttcatattgcacacaggtatctatacttttttaaaaagacttcaatgataatggcaataaatctgtgaccccacctactccaattatagattttacacattagcccttaaacttcttaatatatgctcagtctggtttttaataaatgatgtcgttgacttttgaacaaatgtttgaccattcgttttattcacaaaattatgtaattgtataagatataaatcatacttaaaagtactttgagtgataaaacaactcaaaacaaaataaactataattacatatttacatattgtaggtagtacataaacaactagatctaaatagatagatagcctcataaaattaaatcaacgtgagtattcctcgtagcaaaaaggtggataacatattgatgaaaaatatacttttatttattttaggcaatattatgattttttttttcatagcaaagctcagacatttagctactagtactgtaagaaaaataataaaacccatttcaaatcaaagttgaaaaaacttgccccctcataattctttcaaagaaaaactctgctagctgcactatatttatgccttgtaaggagttcctattacaaaataaataagaaataatgtctaccacaaacaaaatacaacaaatgttggatgagaaaacatatcgcagtgtctgttcaaagaaaaaaatattctatgccatcgagtttgctcatttctactgagtaagcccatttctactcaataccatcgagtttgcaaaaaatatttactctatgcatctatatcaataagttatggtgttgtttgtccacattaatattaatgttagatggatctcaacggctcaagggggccttgacccgcgccctgatcgggggtgcctaacccaatggctggtgggcccccgtcacactgcgccatataaaagggggtggaggacggggcggcacacagtacgaggttcgtcgccgccgccactccaccccacaaaaccctaaccgatcgagagggggcacaaccagtgacgggaaacgccaccgccgcgccacgcctcatcgccgggacgtctacgaccaccattgccgcaaccgtcatcgccgtcaacctcaccggcgccgcatccacgacaaccgcgcgaccacgacgacgatggccggcgcttcttcatcctccaacacctcaaccggtcggtctatctaaaccctctcccgttttcaatctctattgttcaaacatcaatcccaaatagaaccacccgactagatctaacctgggtgatcctagtgcaaagtctaacaatggtatcagagcaaccctagtgattagatcggttcggggaaagaaatccaaagaaagaaaagcacaagatccacacggatcaaaagatcgaaaccctaaccctaccttgtcgccggccgtcgccggcaaaagggggggagggcaaagggcaccgccgaggagccactcgacggccatgcacgcacccgtcggtgcacgcgccggcgagggggcccgcggcggcgccgccatctccgtctttcggccgccgctctctctcacacggtgggggttagagacggtggggggagcgtagaagaagagaaaagaaaagaggcgccggccatggcgcggcggtggcgagggccgccggcgtcggtgacgccgctcggcgcggccgcgcgctcgcaagagagagaaagaagagaagctagggttcggcgcggcggctgggggggtcgggggttttgtttgcccgatctccccgcccggccgtccgatcgaaccctagtggatcggacggccggtgacggtcgggccaaaaacggcccaagaaggagagcgcgcgcggcgactttcccggcccaggcccaggttgcggcctggggggaggagggagcgcccgcacgcgccaaaaagccgtgggccgctggcaaaagttcaaattaggtccctcggggggccgaaaatgatgaaaagagggacagtagcaaattttccttttattttgtataattttcatgcaaatttcaatagaattttgaattgattttgcatgttttacctctgtttaaattcgaaccaacgggagaacttttacagagagtaaattacagagttttgttgttgttcatatgatttttatatagtttttccgctgcaaatagataaatttgatgaaaattagtgtttctaaaattaaatttcgaaccaacgggagaatttaattttaggaacattaattatgtgctatgatgttgtaattttctgaccaacgttgataattgcaatgttatagttatggttatatgtgttatgtctaattctgcccaatggtgatataggcttaatgcataatattttaatgttaattttgttctcaccgtacatgattatttcaggtggctactccttgatgggttgcattaaaaatattccaaccctaaaaggagataactacacagaatggaaaagaaaactcgaccttgctttcatcttgggagaggtggactgggtgttgactaccccatgtcttatagaacctgctgcacttgtcagaggtgaaaatgagtcagatgctaaccggcaaaagagacaaagggacaatgctcctctcgtcatgtcgtatgacattgaacaaaagaaatggtccttagccaacaagaaatgtttggctgtgggaaagaacacgattgagccaaccatattaggctcaatcccagagtgtgacgctgtctcaaagtaccttgaaagaataaagagtcagtttactggctcttcaaagactaatgctacacagctgatcaagcagcttgtgacagaaaggtaccatggaggtggtgttagagaccacatacttaggccctctttatttaggcttataagccaacttataagtccaaaattctaagcgaaaacaaacaagcagcttttttatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggctaataagcctaagcctaaacaaagagggccttaggatgaacaacatggcttccaagttgaagccaatggatttgggcataacagatgaccttctggtccatctggttatggcctcattgccaaagcagtttgacaattttattgtcaactacaacataagtccagataaatggaagtttgaaaagctcatcgctaattgtgtgtaagaggaagagagaatcaaagagtcaaatggtggttcaattaactatgttaaagataacaagaaaaagaaccacaagtctcccacctcaaaagctaaatagtctcagcatctgcctcagcaacaacagttcgctattgagaaagatcagtgtctccactgcaagaagacaggacattacaagaaagactgtcctgacttcttgaaaatgatcatggcaaggaaagatgagaacattattacatttgtaaatgaatctcattatgttggttactctagatccacatggtggattgattctggagcaactattcatgcttgtaattgtttaaaggcattccgttcaacgaggactacgcaaagaagagaaagctccattagagttgccaatggagttgaagaaaaagttgaagctgttggagatcttcctctagagctcgcgaatggcttcacacttttacttcgagatgtcttttatgttccttctttgcaaagaaacttaataagtgtatcaaagttggattttgatggatatgattgccgctttggaaatggcaaatgtgaactatggtataataatgcatgtattggtcttgctgtgttgcgagacgagctttatttgttatctctttctgacaatgtgaatgttgtgtcctcgttgacaaaagaaaacaagaaaagaaagagaactcccgatgtctcatcgaaattatggcactgtcgtttgggccatatttcgaggggggagaattgagagactcgttaagaacgaaattcttcctccattggagttctcagacatagaacaatgcatagaatgcattaaaggaaaatttgtaaagatcatcaaaaaggatgcaaaacgaagcgcaggaattttagagaccattcatacatatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtggggggagtactatggtcgacatacgccttatgggcaagtccatggaccttttgcaaggttcttgttagagaatggaatagtagcccagtattcaacacagggcgaacctcaacagaatggggtagctgaaaggcgcaattgtacccttatggatatggtgcgcagcatgatgagctactctacactaccactgggtttatggatggaggcgttaaaaaccgccattcatattctcaacagagttccaagcaaatcggtgcccaaaacaccatatgagctatggataggaagagtaccctcgctagctcacctccgtgtgtgggggagtcctgcagaggctaaagtatttaacccaaatattgggaagttggaccccaaaacagtcagctgccattttattggctatcctgaaagatcaaaaggctatcgtttctactgtccaaacagttaatacaaagtttgtagaaacgagacatgccgtcttcttggaagacaaaatgattagggggagctcggtagttcgagaaattgatcttgaggagaggcgggtgtctgtacccgctccgtcgactcaggaacctttcttctctttacctgctgatgttgtgcctgcaatgcctgtcattgaggtaccagcacctgttgttacctctcctgtggcaacaatgaatgaaaatgaggaacctgttatacaggattcaacagaaatggttgccacaccagaggaggagctgcaacatcctcaaacagataatgtgacagtacaggagactcaacaagagcctcaggtacaggatgtgccaaatgtggaggcccctagaaggtctgaaagagtcagaagatcggctatccgtgatgactataaagtttataatatagaagagtcacatatggaggatgatcccacctcatatgaagaggccatgagaagcgctcgctcatctgaatggttggaagccatgaaagatgaaatgaaatcaatgaaactaaacgatgtttgggatttagaagaaattcctaatggagccaaaacaataggttgtaaatgggtctacaaaaccaaatatgactccagagggaatatagaaaagtttaaagcgcgacttgtggcaaaaggcttcacgcaacaagaagggattgattacaatgagatattttctccagtctcttgtaaagattcgttcaggattataattgcactggtggcacattatgatttggaattacatcagatggatgtaaaaacggcatttctaaatggagatttggaggaaaaagtatacatggcgcaaccgaaaggttttgtcatgaaaggaaacgaaaatatgggatgccgtctaaagagatccatttatggattaaagaaagcttcgagacagtggtacttgaagtttgacgggacaataaagaaatttggatttcaagagaatgtcaaggacaactgtatttattcaaagtttaagaatgggagatttattttcctaattctgtatgtggatgacattctactggctagtagtgatgtcagtctacggcaggaaataaagaaattcttgtcctcaaactttgacatgaaagacctcggtgaggcttcatatgttttgggcatagagattcactgagatagaacaaagtatgcattgggactttctcaaaaggcatatatagaaaaggtgttgaagaaattcaacatgtacagatgcagtatggggcattgcaatgtcctagaaatcagtatgagctcaatgaaatgaaaacaaagccatatgcatcagctgtaggaagcctacagtacgcgcaagtgtgcacacgacctgacttggcatttgttaccgggttacttggcagatttcagagtaatccaggcccagagcactggaaattggtaaagaaagtattgcgttatttgcaaggaacaaaaggcctcatgctgtcttacagaagatcagaatcgctccagatagtggggtattcaaattctgactttgtaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagttcatacccggtttaaaggttgacagtattgagaaaccactaaagttatactgcgacaacgaacctgcagtaatgtacgctcacaacaatcagtcaagtggtgctgccaaacacattgacataaagtactatgttgtaaaggacaaagtccgggatcaaacaatcagtctcgagcacattagaccagaaaggatgctcgcggatccgctcacgaaaggcctaccatccaacatgttcaaggaacatgtagccagcatgggtctaaggggagccttatgaatcctagactacagggcccaaaagtaaaagtatctgtttctgaatagagatgtgtatagtggctatcgaatccatcggtgattgaccgtgacgatgaaacatgctctatgtgcaaatctgtgatggaatagaaaacttgaccttgctttcatcttgggagaggtggactgggtgttgaccacccgactagatctaacctaggtgatcctagtgcaaagtctaacaattaaatgataaaattgtccctagtgccatattcacatatggaagtttgactgtgcactcctagcgtatcccaattcccaacaggaattttgtccatcatgctgtagaggagcaaccttgttcgttccaacccagaaaagatttcacttcctacattcatccaggatatactttcgaaccataggtggtgttccaccgaagctagcaagagcacagcgtcctgtaagcttcgcgcttgccacgcaagattgcaagtagttgaactgtcttcttggatctcgagggccaccacatattagtaggaagaaaggcttcagatattgtatttggtggaaggggaagaacgggcgacctgttctcaattggcaggttgtgaatgtagtccatcttcctagcagccgcgcagaaagaacctacaaactcaggctgaatatcaaacaagaaccttgagatggtcgtccatacacctttcgaagatagggcgacgttttcatagtaaaagaatggtggtccaaaagctggtttcaggaaggtttctgtggactaaccttaaactgtcactgggcaagctgaatcccaccaatccaccataggatttggcagaggcattggctcttcatggctgtcaccaaatggcatttgattcccttgtggcccacttccataccactctttttcttgcttccatccatgaatcttgtattctttcttcctccaaaggaactgaactctgcatcctgcaaaattataaacatgatgctagtgccattacatttaaagaaatgaaacaatttcttgattcggatgcattataatcacaaggtacctcatagtcagataggtttgcagagtaaacatttcctgcagccagataatattgaatcagccaacatatctacatatgcattgaaacctgcgaaattttacccaacgtaggcagtataaggtcccttcctgtgaaagcagcaaattcaagaggcataccacatctagtaatagccgtctttgcttcatcttctggaaaacccatgctgactaaggacttgattttctcatcgttctctgacagctcctgtaagaaatcctgcataaaagcacatgaaaggcagattgaaaacatttgctaaatctcacagatgacttgcagtttggaataacaaaaagtagtactcacacaaatatacctgctttttccatgctcgtaaatgttctccttgtatacccactcagtaacagataaagcccacctccaatttcctcttgcctcaagcccttccagtatttgtagtagattaccttcactataaattaggtcagattttttttcatcaatctagtaagcctccaatcatgtaaacttagatcatattagttcagtctgacaggcaaacattcttatgcaatatggggaaaaaaaatgcaacacttcatgcaggttcaaatgtgtcttagcatagattaagaggagaaacctcagtccccagactaattatttaatcaataagaaaaacttaattcgataatagcactaggatttaggataagtgaagtttacaatgaagttaagtgcataaccgcatataggtgcatactacactgctgtctcaatggtaaaatatccaggctttgtaaaaattagacctttcttttctactaatagtgaatggcagaactcctgcctccttcctcgaaaaaatacactgctgtctcaatggtgaaaggaacatgtgtataccagtcagaaacaatccatgctaagtctacgcaaattctaccatatctcatattcatgaaaatgtgattatttaagtcataaagcaaccagcactactttgtactcctacttgaaagcaggacaaaggccaagaatgccagaaaaagcagtagcacgaacatacctggcaccacagagttgacaccagtataagctgcaggaaagtagttgcacgaagcagaaggacatgtagacagaagcaatgaacaatctacagagcctggcaccacagagttgagaccagtatatgctggctacaaacaaagacttgacttatgctagtaaccgttatcatttgtctccatctttgttgtccaaagtttgagaacttgaaactaaacctttatctacaaatttcaggatatctgaggaagttattccatctttcgacagctccacaactgcttcatttattaatcctaccattttcaaattattgccgtaggtatctttttggagaacctcttttaaaagctcacatcccttcatgggatatccatttgatatcaaaaagtttataaaatataagagggaaaaagtatccaactcaaaaccttttgtcaccatctcttcaaagtaggttagtgcagtctctattcggccacatttgcgcaacccgtttataaaagcagtatatgctatattgtttggagcacaacctttctccctcatttcgcaccacaacttaatggcttcatcaggtcttccagcactgcagaatccatctatcaaacttgtatatgtaattactgttggttgcttttcttcataaaccattttatctaagtaagaaattgctttctcaatcctgccagtcttgcaacaaacatcaatcataaggttgtaggtaacaacagaaggaaacagacccttctctaacatctcttccataattttttgtgcttcatccaatttacttgattttcgaaacccatttatcaagatattatgtgctaccacatcaggaagataatacttacaggaaatgtcacggaagaggtgtaacgcatcgtccacctctccagtgttacacattccattcatggctgcagagtatgtgacaatgtcaggaagaaaaccaatttgaagcattccatctaaaaattgcactgcttctgttactctgccactgaagcaaagctgttgcaccatctccgtgcagttctttatccatgggggatgcccatttgtctgcatctcccttagtaaatccagagcagcctttggatcttttctcctacaaatgccatagaacaatgaattatatgtgaactctgagggtgtcaaaccaaggtccttcatttggttaaatatcccatatccttcttctaaccgatccatattgcacaactcatggatcaaatcattaaacatcaaaatcttgcccttacaaccaaggctaatcatgtcttttgtgagagctaaggccatatccagcttcttaaccttacataggccacagacaacaatgttaaaggaatcagaatttggtttagcatcttcacggatatgcaacatatgtgcaccaccagccacatcattgttaaccgcttgaccaccacataccatggagcggagcaactgataagctgcttctacctcaccacaatggacaagctcttctaaaactacattgtatagtgggacaacactgccggatttcaaatactctgcattctcattaatgaacggaccaataacggcaaaatccccttctctacaaaaagcctcgatcaccttcttgagtaagcggacgtcaggagcaactccactgctcttcatttccttgaacaacttcactgctctcgcaatgtccttctgctgacagagcccctcaattaaaacgctgtacattgccaaatcgacaacaaacccgtaactgaccatcttggcaaacatgtccatggccttgtcaaccctgccttgcttggtgaacccgtggacaagcacgctcaatgtcttctcactcaacctcatccccagtgcttccatgctccctagcagctcaaccgcaccgtccaccttcccccacttgctgaacgccaccatcagcgtcgtaagcacatgctcgtccacccaccccagctcgctcatcctttggaacacgtcgttggcgtcatcaggacgacctgcattgcagtagcaccgcaggagtgaggtgagcgtgtacttatcaacgctcccgtcgccgcacctcgccaccatctcccggagccttgcctgggcatcgtccgcgcggccggccttggcgagcgcgtcgaggaggcagttgtaggtgtacgagttgggggtgcaaccgaaggaggccctcgcggcgtcgaaggcgcggacggcggtgtcgggcagccccgcggcgccgaggcagcggaggaggaacccgagcgcgcctggcgtcatgaggcagcgcgcggagatcgcgtcggcggcgaggcggtcgagatgcgcgcgctggtggcgggggaggagggaggccatggcgttgagcgagtagcaggagtggcggaagcccggctggtcggcggcccagcggaagaagtcgagggcgtggcgccaggacgggagccggaggaggacggactccgcggcgggggcggtgagctcggcggcgagccggcggaggcgcgccgcgtcgcgggtggcgcgcgggcgggagaattcgtcgagcaggtggtgggcgaggtaggaaggggatgcgggcacgggagcgcgcggaggcggagaggcggaggtggagaaggagaaggagcgcggggcgcagagagagcgcgacgagggggaacgggctaggcggcggagcgacatggaggagggcgcggaggcggcgcacggcggagtggaaggcagggaggtggccggaatccggaagggtagagagaattccaagcaagccggaccaactgggcctgggccgaccagcctgactaaaggctctcacagtggatttatatatttatttatttattaaaagatttaaaaacataaagtaccgttcaaagttctacaaaaatatgctcctcccacccaaccgtagggcgaggacagaaggagcatattaatgtgaagtggcacctcaggagaggggcgtgcaatggcaattttctagataatctcctcccggcgataaatcgttcttccctagggtgatttattgctggaagggggtcgcctacaaaattaccatagcgcaacgtttagctatgtatgggacgcaccatagcaattgtgtagtggctccttcccaacaatgaatcgccctcccctagggcgattcattcttgggaagaagccgcctgcaaaattaccacgcacacctcccacagggtaccacgtcgcgtagattgtcctaccgtaggacgatttatctacccccgccctacggtagggcgggaggatatatttatgtgaagctttgaaatgagaatatatttttgtaaatcttaaaaataaatataaaaataaaaaattttcctcacagtgcatcccacctatataagaggcctcagagtgtcacgtaggctagagctacgaattcaaaatctgcgttgctcaccgtgcatgtggctatagaagtggctttaattttataattccagctcatgattttttttcagttcttatactttctctaatttacatagaagtaccaattttacattgcacaccctaaaatccaagaaataatatcaaatcccctcacctaccctccctctctctctcctttatcccctccctccctctcggttcccacggaacacatcggtgccactcactcctctacgtcaaccccccaccatcggcaccgctccccctccgccacaccgctagcgccgctccccttccccc

SEQ ID NO: 70034 - DNA, 2764 bp, Oryza sativa
gacgtcctgcaccgggagaaggcggcaataaggttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatcgaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgcattattgcaaaactacctccatcttggagaagtttcggtactgcactcaaacacaagagataggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggtcaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtaggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtactggacatgcatgttggtacaattatggagtctcgtgatgctaccttctttgagagctttttcccaatgaaggatacacatagtggttcgaatcaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctg

SEQ ID NO: 70035 - DNA, 15898 bp, Oryza sativa
caaatagaaagtagaaaatctaaattttatagtcggaaataattgacaacgatattgtttttaacgaaaacgatatcctaccgttttttcatcctactgcaaaacaccgtggcaccagctcctgccttggtagtttaactgcaaaggacctggatacttagagcaaagttaataatatagtctattgccagctccaaaaaatagccatgtgtacacagtgtagcgctaatgtgtattatagaagcactgtagcataaatattttattatattagtgggacccatatcttcatatatctcattctctttctccatctcatccccttcctttcatgtcgtattgttctccagtaagtccagatgatgttcagtggcgctacggcggtgtggatgcaggagatggcagcagccgtgcgacgatgaggaagatggcggcagccgtgcagcggatgtgggtgatgccggcagccgggcatgatgagggcgcccatgcggcggacgcgagatatggcggtcggtgtgcggataacacgggagatgagcaggacgggggtggcggtcgtgcggcagacgcgggagacagcgacggttgtgcggcgggcatggaagacaaaggcggccgagccagatggcgacggtcgtgcgatagacgcagaagatgggggtggccgaactggaaggcggtgacggttgatccagacgactgtgaccgtgcggcggacgtggaaggcgccgccaaccgtgcggataacgcgagagacgacgatggtcgtgttgtacgacggatgcatgatatggtgtcggtcgggcggaatgagagcggtggtgacggctgcaaccaaggtggacgagggaagttgctgcaccggacaagggtgatgtctacgacgtgacggccatggccgaggcggacgcaagcagtgacatccgcagtagctgaggcagacgtggccgacggggggcgaggtgggcgctggactcaggtgacgaccgtggcgacgagggaagacgaaggcatgtggctagcgcaggggcgccatcgttgtggcgagcgggcccacaacctcgggttgcacgtggagccgagcgactaattagtccccgctcattctctctcttcaactatctcttctccacatcagtgaaaaatcctacgtggtgctcctatcgtcaattattgtactcgctcttatagaaccgttctatcgctgaatatcataccctacattagtagtttaattgtagaggacctggatccttacataactgttttttcaccgatcactctcatgaacactttgtgagcggtattttcgataaccgtgaaccgtgattactgctcagttaccaaggaaaacggttgaattcagagtttcagactaaatttgacgatgaagtttgattttcacttgagatttttcaaaacttgagtacttgactggtttggtggtttgccaaacggtttctagattcatacctccactacatcaacctaataaatatttgaggagttactatatccgtctcaaaataagtttattttcactaatcttgcacatacaaaatgactagaatacccctaatttatcaaatcccaatgtaactatttctcattttatcttctccaaatacaaatatcccatattttcacaaatttcgatgcaatgattattctaaacatgaacttactttgacacaaatgaaagaagctagaaatgcacttattatgaaaccgaggaagtacatcgcatttgtaaaccttgcatagaaaaacgtatcccactattgttccctagcagcaaaaggattctcgcctgaacaaacaccaccaaacttactcgtcctttgaaatatggaattttattccgaattctgcgaaaattgaattcggctgtgtagaacgtctgcggatctccatctacagcccattttgcagcccattacgcacagagcccagcccaacttcccccaccacccgacccctaaattctcgttcggtgattcgcagcgccgccgcgctgctcaccggcacctcgcgccgccgccgccgccgccaccaccaccacctcctccgcctctcctcagctgcgtccatcagaatcccgcctcgttccttccgctaccgccggctgggatagagaggccacgcagctctcgtcgtgcgcggttcaggcaactcagcccgcgcaggcccggatatggcggcggccacgcgcgccgcgacggcgtcggcggcgaggcaggtgacgaagcggaacttcgcggaggccgtgcaggatctggcggcccacgtggaggcgtgcgactacgtggccatcgcggcgcagaggacgggcgccccgacgggctggcggcgcgcgctgccggtggacaccccggagacggcgtacctgaaggctaagctcgccgcggagtccttccagccgctccacttcgccatctgccccttccgcgttgatgccacatccccttcgaccctcgtcgcctatccgtaagcagctctctctccctctctccatcctgcataaggattactatggcagctaggattttcgacaatgcattttgtcgaacgtcttgcgcgatttctgtttgcaacttgcttgcgatcaaaatgtcagcggcgtcttcgagcaatatgaaatgcatctgactcttgccttgcagagtgcatcagaatgccatacagatgagaaactacctgtgttgtcaacatttttcctagtttggcgaggagttattgaaagttgtatctccacgttacatctggaactagtttaagtagtgaaaccaggggaaacgaatcgtagcctcgtaggcaagcttatcacatgactagttaattttctttgcagtttttatgctgggccagtgatgaaaaaaacatgagcatgaaggctcatcccaggatgtaaaggaagactactctatcgtcctgggttcgattcttcacgctagatgtttagttgaattgtcaggataaaataatgctagaggctgtggacagccaacgatatatattatgtaattcagtagagaggtggtacaaataaagatagaagtgtccacttatccatgttgtgaggaaattaaatgatgtatttgaaataaatagcctgttataaggacaagcaaggtgttaatccaggaaaaaaatgacatatggtttgttggctcattgccatttctagccttacaaaatttttttgccagtgacaagaattggtaattgccaacttttttagtaaaattggctaggtctttgtttggtttggtgccaattaccaaagttgtacttgccatccaactaagcatatgccaataatttggcaatgccaatttttggctacaaaccataaagatgactaatattctgtcaccgtcaatgattttttggtttggttgagtttggctacaaaccaaacagacgcataatctatggaaatcgaagatgggggtcctttagcatagtgtttgaacttttccacagttaatgtagagcaaggcaggtccaattgtattatcacacaaatgggataaatgatagaataaatcagcttcagtgcttaagtatggaccaggtaatcaggtaataactgaaagcctttggctgtactgatatcctctgtcattcaatgaactgaatcagttgacagtcaaatgaaatataccatataaactagcaagcaacccaccaaaattatatgtgctgtttcaacttgacgtcctatttgaggaactgaatcagttgacgtcctatttcaacttcctggggatatagatcaaccatttgaggactggtggctagcgatgaggcaaaggtttgcgaagcaattaagaagagcattcgattctctatgtttgatattaagttggcttgtgtggaaggaaaggaatgccagaatttttgagaatcgaaggaagtctccatcgcaactgtttggcggtgtcttagaggagattgtggtgtggagagaagcgggagtgttcaaagaacctgctgattagctgttgtctttagtggatgtggttttggcgacttgtctgccagctccaactgaagctagcctgtttcttccagatatcgacagtgttctgttgaggaaaatatgctggcgttaatgtaaacttaactttattgcatttcctcttcaaatcttaatacaatcggttggtcgcttctttggccaacctggctaaaaaaaatggtatgtgctattgcacagaaattaccatatttaaggacaacaaagttgctttgaaaatctctatatctcctggagtagctcttgactccgacctgtttctattagaacaacaatttaaccatactaaaatcttctgcttgtgctactttcaaagaacagtacttgtattgacattcatttatgcatgacaattgaaaccaccctgttttgcatattttactagtttgttcataacagttaagttcatttatgaccatggccaatcaatttatccatttttattgtctataaatgttagatgcagttttgtatggagttcacaaaaatttctagacaatcaattcaaaatttttgtccacttgagagtaccatgttgtgctctcccttgcttcagtccatagtattttgtattccctgattgttgctgatgcttttgtctgtattttggatgtacaggtacaattttcatttatttcccagagatgagttacagttgggaatgcctgcttacagtttttcctgtcaatcatcttatttatcatctatggctcatagtggttttgatttcaatatgtgcatttatgatggtgagtattataccatgtactgtgatgaatagcaagttgtattattttttatagacagcctaattttctggtggccatatgccaggtatatcttatttatcaagggctcaagaatccttggcaagggaaaggatatttatccctcatgttcgccaattatcatcgtcaccaagcacatccattgctgattccgtttttctgactagaattaaatcgagaatagagcattggcgaaaaggatatacaaaaccatgtaaaacagctgatggtaggttattatagataaatgttcagtctaattctagtctattggccagtcctgacatcgcttcttactgggcaggttctctagtaaatacccttaggcaactgattttgggtagtgaatcgtatggttcaaggcccagtttcagcattgatgtttgcagtgatcgccaagttcaactggttttggaggtgtgtttttacaagttacatttgctttctctttcttcaaatatgatttcatcaattattcagagaatcatagatttcatcaagaaaaaaagatgaatttaggttgagcctacttatgttctgaattttgtttcactattgtattggttttgagtactgatatatgaaaataattcactgattttgagaactgatatacgaaaagaaatccactgatttcatgaagaaaaatgaatttaggttgagcctacttatcttctgtattttgttttactattgtattggttttgagcactgatatatgaaaagaattcactgatttgtaacagatgctttgctttagatttaacatttaatttcaataagccgatccttatataaagtataaataaataaaattgcaacaagcgaaatggattgttccatctgttacatcacgattatgtaagctgtaaagttaaataataagcctgtttacctgtgtaatatttgattgttttgagctatgctgcaggcagcaaatcatatctctgatgaccttgtacctcttgttgttccggacaaagctgggacagctagggcagtgcgtgtgatcttcactagttctccagaggataagaaccttctcctggtttgtatctcttcagattggcagcatgtgcttgtataaaataaaaggaaggtgtcacgtattcaggatccgttcttatggaaatcattttcagatggacataaaaaaaatggaggatgaacataatttgaagttccgtggttttcgagaagttattgatctactatcatcttcacagaaaccaattatatcttataatttcttgaatggtaggttgatgcataacaaacctgcacaattttctgacatgttaatcttttttgctcttgatttcaacatctccctcttatcccagatttcacaatgatacactccaaatttgttgcacctcttccaccaaacttgcatgaattcatgtgctccttgaggatggtattttctaatgttattgacatcagtcacatgtggagagaaattggccctttgagaaaagcgaagaatatacaaggtgctctgagttacctacaaagacaatactttgtgccgatggatgtagaaatacctcagcaaggtatagtttcagctgcataattgacatgccatgtttattcataaaccatggatcatttccttttcaatcgtgtttgggaaaccaaatgaagtgtgggtacaaaatcgatgactaaatcttaaattcttcaagctactgaactctcactttttattctcttttgcagatggtaacaacagtgtcaccaaaagtggggaaaatgttctgagaataacaaagttgtttgctaaactaagtaatttactgaaaatcagtcccaatggtcaaactcactctggtgataagtgtcacacagttgaggaatattcttacatattgtatccgagttgtacggctgaagaatctgaagatgataaatccagtaatgagtcaaataccaccagatcagtgagaactgataatgttgttttcctatgggggtttagggagacatctgtcaaagaactgagatctcgccttgcaagcttgcatcatgccttctcaaaagattttgagctcagattattggataactcgtgctcagctttgatattccacagttctgatacggcaatagatttactaagagaaataaactcggaaagtccctctctgaataatttcttttcggaaggcctgaaagctgcaggctttgatgcctacaggaaggtttgcaggtcagggctttgggattcagatttagctgaggccctggatggtgtttcatctgaaccatctacttcaacgctttctgggcgtggcacctctgagatatgctggaatacttcgctgatgctagatctaaaggaatatctggaacgctaaacaacatatatttttatggaagtcgcctcagattaataagagtttccaggtctgatcaaccacaaccagtcagcattgctggaatcttcagttaagctcctatgaggagaacatcacttacacgatgattatgttgcttgactgaccataaatgggcaaggtgtttctattcgtggcgcaatcatgtggaacagtgatattgttttcagcttcagcacaatggttgcttacattgcttactcctcacctgacatggcatgactacatttttcgtaatatcagctaacccaggtttctcttgtctttacggagcttccacagaaaacccaggcactccgaggtgaaggtcatccttgtacacaatcagctggccattgcttcgtttgatggacgacttgctgctgaagaggaaatcagttacaccgactcagatccccacatgaggactacctcaccgtattctgatctcaaacgattcgtaaaactagccttctgtggccatgagagagcaacgcaggactcttctatgacaactagccagttgcagcacgcatggaatcgtcaaagtcaggtactcaggtggggaattagtattggaacctaagcccgaaagtcagtcggtcacagcattgtgaacgcatgccatcgtgttcctgcctaaccacatggtgactcctggcctgtagagcaacaccgtgaacacaagcaacgccaaagtctcctttcgacattatgtccagacatttgcagtgggaaaaaagtatgctttaatctttccctgcagtgttatcccctaaccaaccgaatgaagagactgtttcaagtgacatggtatcaagggagtaaaaatttgatggaatagaaggcaattttagtcgacttttctgtttaagaacggtctgaagaagaaatatttgtgctctcagagcatgagcactccagaaaagaaactagatctttagatctttgatgtgatacaaattctcatttatagatcgtgagatggttattttctccttttggcagtagggcttcttattggctatgtattttaacaccaaaccataaccacatgataccaaaattttagcaataccaaatcgtgtattaaaccaaacgagcccttcaagtctcatcgagggacatcaaagcagaaaattgtgaagatgtgatggtagttggatatacttcatggtgaaaacacactcgctctaatatactcatacaaccacttacacctagtcatgcaaactcaacaaccaaatcagcgaaataatattcataataataaaaacatttaaatagcttttaaatggcgttacacaaagtcaccaaccacaaagtgaaagaaccatagagagagaaaaacccactagaaataggcattgaatgaatgatggagtgacgaagtaacaataagcaactcacaagttgaatgtgaaaaacataagaaaaacaaataaaaaaaagatagtcgtaccgctggatagggttggatatggttgaatgagtaaccgagtaataagatcaaataagtaatagtaatatggcattatgtttagcttaaaaaaagtatatgtatacatttatagggtaggctcaacttggttccactggctcactgccctatctagcactttcccccctcatcttcttcattgcccctctataggctcttatcatttttctatttttcaatttttcgcgtgacctcaaataagatcataaaaatatcttagatatagaaactagagatagttggatgattcaatgaagttactttgagtatacttactaagttgaaaaaagatactgaaaaaggtgtaaagataaaataagtttaatataatagatttctaaatttcacacacaatgccaataaaatgcatgctagcatcacaattgtaccaattcaaactaatgaataatgttggatgtacggttgaatggtgggggcgaataagtaaggggtgtgcttagtatgaaagagcatccatacacgcttcaaggatgaaactttacccggttttactggctcgccgcactattaagtactcacttttccctcgttttctcctttatccctctataggctcggggtctgttttcatcttttcgattctaattgacctcgcactaaaataagccaatgataacacttggatgatgtgctgaagtaatcccgagtatataactagtttaaaatatatgcatccgaaaaaaccgtaaaagataaataacgcctaagaacatcaacaacaactttctaaatcttacttactaaatgctaacctaatattaccattgtaattgtatcaactctttttttttttgacattggccctgtttagattccaactttttcgtcacgtcgaactttcccacacacacaaactttcaacttttccgtcacatcgttacaatttcttcaaattttcaattttggcgtggaactaaacaaagccattgtaattgtatcaactctagccccgaataaggtgttaaaagaaaagagggagggaaggaaaaaaaaataaaaaaacaagtctaaccccaaatagctttagatacgcgaaatggggcaaaaacaaagcgatggccgaacacccgtacacgtctgaggggtgggcccgacccggttccgccggctcgtccccccgctttcccctcgccttcttcatccccctcctccctctccattcctggatctcctccgcctccgcctccgcctccgcctccctcgcaaggggtctcccacgcatcgccgcccgccgctgacgcgtgggagccaccccttgcccccccccccacaccacccgccgcttcccatctccgacaagcgcctacaacggcgtaagtagccctaaccctaggtcgctggatgcgccgatggccgccgccgccgcagcctgcgtatagagccccgacgagggcgtggagatccgggaggtatgggcggggaacctggaggcggagatcgcggcgatccgcgacgaggtcgaccggtacccgtacgtcgccatggacacggagttcccgggcatcgtgtgccgccccgtcggcaacttccgcaccaccgacgagttcaactacgccaacctcgaggccaacgtcaacatgctcaagctcatccagctcggcctcaccctctccgacgagggcggcgacctcccgcggcgggggacggggggcaggcgctgcatctggcagttcaacttccgcgggttcgacccccggaccgacccgtccaacgccgactccatccagatgctccgcacctgcggcatcgacttcgatcggttcgccgctgagggggccgacccgatccgcttcgccgagctgctcatgtcgtcgggcgtcgtgctcaacgccgacgtgcagtggatcaccttccacagcgggtacgacttcggttacctgctcaggctgctcaccggccggaacctgccggacaacatgcccgccttctttgacctcatcagaatctacttcccggtgctctacgacatcaagcacctcatgaggttctgcagcaacctccacggcggcctgagcaggctcggtgagcttcttgatgtcaagcgtgtggggacctgccaccaggccggctctgactcgctgttgaccctcgggtgctacaacaagatcaaggaggtgtacttcaaaggatcgaccgagaagcatgccggtgtgttgtatgggcttgttattgaggatggggtgaacagaccaccaccaactcagcccaatgaatgaatatggttagttaaataaaacaatctgaaatgggaaaaaaaattgaaactttcgttggtgaatatatgttgtctgatctgatctgatgatttgcttatggtttccatggtagtttgttgtgccttgctgttactatttgttgtagttgagttgctttagttgttttgtctttgactctttgtgctgtgcaatcatctttcattgtttgcccaatttttatcgctgactgcactgtttagttcaagtagcaagttcttgtcatgatgaattagtgcgaaagatagtaggatagttcaaattatgtttagggactattgcattagatatcttggacagcttgtctggttaattttactgcaaataagcgattgcttcgcttccatacaaaagtatgtatttaatatctgatcgttctttttgatgttgttccctgcctgtgcaatcaggcagttcgtcatggtgttctgaaggtacaatactctcagcatgacaattcttttttatgttgacatgcctgtttgtgtggtggttgtccttcgtttctcagtgggtacttctttatatcactgcttgtagtatgctgatgaaatgcaaaatcttaagtggtcactagctagactacgaattatgtttgtttcaaaatgttttcatatgtctattgtatatcattgtttgcatgtactggtgcctagctagcacctttacattatcatttataggggtgctaatggactggatttaagtgggctgaatgggttggatctaagaacgggttggctttggttgggtccgactggattgatttaagatttggcctggatcgatttggggctacaagtgaagcggtttggattggattggatctggctgaagtgtttttggttttaaaatggattgaacccatggaccccaaccagtacattgccttggatcctggtcgagtggttgcgcaccgggtgtccgagcgtaggaggcgccgctgtccctcccctccccccagtcatcttccgtgcacgggctgcaggaggtgccaccgctgtcctgcctccacccaccctgggcacagtcgcgccgactgttagaacatcgacctgagggtagtgaagtgaatgaggtgagcagagcaaagaacaacatcgagcaaccaactgggagtaaaagagatgagattctttggttgaaatctcaaaaattggaaaaaaaaggggacattgaatgcatgatttcttgaagatttcttgaggatttgttgtccagcactcagcaccttaattttaaatctgtctgtcgccatttgttcagcggcttcatgtctcagttattgtcctcgccgtcactgtcgcgtgggtgccagcagacatggtgcagagtgatgtcatcttctgtcagcggtggcactttctcgaaaccagccatgctggggcacggtgggagacaccgaatgtcgggttgccttgtctgtggcaacagtatggatttcattttctctaggaatggtctcagaatgggttcaacctattattttgcatttggtttggattagcttttgtgttggggtgggttggcttggattctacaagtgattagttgatttggagtggactgggaaatatgcaatacagacaaatggggcggggtggatttggaatgggtttcagtccactggcacccctaatcatttgatggacgttctgcatatcggtaacatgggggaactgaaaagattaacatgatctggtttatggttgagagtaaatatagattgttttactagctagcttgttttagcttcgtaacatgaattttagtattcatatttttctatgttgtttattggttacaaatgacaccatttcatcagatgatgagctttaacaaatgcttcacttgagtttggtcatgtggtctgatatcttcttcaatttacatttaacatggcattcctctatcgcaactgcttgactgaacttgctatcaatcctatagtttttctttactaaatattgatgatgacattttttattccttatactagatatttgatggtctgtcatataaaattcaattgaaattaattagacatctataggaatgtattactttgtgttctgttgaccagtttctgcagttgtgcatttagctattcattgtatggctgtttcgtttgcttttatctctatatgtccggttgttgactgtttatgtggcctttgggaggacttgcactctttctgtttgatgtttttcttcctgttacttcagcaatacctatgtatgaatgctaattatgtttaagcatttctctcgaaagaagagaggacttataaataactttacatcctaattatccagtaaagaggtacttctgtttgatgtttttcttcctattacttcagcaaaacccatttagacatgccaattactttaagcctttctctagaaagaagagaggacctgtacttgttttgcatgaatagtgttcctttttgaaacttagtagtattatggtaatgaacttctggcttggtttctgaagtttcctgcattggttatggtcttggtttgccaatcgtcacatttctgtacatatggcagaacacttgttctacactgacgacagagctcctgctcttatttgaggtcttcccaacagagaagtttgagtctgctcatttccttttactgtattatctgatttggtctactctgtgcctgtggtttgatatttcattcccaatggtatgatcgattgcctttgtggtttgatattttatcccaaggcaggacctgctgcatcatatatatgaatccagagttccattgccgactaatgtggatgatcctattaataggatcaacacaccaaattgtttggtttttgtactaagtaatattgatatgagccttaaagatcctttttgtttcctccctacactgtttggatgatctaataggatcaacacaccaaattgtttggtttctgtactaaggcctggtttagtttctaactttttcttcaaacttttaacttttccatcacatcaaaactttcctacacatataaactttcgtctttccgtcacatcatttcaatttcaatcaaacttctatttttgacgtgaaataaacacaccttaagtaatattgacatgagccttaaagttcgtttttgtttcctccctacgctgtttgcatctgcttacaatgcataccagatgcttatctgctgtcagaagcttactctttgtttgactagttggattagaaatcaaaatggaattaatttactggcgttgaatgcggctatgcataactgcccatggctggattgatccctatcattttggctactccctccatcttataatatagcaatctaaaattagatggaacactttatagtacaacgaaacgaatcgaagtatgtcttaactctctggataggaagtatgtatgaactcgttgtactattaagtatctcgtccagtactagattgctatattagggacggaggaagtatcattttactcttaaatataggagtagtacaaaagattcctctgctgccaatcaggttggcacggatttttcctttttttgtttataggaggtaaaatcgattgttaccactactacgcctcgatcacaaaccttgagtcggcgaagtgtatattttgacctcacacgcggaagataaacttcacagagcttaagagaaaaatactttttatgaacggaagcttctattaaccactagctcaagccgtcggaccaaaaatattttcctcggtgtgcacaacatgccatttattgtgcactactataaatatgaacacccattttataatttagaccactaatccataggtgatgcctaaagttttttctatttagttttaaagtttttagggatgccagtgcatacttggaggcctcggtgcctctaggcgaatccgtgaacaattataaagcttggcgccaggaaaatacatagttgagcttgccattgattttttaaggaagggttaagtccgatttaccccctagactcttacgaaagtatgctttaccccctaaactatgataccagacataatacctcctttaactattcaatttggacacttaaccccccgcgaccaatttcggctggttttacccctttggtctgacatggcactcccatgtggcaaatgatgtgccagttacataaaattatccctaaatagtctaaattatcctctctctccctctccctcgcgaaaaattccccacccaaacccctaaccctagcggcgcaggtggatctgggcggcgcaacggcgtggtgaagggctgcactggggcgtggtgaagggcgacgtaggcgaggctctgcggcgcgagcggcgcgcgctgcgcaggctccgacgctcacacggcggagcgagacacgcggcggtgcgacacaagcgcagcggcgaggcacacgcgcagcggcgcgacgctcgcacggcggcaaggctcaagcacgggacggtgcacaggtatgccacagagctcaagcatgtcactgatgcaaaggtgcagatggaggccaatgttgctaggcacaaggaacagatggaagcaatggggaagcaaaaagatgctggaaaatgctaatctagttgctaaaaataatatattagataagggaagatgtgtgcttctgtatgcatttgtagcatgtgtatttgtaattctggggttgtatgttaagctgtgatcttcctgtatatgcaatgtactagcatgtaatcactgcatgtaatcagtactgatatatgtcatggagaggctatttgaaccagcatgtttctcaatttgtgatggtcatgttttgtgcaataaagtgtgtgcacagttagtataaatcaatcaaggaggctattttgaatagcacaagggaatatatgcttcagtg

SEQ ID NO: 70036 - DNA, 1256 bp, Oryza sativa
cgcagcgccgcacagcctcgcctgcgtcgcccttcaccacgccccagcgccgcccttcaccacgccgctgcaccgcccagctccacctgcgccactagggttaggggtttgggtggggaatttttcacgagggagagggagagaggggggggagggggagggcagggatatttttatgtaactgccacatcatttgccacatgggtgtgccacgtcggaccaaaggggtaaaatcagtcgaaattggtcgcgggggggattgaatagttcaagggggtattatatctggtatcatagtttaagggggcaaagcgtactttcgcaagagtttaggggggtaaatcggacttaaccctttaaggaataacctatatcacttagttgaaatttggcccatagttgaaagaaaaaagatttacttttcctaatatttgcatgtcaaatatatctccaacacgcattgtaaattaaatacgtgtctaagttttcttttcacacaaggcagtaacttagctttgataaaccacatgaaaaaaaaattgatgggcccgatacatcaacattgtccttatgcacacccatgatgagaatatatgtgtcctattaagacgcacttatagcaagcatttttgaagaaggcaactttgttaaaccacatacctgaatactttgataacatcagttggctttctcagtatttcactcctagcttgttggatttcctacacaaatagaattgtggttgctacacgaaaactaattggatttcccatgcaattttacaggaccaattaaatagaaatgtgtttactacacaaccctataaatagaaatgtgatgacatcgccgttgacagtgttcacctcttgatttcatggaaggtgcgtgaggtgggatgatatggagagcgagggcttccataagataatggcctactttcccgacaatttggtgaatctgccgcctgtccctgatgaggtgcatatgtgcatgtcacaaaccatagatctattctccccactatcctcaccagtgttaaggaggatggtgaccaagctgtttaatagccccactgtgtgggcaccatcacaacggccgccaccattctagcgctaccactgatggtggagcttgacgcctatgtccactacatcatggagtctgtcggggagctactcctcgtgagcatgctctagcactagcatctggtacacaaggtggacaccgtgacaaggtgtttgtcccggtcagaagcc

SEQ ID NO: 70037 - DNA, 18095 bp, Oryza sativa
aatagaattgtggttgctacacgaaaactaattgattttcccatgcaatttacaaggacaatttaaatagaaatgtgtttactacccaaccctataaatagaaatgtgatgacatcgccgttgacagtgttcacctcttgatttcatggaaggtgcgtgaggtgggatgatatggagagcgagggcttccataagataatggcctactttcccgacaatttggtgaatctgccgcctgtccctgatgaggtgcatatgtgcatgtcacaaaccatagatctattctccccactatcctcaccagtgttaaggaggatggtgaccaagctgtttaatagccccactgtgtgggcaccatcacaacggccgccaccattctagcgctaccactgatggtggagcttgacgcctatgtccactacatcatggagtctgtcggggagctactcctcgtgagcatgctctagcactagcatctggtacacaaggtggacaccgtgacaaggtgtttgtcccggtcagaagccttgacaaccgctccctctttatcagctagatcaggagtttctctgtcgaagctgacaacttgcctactgtcgaggctggctgcatctacttcatgaaacagaacctggcaaacaacaagtatttttgtctcacactcagatgattggaggaggccatatgcatggttaatctacgcaatgttgctgaagcagaaggttgcatcctccctctcaatcaggagcaagtcatgctaaattactatatcaacaatgagaagtcaacaatgctcaacttattagcaggtgataggtacataacagagagtagtctagtggcgcagaaaaaacatcactaagaaaaaaaagtttgatggtttagcaaggcaacacgtagaaaatgatgcacctttgtggatggtggatggtgaagtcggaggagatgaagggatggcagaagcctgattgagtgaagcatgttgggcctgacattttcccataatttctctcaagataaaatgtgtccaacccacttattctaaaatagtatgatggtggctagggtttgaaggaaaagagggtataaacctagattagcggcataacacgtacgattgatattcatccaatggttacaaattgagtagccaattacaaaacatgccagttaaaaccaagatccctctttaaatattagcgacaagtagcgctgctcatacagtcacatgcattgcatgtggaagtgcaaatccatgcacataggaacaagcacctacgagggtttagatcttgtctccactggccgatcaaccatagtggtaatggcaactgactgatccctgccccctcctccgacttcatctatcacgtcagtgactgtctcttagcttccgaagacttcgacaactacgacactttgcgcctcatctgctccaagtggtgtctggcaccaccaaccctaagacgacggacttcgacgatgcagcttcctcaagaagctggccattctcgagctcaacggcaatagatacggggacgcctccattgccacattcttcaaacttgacaccggcagcttcgtacgcaaatgtgtcctagtgctacgtgactacctcttcatcgccaacatggccattggccttgtcatgatcttggagatgacgccaccccataagaccagcatgctcaacccctttcatgcgtaaggtcgcccattctagggagctcatccatgcggaggaggtcagggaggtggccacgacgaactcaccattgatggtgttcacctcctggttccatggaaggtgcgtgaggtgggatgatcaggagagcgagggcttccataaggtaatggcctactttcccggcaactttgtgaatctggcacctatcttcgatgaggtgcatctcaccaaccatggatccatcctctccattatcctcatttgtgtcgaggaagaatgcgaccaggctgttcaatagccctgctatgtggacatcatcatgatggctacaaccattccaactctaccgttgatggcagaaaaaagctcattaagaaaagaaaagtatgatggcttagcatggcaacatgctgaaattgatgcacctttgtggatggagtatggtgaggtcagagaaggtgaagggatggcagaagctaggctttaatttggaggcaatgactgagtgaaggatgttgggcctaacatttttccataatatctctcaagataaaatgtgtctaacccatttattctaaaatggtatgatgatggctagggtttgaaggaaaatatggtataaacctatattagtgaaagaggacgtatggttgatcttcatctagtgtctataaatcgaatagccaatcacaaaacatgccaattaaaaccaagacccctctttaaatattagaaatgtgtagtactggtcatacactcacctgcaccacctctggaagtgcaaatccatgcacctaagaacaagcacctacgagggtttagatcttgtgtccactagccgatcaaccggtagggaggtggctgtgacgacctcgccgttgatggtgttcacctccgggttccatggaaggtacatgaggttggatgataagtagagcgatggcttgcataaggtagcaacctactttcccggcaactttgtgaacctggcgcctatctccgatgaggtgcatgtcaccaaccatggatccatcctctccactatcctcgcttttgtcgaggaagaaggcgaccaagctgtttagtagccccgctatgtggacaccatcatgatggccaccaccattctagcgctatcgttgatgttcagagcttgacgcatatgtccattgcatcgtcgaatatgcctgagagctgctcctcatgagcatgctctagcgcttgcacctggtacacaaggtgaacaccatggacaaggtgtttgtcctggtcagaagccttgacaaccgctccctctttatcagctagatcaggagtttcgctgtggaagccgataacttgcccaccatcgaggctggttgcatctacttcgtgaagccaaacccgacaaccaatgagtatatttgtctcaccaactgatgactgtaggaaaccatactcatggttaatctactcaatgttaatgaagcagaaggctgcatcctccctctcaccctagagcaagtcatgcagaattactatatcgacaatgagaagtcaacaatgctcaacttattaggtggcgatgggtagataatagtgagtaaaatagtgggtaatccagtggtgtaggaaaaaatctcatcaataaaagaaaattatgatggtttagcatggcaacacgctgaaaatgatgcacctttgtggatggagtatggtgaggttgaaggaggtgaggggatggcagaaactaggctttaatttggaggcaaagactgagtgaaggatgttggtcctaacatttttccataatatctctcaagataaaatgtgtctaacccatttattctaaaatggtacgatggtggctatgatttgaaggaaaagagagtataaacctagattagtgaaacaggacatacgattgatctttatctagtgtctacaaattgagtagccaatcacaaaatatgccagttaaaatcaagacgcctctttaaatattagaaacgtgtagtgctgcttatacactcacctgcaacacctgtggaagtgcaaatccatacacctaaaaacaagcacctagaaaggtttagatcttgtgtgcactagccggtcaattggtagggaggtgattgtgacgacctccctattaatggtgttcacctcttggttccatgggaggtgcgttaggtgggatgatcacgagagcgatggcttgcataaggtaatggcctactttcaccaaccatgaatccatcctctccactctccttgccggtgtcgaggaagaaggtgaccatgttgttcagtagccctgctgtgtggacaccatcatgatggccccaaccattctagtgctacccctgatggcgaagcttgtcgcctatgtccaccacatcatggagtctgccagggaactgctcctcgtgagtaagctctagcgttggcacttggtacacaaggtggacaccgtggacaaagtggttgtgcctgtcagaagcctcgacaatcattccctcttcatcatatagatttggaatttctctatcgaagccaacaacttgcccaccatcgaggcttgccgcatctacttcgtgaagccgaatctagcaacctaggagtatttttgtctcatcaatagatgactggaggaggccatgcgcattgtgaagcagaaggctgcatcctcccctctcaccctggtgcaagtcatggtgaattattatatcaataatgaaaatttaacaatgctcacattattagacagtgatgggtacaaaatatttacttatccagtgctatagaaaaaacctcatcgagaaaagaaaagtgcaatggtttagcatggcaacatggaggaaagatgctaaggaggatgagggtgatggcgactctttgacaagcaagactagtgcataaaaggttgcacctttgtggatggtgcatgttgaggttggaggaggagaagggatggtagaagctagggtttaatttggaagcaaagaatgagtgaagcatgctgggcttgagattttctctgaaatttttctcaagatgaaatgtgcctaacccatttattctaaaatggtataatggtggctagggtttgtaggaaaagggtataaaccttgattagtgaaagaggacatacgtttgatcttcttccaatggctacaaatcgagtagccaatcacaaaacatgccagttaaatccaagagcccaattatgtcctaatgatatgatccctctctacatttcatgtcgtttgcttaatagtactacttttgttcgatgagatactgtggtgaaatcatttgctttggcttccaaaaagatatgttgctcccttcgttttttcatatatgacactattgactttttgagatacgtttgacccattcgtcttattaaaatattatataattattatttattttattttggtttgatactttgttgtgtcttgtttattgctaaaattttcttgtgttaccatgatttgagagttcagttgcttatgtggcatcacctatttaattattccatcatctagaataaaattgtatttgattccaattagtagttcactactcaaaaacctgtgcgctgcatgggatagtattttaattacatttttactatcatgttcaagaaaatgactttcaaatataaataactaaaattaattccaaatcagatattaaagttttaattatttgtaggcccatattatattatggtggtttgctttactttttttttcaagtgagctctaatagtgtttagtacacttttgctaaaactcatcagtttttttcctgggttatatcttttcagaagaaactgggagacccttttctgtttgcatatgtggttttactctttttttatatatatagatatgaagctaatatctttcttcctctaacacaatgtagattttcttttagtggttggggggaaggggtaataattctgtccattagtaggtttcttctttcctctaagtgcttcttggcgtttgaaagatcttattagataaactagtgagcagtccactttatgaaggttttgtccaactggtcataggtgccggatatcctaaccggcacctttgatttgttggtgtcggatctacaaccagcacctataaaacatatcggtgcccattttatgtaaagaactggtacctatactgccatataggtgtcggttcttaaatcgactgccacgtggacaaccttataggtgccggttgtactagttcttgaatacaaccgacacctatgagaagtatataggtgcttgttgtagaccgcgtaggacacatggcaattttataggcgcgggtttgtaagaaaaattggcacggcacctatatcttggcaagaaaaaaatggcaggagctccaatttcacatacaaatcacacaataatagaacttcacatcaattcacacccattcatcaacatacaaccacattcacattcatccaaaatctattcaattccatatccatcatcaacatacacacattcgcattcatccaaattcacccattcatcaacatatgcacgtgcctagtccatttatcgtaaaactatatgttggtggctagggtttggaggaaaagagcggatgagagagttaaatctagattagtgaaataaagactatgtatgctagatcttgatccaatggctacaaatttaagagtatgcacattagatcttgatccaactggtgcagtttgagtggccaatcattttgttgtgtgatttcgtttcaatgagatattgtgtgatcttgttttgcttttgttttgaaaaaaacttgttgtttggagattatactcgcaagccttctttatcattttgattggaatttgcctaatggaacaggcatatatgagctagatattacagaaacatatggggtcactgcgcatcgccgaactgagcttttgctcaaagctactccagtgtatgcatgattggtcggtacacctagtcagatatgtactgtcaagacaaatgtctggtctcttaaggccctctttgtttaggcttaggcttattggcctagacttttaagtcagcttattggtttatatgatttataagccagtggatttaatgtcctaagtttagtggtggagtcatacatctatctcatataagccaaaaaaagcttctccaacctagcttttggcttaatagtgttagagtggcttatggcttaaaaaagccaaatgaaaaagctacttgtttattttggcttagacttttcgacttataagttggcttataagcctaatcaaagagggcctaaacactgtccatgtttgcctacttttgtttatattataaataagaaatgcaaaatgtggccacagcgagtcgatttgagaccctgaagatgtacccaagtttgatgtttgctcaatatagcactcgcaagtcttctctgccatttcaactaggagttatcgggttgtgaaaccaaaaggagctagacatgagtgaagtggtctgaaagcttctcgacacactgatctttgcctagaggcaactcctttgttgccacagcctgttggatcttacgatatttcttgtaggagcactggaacagctagccacgtatctttcagaaagaacagctaaacggtgtgtttgcaagggggtgttcccaacactttcctctcgttttctgcgcacacgcttttcaaactgctaaacggtgcgtttttttaaaaaagtttatatacgaaagttgttttaaaaaaatcatattgattcatttttgaaaaaaaaatagctaatacttaattaatcacgtgttaatagattactccgttttccgtacgcactatacatgttcccatcctcccgtagcaaacacagaagctgctttcgggaggaggggttgggaatctccttcccggtacgcaaaacgaaacatgtattattgcatgattaattaagtattagctttttttaaaaaaatagattaattggaattttttaactttcatatagaaaatttttgcaaagaaacacatcgtttagcagtttaaaaaacgtgcgcgcggaaaacgagggagataggttgggaacttaaaggtaagaacacagcctaagaaaagctccagattacccactgcaggtggtattatatttgtgggtcacaaaccctgggtcagcatcctgcgtataattccagacttataccaagcttaacataattgcacttagcttaatagtaaacaaacatagttgataggtgtgcttgctagcgtcagcatgaagagcaaatacaaattatacaacagcttgtcgttctgaatattagaaagtaaattggctacatgaaacgtttgtatatttctcattttctgcacatcgtcatctataaccaacaaaatactcgggactcagggtttaggtcccttctttaaatttaaaagcattagcagaacaaaatgtcagtaaaattctggtgctatgttaaccttggacgcacccatgggaatgttgagtttacttgcttttgttaacgggaaggtagacgccctctgttgccaaccaaatattttcagctcgcttctctctaacgccacatacctgcaagataaatgctacaacttagcaaacaaatttccaaccaaatcacacttggtacctagagaattttgttttcacatatggtagcaaacctacatgatatgctttttttttttactttgttccaactaatacatactccctctagatttgagtttttttttttttggacagagcgagtacaatacacggtaactaataaaaagatgtgatagatacaatatgcattgaattaactaaaagttcataccaactattaagtaaaaatgtcacatccacaaacccagtcactcaaatatccctataaagtttttgcaataccatacttgtactataaccgtgtaatgatctaggattagtttgtttctgctaatctaccatctaacacttactcataatctggaggcaggaaataaaccatttactaaactcacctcttgctgcccaccaccaagcctgttgtacttcttgttgtgactgtgcagataacctccagtatcaacatgtcggagtcttactttctgatcctgtttccatagctttccacctccctcaatctccagcctgcaggacaccccaaaaaaaaaatccactaagccatactaaccaaccaaatggcatttatattgtgagccttaagtaattgcacctccaataatctccagtatctgattgtccatccccaccaaaacagctaacctgtaaaatcacacatacaaacctcagggattatatttgagaagataatgcaaaagaaacgcaagacatagaacttgcaatattatcctaatttagcagtgaactaataagtacggtaatttcttcacagtaagataaatcgatatatattcgtaacatacttaatcctgacatactcatacttaacatgcactgtaatgtggtgtgaccattgtaaaccactttgcttcagatcagcaatgttcaaacttcaggacaaaattagctctaaaacaaggacagcaacaactactggttattcaagttaacaaagcaccgtactatggaagatatactaatggtagttttagtctcattagttgcaagcaattctaggcactgttggccatgtaattcatgaacattagcaaatccagacagtggatggccgaatgatgtactattgcttcttgttttgtgttcttgttttcggataaaatacatatcaaattggcagatacgctgtcatctttcagctggtgtgtacaacaatatgagatcagctagacacaatatgtccacagatagggaaggataaagtaggtcttctaatcccatgtactattactgataatcatttgaagagagctcaatcagtttgaagagcactcaagcttttgggaaaaaataaactcagaatataacaactgaggtcctatgaaattttaggaactaaatgttgccagatatcacatgggatattcatgttgaaccaacctctaggttaccggataatggtgaagcatgcaagtggctatgtaaccatttccgtgtcctcatgtgttgcaacctgatgatgctaccggtttcaatggcatcaccctgtttagctgatgaatctggagagggccgcacgatctgcagatatacaagtaatcaaatagcatcagaaccctgattatgtctgattggactactcactacttgaatggcaatcatattcacttcagaatgtaactgctaattcttcagacgataaataataaagttttgttatttggggttgagatgtgatccatcatcctacacatataatagcagtaactacataaatacacaaaaattcttttgggcagtttccataatttgaacaatataggtgccattgcttacatatctcagtttgataattagtgtttagatattctattgccagcaggattctacaccctcaaatcaacactgttgagcacatttttaaaccgtcacaactcccaagcatatttgcacactgaactcaaatcaatgtgtaccatagaaaaaaatctattaatgtgagtagatacttgcattcagatcaatattgaatggttggttcaatcacatgttggcttgtacaaataggtagggatcaaatcaagagccctattataacatgaacgagaggaattacggatctacagaatgagacgcacccagtagctattggaatcatcgacttcggggaagccagtgacggactgctggccgctgcctgagccatacggcacatcgtgcgagtgcagccggtgcttcgtcttctcgtgcatcagcttgatggtgctcccataagccacctgcaacgccaccacacagatccagatcacacccgaacccctaaataaataaaaaaattcgcagatctcgagatcggggggaggcaggaggcaaacctcgacgccctccgccgccggggaggcggccgcggcgcccctgtcgaccccgtagccgctggcgccgaggaggaacgcgacggcgagcgcgagaacggacgcggccatcgcgacggcggccgcgctacgggacccctgtcgcggatgcggcggcggcggcggcgaggaggatgaaggcgtcgaagaggcggaggaggcggagctggctgtgcctctcctcttggctgctgcggaggcggcgccggctgaggccggcggtgccgtggccgcgggcggggaagcgcgaggcgctcacggtggcggtcgatctcgatctctctcgcgcgcgcggcgggcgtggggtgggcgtgtgcgtgtcgcggccgttgggaatcgggattttgccgagtcggggacggggggaggaggaggagtctccgtgggcgtggagaatgggggaagtggggaagctatacgcgtttgggtcgctggggactggggcccagagcccctccacgtgtagtgggcgaatggagggacggcacgtggcacggacacgtcgaagcttggtgtgcagaccgtaggatgcatgatgggcgacttggatgcagcgcggttaaggtcgcatgcgttaatgggccgtggctttttggtctgtactaggatccattcttgaaagggataagtctattttaccttgctcaacttatgcgggagagctaattcacgcgcgtgcgccggcggcgcgcgtttaggcccagaaagcccagcgccagcgcgcgcggggacagcgtttctttttttttttcgcttttcttttttttccgtgattttttcctttcctttccttttttcgattacttttagaaaaaaatttcgccttcttttttccgtgattttttccgctttttattacttttttttaatcttccaacaacacgtgttttttaaatgttttgtgttgaaagtttttaaaaattaacttaaaaatttttaaatctcgagctgaaagttttcaaatctcaagttgaaagtttccaatcctgagttgaaagtttttaaatccgagttaaaagttttcaaacccgagttgtcagggttatggataccacatacctaatagtagttgactaaatctcggtaggacccaccacataccatatcttatacggaaacaactttcggatataggaagagttccgcataaggaaggatgaatagacttctacatggaaacgacaaggactactccaattgtatccatattggtttccctagttctacttggacaaggggacacctatgggtataaatacaaggccccctaggagtagagaggacacaatcaacatacacggaacaacataagccaacatacgccaagacaagacgccggatattgacttcagagataaacatggctagtcccctacggtgcctacggataccgtcaggagagacatagcactgtctttgatctcgccggacacgaatttgaggaggaagaccactttgttgtcgactacgtgatgatacttcaagccgctatatcgacaacagatagataggctacctcaaatattgtactagtgtgattatggtgaataagagcaacgaccggcttcggccaacaggatgtagggctattacctgataattcaggggcccgaacctgtataaaaattctcgtctctgtctcttttacctaagtctcgcatatatcctggtaccaacgatccccatactgtgcaaataccagaatcgcgacatcaaacgtcgacacgagttgaaagttttcaaaatcctgagttgaaagttttcaaaaccgagttgaaagttttcagaatcctgagttgaaagtctttaaatccgagttgaaagttttcaaaatctcgagttgaaagttttcaaaatctcgacatgaaagttttcaaacccgagttgaaagttttcaaaatctcgagttgaaagtttttaaaccctagtggaaagttttttcaaatttgagatgaaaagttgaaagttttcaaattttggcttcaaaaattcaatttccgagttgaaaagtttttaaatatagactgaaagttttcaaaatttgacttcacacatagattttttttcaatctgttacttaaaaatatcttctagaaaaaaagtattatcttaattaccgtcgttatctaaaactaacatgttagttacgttagatatactcatcgaaaaaaaatccaccggcatacgcgataaaaaaaaccacaaaaaaaaataaaaatccgaaagtgaaaaaaagagtaatagaaagaaaaaaaaaagaaaacctaccctaggggctgcgtgcgcgttgccggcgcgcacgcgccaactaggaagcccccaacttatgccctgattgaatcacatcccttaaccgcaaaaccggatataactcatccctaagtcccaaaattgttacaaatcgactccccggcggtttcgtccgacatggtatctttgaccctgttgactggctgaatcagcttgtgggacccacatgtaagtgacaaggataaaaatgaaaatggtggggcccactgatcagctccaccacagagggatgggatacggcttggcgcggctcctcctcgtggcgctcgccgcgctctcgctgctcgccatggggggcttggacgaccaccatgccggccttagcctcgccgcgcttccgcgtgatgggatgagcgagccggctggtccagctggagaaggtttgtcggcatccatgcaagtaaacagcgagggtgtgcgcttgccttgccaacctcggtggcaacgccgttcttaccgtctccggtttccggtgccgccaccgagatagaggctgaggcgataagggacgatggaagggggcgcagaggacagcgatggtcatcgaggtgcttcaccatctgacgacgaaggagattgacgagggttccggccgccaccatgtcggaccccttcttttttgccattgtcaaggccccacccatgcttgaacggccagatttggtgccctgctcgagctaggacgaggggatgagaggaaaggggaggcgacgacactgagtcgagctgggaagagggtaggagagggcagggatggcgtcaccacagcaccaccacctcgacgtccattgtcgccacaggcccgcaaaactccaccgacggctgatgatctcctccccacacgcgttgcggttggctgacgagctcctccttccatgcgcggccagctggctgccaagctcttcccccgtgtgccgtcgccaccatcctgcctctatactaatgaaaggtgagaaaagatgaagagatgaaagagagagagggcgggaggagagggagaagatgggatgaggtgcagggcactgacaagtgggtccacatcggacgaaaccaccttcgaaactgcttggggtgtcgatttgcaacggttttaggagttgggggacgagttatatctggttttatggttaaaggatgtgattcaaccagtggcatgagttgagggaggcaaaataaactaattccttcttgaaatgtaatgttctctataataggatggcccaatgaataggtagtttctctatagggataagtccattttacccactcaacttattgcgtttgcatgaacaaaaaaacgtccttttaactccaaaatcggatataacaaaacccttaacttttaaaacaattatatttaaaccaccccccttcttgcagcgcacacacaccctcggtctcaaccaaagtaatttttgcctacgtggcattgacatggtggcccaatcaacctttaagtttaaaatatagcagaacccaccttgtagtgaccatctttctccacctcctccattttctctcgatctctcctcacagtcccgtagtcccgttgcacccaccacctactgttggtgggcttttcgcctcttcccgaatagccaccactgtcaacggggctcctctttgaggaccagccatctcatcatagaaagagggaggggtaatgatctagcggcagggattgtgcggcggcgttgatctggcgagcagatggtggcgttgatccgtgatggagggcttgcatcagcctgatacggtaaagggcaacactactctaagggatatcatgatgaaggaaggagttaatctggtggagagcacgtccacaaccatgtagcctgctggtagagtcggcatccctcctagttgtagggtgctatctttggtggtggactaggccataatgtcgaggcctcagtagtagagaaggatgtacggttgccgctgacgtgtggctcccatctttgtttatttgttttgatgttgaatggattgtcatgtcaacaccacagttaaaaaccacgttggtttagaccattagggttaaatcgaaaggttctaagaattgagggtgtgttatacctggtattagagttttttttttagagttttgggctgtttttcaatatattaacgtaatactaggtaagggatgttaaatgaactcccagagtcaacgttatggaaacatcaggctcccacagagttaaatctggtaagtcccacagtgcacaggggagtattattaatgcagcaaccgggaaaacattgggctaggtacgtgccgatccacagagaggaacatttaaaagaatcgagatcaatggtcatgtactgctcagcgatccacagacagaccacctgcagacctgccttggcttggctgcttccctttccagcgtgctgaagctgagcagagctaccgacgagtccaagattcagcacacagatcacacgaccgtgcctacacttcaacacttgtacctacacttcaacacctgtactagcagcagccagcaaagtgcccgagcgatcaacctgccacttctttctggtgctactagtaacaaggagtaataaagtggagtacacttcttccatccaaaaaaaaattaatctaaaattgaatttaacataatccattataataaatctggacgaaacttctagattgaatcttttagggcaattacaaatttaccactattttaaatcgttattgtaaaattatcaccagaaaattacaaaaatgccactagaattatcattcgagttgcatccttgcaatattagaaaaaccgatgacaaatttgtaaataccccttgatcttttgtgggacggataaagtaattcagacagtgggtaggtgccccttggtttgctggtgttagcctttttcatgtgaagaatcatcaaacgtttggatcattcatttcaacagccggctgcccgaccggctgccgatgcgactacgcaactgaaaaatctgtactcctacctggctgcagggcacagcaggtggcaatctcattcttcgggttggtcacgagacctgcagctatctacggcttggaccaaaagagttattggcattcgggtgcacggcgcgatcgcgggtggttcgctgccgctcacggcgcccggccggccgcgtcccaatcgggacgacgtggacgccgccggcgccatgaacggcagcgagcaaaggcagtagtgggctgtggccaccgcccaccggtggtccgagtcggttgggctgctgcacctgtattcttagggccctttgaatcataggaatgagaaaacgtaggaataggaaaaacgtaagattttggtaggaatgcaagtgtaaaacagaggattacaaaacaaaggaaaaaatacaggaatgaccattagattggaccgaagaaaaaacacaggaattagaggagagataaagactcaaaggaaagtttccatgaggttctaccttatattagaatttctccaaaacttgcatagcattagacattccataggaattttatgggattccataagatccattcctttgattcaaaggactatataggaaaatttcctttagaaataaaattctctaaaattcatatgaatttcctttgaatcaaaggaggccttacttcccggacttgtgtggctgccacagatcgaactgttgttttgctttgtgtaattgtgttggtcccgtacgacggtacgtacaagagatgaaagtgatcagaacccgtctttataagctccattgttgttggattctaggcgtggtgtgtgtgcttgtttgggggagaaaaaagggggtgtgatttatattttcggatttgagaacaaaaagggatgtgatcaatgtcgtattctttgaggttgtagtgttgttctcacactatggtccctaattaagcactgagaatatgcggtttgtggtcgacatgtcatgtatacgtcgatttggattagccggccggtttcagagaaacaatagagcaggcagcagttgcaatggccaagacaagtatactggggcagctcatgtaaccgcctgatcgaggcacgcacggcccggttatgcccctcgtgaggatgtgtgagcctcgttgaaaccagaactactcggaccgagtaaaaaaacgtgaactactcgcattttttgggtcaatatcgaaccgaattttattatgacaatatttgttgggattttattggtttttatcggtttctcaatggtttatgtgaaatcagaagatatcgctcgtgagagtatagagagcatataatagacttatacatatcaattattgatattattttgaagctttgtccattatttaaaggactgaatatatgagtaaattgccaaccatatgaacaaccaatgttatcaattattcacatagatccaactaaaagtcgagcacttctacttttgttatttttttactcccccaaacgttgtctcatgaactattttatgcttccctagtacctcacaattcatgttcgtgccttatttttacagatacttgcgagttgcgacatatttagtagagattcagctccagctctcatgcagtttgagcacaactaaacaattttacctccatccaagataagagtagagctggagaaagtgctatcacaaaataaactagagagacagagctgaatttaaattactccacaattctactctagacctagtccttagagctaaatttacgagtccaaatttagcccttagatatctcagactgctccaaatttacccagtccaagaaatcattagatatctcggactgctcctgccacgtccaaattattcaagagaggtttcacgttgtttgtgtggtacatagaggtactagagatactacaacatggaccattgatcaagaagaggagagcaagatacaaaattaaaattatttgattccaatgaaattgttaccttagcatataatgtctttttttctttagtgtgctatacctctatgtatctaacctgtggtcaattatctccagtaaggtcttaaaacttctttatct

SEQ ID NO: 70038 - DNA, 12558 bp, Oryza sativa
  unsure (1)..(12558): unsure at all n locations
tgtgctatacctctatgtatctaacctgtggtcaattatctccagtaaggtcttaaaacttctttatctccttcccctcgtctgtatgttgccttgatctaaagtttaagggtgtgtttagtttttagccatactttaccatcacttgacaataaatattgccagcgtagaggatgagatctcttatgcttattttacatagtgagttatttattatctacgggattcacgaatcctgtagacacaagggcctgcattggtcatgcttgatttttcccccttatctacacagtttagtagtactacttgtttatggaactagataaatatccagccgcgttgttgtagaaaattaagttgcataatatgtataaataagatgtaatttgattattaaaactaaaataatttgatacaattttgagactaaaaataattgagattagatgtttttaagagagaacaaagaagagacaatttggaccatacatctatcatccaaaagttagaaataattagggtgatgtgccttaatgagagaagagagaaataacattataaatatttggtaaggatgaactgtataagtatatagaattcaagattcactcaatcaattcttgttaatggaatctgcgaagcagatccataatatccataagaatctcctagatctgatcattgttcccttggtgaatcccttatcattctggagtctatgctcttccggcaacatggattgcagaggtgctcgtgttcttgaagacctgaggagaccaacataacagatgaatgctggtgctaacgaaaaaaaaagattgagaaatgggacttcaggttccctggggacaaaatgtaaatttgaaaagtaacgcataaagaaaacataccggagcctccttacagatatactgtgtaaaacgcagacactcacccctatgaacacacttacagatataatgtgtaaaacgcacactcacccctatgaacacacttacagatatactgtgtaaaacgcagacactcacaacgcatgcgcactcacccctatgaacacacgcacgcaaaccctatctctatgagcatcttcgaagaatgggacagcaaatcgtgaagagattgacgaagaaccctacctctagagcattttcgaagactgggccggcaaatccaacaccattaaatcctagaaaattcgctcacatagagagttgaacccaggacctaaggtgctactgagactcttataaccactagattacaggccctttcactacatatatcaatacttaattgcatttttctttatatatttaaattatgaagctttcgatttttaccttttatgatctacgagctgactattcaatcttgctatctccactattgatgccacttgtcactttgccacctaccaccacaaatgatcttcctcttaaaataactccaagaggatcatagtgagcctcaatattgttttaagaaaaatcggataaaaacatatactactcgattctccaatcaagttttttttaagaaaaaatcaaactgaattttatttttttatagaatttattcggcttttatagggttttatcggtttattaactgattccgcatgatctgatgataccgctcgaaaatgtgaagccccgcacaccagtaccacacacggccgtggtccgccgcagggggcagctctcatctcagcctctcaccagtaccaccaccagtcagtccaccaccgtcccaaaccacacgcgcacacgcccacgccaagagagcgatacagccatagcagcttactccctccgttccaaaataagtgcagctataatttttcgtgcccaattttgaccattcgtcttatttaaaaatttgttaaaaaaattaaaaacataagtcacgagtaaagtactagtcatattttatcatcttataacaacaaaaatgttaatttaaaaaaatttcaaataagacggatgatcaaagttagacgcgaaaacttatggctacaattattttgggataaatattactgctccgtgccaagagagagcgagaaaaaaaaagtaaataaaacgaacaggacgcgaagacgaaaacccccctcgcctctcgtctcttttcgtgctcctccgaatccggtgggtcccacctccctcaccacgcgtccccggccgatcacttcgcctcctcctcctccgctctattaaaccctccttcggccaccgcgcctcctcccctctccaccactcgcgcccccatcaccacccactccactccctcctcccccgagcccgagtgcctcaccgccactagctagcagcagcggcggcggcggcggagaagaggaggagatatggcggcggtggcggggacgggggtgttcgcggagatcctggagggggaggtgtacaggtactacgccgacggggagtggcgcgtctcggcctccggcaagtccgtcgccatcgtcaaccccaccacccgcctcacccagtacagggtgcaaggtgggtttcgcttgcatgcttgctgctctgagctgctactactctgctgctactgctggtgggatgattgccttcccggcttatagttgatcggctgggtggatattggatatgattgattgatcgacgatttgacggcgaccatccctttcgatatttacgaagttaattacggctaagttgatcggcgccactaattaactggagtaactgcgtgcgagctcgccttctttaattctgatagctccccttacctaattggttttccctttggattctcaattgctccctgatttggtgaccggtgaatttcccatcttgtcggcgcaagaacatgcctcggattcatcgccggcttcattcttgcggctgtaattcgagtgttgctacgaattgcgaaacgagttgactttgaacctgatatcacaattagctgagaaaatttgggggtccttttgtgtgtccagcatgcacccaggaggaggtgaacaaggtgatggagacggcgaaggtggcgcagaaggcgtgggcgcgcacgccgctgtggaagcgcgcggagctcctgcacaaggcggccgccatcctcaaggagcacaagaccccgattgcagagtgcctcgtcaaggagatcgccaagcctgccaaggacgcgatctctgaagtcagtggcaatttcagtttgtacttggtgaattttagtgccattcttcatctgaagcgaagctaactgacaaagatggcttgttgtgttttttgagttttgacaggtggtgaggtcaggggatttggtgtcgtacacagctgaggagggtgttcggatactgggggaaggcaagctgctggtgtctgatagcttcccgggcaatgaacggaacaagtactgtttgagctccaaggtatgtgttgcattgctagattcagtcgactttcggttaagtttgtttgccatgttgtttctgtctctcattttgactagaaatagcgatgaaaaaaaagaagcttgtagtatttcagtgtttgtgtctggtggctgttgttaattgatcaacgggcctttgttgactggcagattgacaaaaagttgatgccttggaggcacctgtctaaatcaagttttaatatgtgttacctgtatgataaaatgaggttgatataaattatgcagctaattgacacgtataatggaatatggtattatggaatattccttggatgctagtggtactagtagcccatgtcattctggtttctttatcgtcatgaggtgacctctgaaattagcacttctccctgagtctaggatcactgatcgggatgggcatgcagtgggactgcatcttaagggtcaagattatcagttacagtaacattactacagtaaactatggtacagtagagtctgcagtacctggataaatccactcgaagctgacacatactcacactaccgactgcagcaaaaccaaatccctgagtctgtgtctttcccttgctgatctttctcctctatctgtctagtttttggatattgaacataaaagaagtgcttctgatacttgtgctcatttggccaaagttaaacaaaattgggcaggtgtcgacgtgactagccataactttggcaaaattcgctgtaatccagaccgaccacagctcaaacaagcttggaatgaaaccattccgtatttgatactgtcttcaactggaaatctaggattgccggttacttgtgaggcctgtttccactggttttcaaaatctgaactctcaactgaatatattcttgtattttccaatgatttgcagaagcataaaaattaaaatataggttgtgattctgtgaacctttgattctttgtgattggtatacagtagttatccccactttagtttgttcattgctattttagttgagttatagtaatagccctgtggtgaacttgaactaatcattgagtttggtgtgtaagtgtaactggtactttctaaatgaacttccgtggcccattttatcgttgatgtcgtgaaattagatacttctcatagaaacaaagtattagatgacaggaaaacattcagctatggttgttgctcctgggtccttttcagagattgttagcattgtagtgtgattagatctttggccatctgactctgtgcattaaattaaacatagtttcaaagtcattattccttagtactaattatcaatacctggatggttttgagatgtgaatatgctgctatatttcttcaataggattttcagtgatatggtttgttcaagaaactaatttccaacgattgtgattttctgatcatctttttttttaatctttagaagataacggattgttgaaactgagtatcatgtactctattgcatgctctagaatgtatgttcaagaaaaattttcatgagtcctaagatgaatattatggttgatacatttgactatcaatgctccagtgaatttacttaatatcctgaaattgatgatccatcattttgtttccttcggtatctaattcagtgtcctattcatgcaggtacctcttggagtagttttggcaatcccaccatttaactatcctgtcaacctagcagtctccaagattggcccagcactaattgctggcaatgctcttgttctgaagcctccaactcaggtatatattcttttatgtaaaaagacttgcctatgtttgaagtaaaacatacttaaatggtgtactactgttcaaccagggagcggtggctgcactacatatggtgcactgcttccaccttgctggtttccccaaaggcttgatcaattgtgtcaccgggaaaggttctgaaattggtgattttcttacgatgcatcctggagtcaactgcataaggtaataatcatccgctcctatttctggcatatgcagattcaataagacacagactaaacagtaaacacttatgccatgtagttttacgggaggtgatactggtatagccatttcaaagaaggctggaatggtcccgcttcagatggaacttggaggaaaagatgcttgtgttgtgttagaggatgcagatctggatttagtggcagcaaatatagtaaaaggaggcttctcttacaggtactaaacaatgaatttgattgatcgatctatgggttagaacaacgtttatcgtgttgtttcatttgatctattagatatttggacatgtcaaaatatggataccacaattccttaaaaaagtgaaatcagccacgggaaatcataaaaactttcagataagttttagctaacagaacatgacgtgtggcatccaagtagtgtcatcatgcatatcagataatgttgccatatgcttttccttgcttccatccttgtaccatactatattatttaaatagttctatacacccatatttcatctttatgtgccattttcttttgcttttctattattttccatgcttggccctagtaactatgcgaggacagaagtcttaactgaatttgcatcaaatcatactctggatttctactgacatttcttatgatcaacgtagtggccagaggtgcactgctgtgaaagtggtgctgatcatggaatccgttgctgatatcgtggtagagaaggtgaaggccaagttggcaaaactgacagttgggccacctgaggctgactctgatatcaccccagttgtaacagaatcctcagcaaattttattgagggtttggtcatggatgccaaggagaaaggagcaaccttttgtcaggagtacaggagagaaggcaaccttatctggccgttgctactggatcacgtccggcctgacatgaggattgcttgggaggagccatttggccctgtcttgcctgtgattaggatcaactcggtcgaggaaggcatccaccattgcaatgccagcaattttgggctgcaggtgcacactcacatacatgatagaaatggacattgatgtttgttacaacatgaatatcattgtgcatctgattcatctatgcattcttccatttcagggatgtgtattcactaaagatatcaacaaagcgatcatgatcagcgatgcgatggagaccggaaccgttcagatcaactctgcaccggctcgaggacctgaccatttccccttccaggtattgttaccatgccattgactcggcttgccatcattttgttcaatttaccttttgctttcttcagttgtttgtaatttctatggggtttggactacagggcttgaaggacagtgggattggatcccaggggataactaacagcataaacatgatgaccaaggtgaagagcactgtcataaacctaccatctccatcctacaccatgggctgaggtgttccatatagatgatcagatttctataaccacatgagtacaatgtagagaattcaaatgttttgtaaccacgtgagctttgtacgctatttgcaccacagttctccctgtatgttgttggctcttttacaattaagaataatgcatgttgaagtatgagtcttcctgtttgcttctccttgatgatgaaacgctgctgcatcaactgattatttttcagagaataaacgataaacaaagcacggtgaagtatcgtgtaacccaccataagtggtagagccgtagaggtaggactgtgcatgctgaattgtaattaccatggttagttcagcagaatttgcaaaaagaggacaacagaattagaccatcgtcatgaattaatcaaggtacaaaccaatggttgctggtacatcagtagcaaatggctgtagcactagcgtgcccatatttatattccaagcctccaaggtatacaatacatatttgatgtaccgaacaactgaaaaaggcgcttggtttggaagcgcactatttttaaatttataggataacttctgacagcctttcttctaaatgaacttttggcaaccgctctgaagccgtgtaacacaatccaacaaagcaatttgcagtcaaaatttcgggcatgtgccgttctagttagaatttaggatgtgactcactaagtaattgtgattgtttctctatgcaaacaccagccaacagtattgatttcatcatgcataatctggcatgaccttcttgaggaatttaattggttgggattcctcaggcgcaacctcatcaaagggaacatagtatctatccttgtcgtaaacatggcatttagtcagtattgtcttcatcaagcgccagttccagctggcttcattgatgtactgcaagtagaaggtatcaagggaagagaaatgaaataactatacaaaaaaaaaaaccagtgaaatgcaccccaaaaaaatgggagaaatattgaagtaccttgccccagttctgttttatggaatcataggcagcacgaaggttataacttggaattcttggagaaatatggtgtggaacatgtacatttatgtcatgacaaagtatctctatcctgtaaaaatccattagtcagatacaatccaactctacagaagcatgtttccaagataattttgacaaaaccaagacagtgattcagcttgctccagttgtacaaatgttgacacttatacccgtatgaacacttcatgacaaaatattcacatcatatcccatatttaccacatgcactttactgaaatatatttatcctatgctagtgctaaatgggagtagaactagactcaattgagctattaaattaaaaaaaacatggtttatatgcacctgtggcacattctacaagatatgaaacttatgtgcaatccaggaaaacagtacaaccacatgatggaaaagtttcttaatcctcaaagatacaaataaacaataaatgaattgtcgctgtcattttattggcaaaatcaatgatttgtcatgtgatattaactagcccaattttttactgggattatagtccagtgaaagttttatttgctataattctacatagtatataattttgtttttcatgcagtttcaatacaaaagtgttctaatatccaatcaatctataccattataattaggaccccacccaaatcagggtgtagatctctcttttctgagattttatgtagtactttttagtccatgagagctttcctgtgctaatatccaatcaatctgcactattaaaacaactgaaaagtaatagcatctatcttttgattaataacctattttattgatataaccgataggtcccatgtgtgacaaaaattaatatggaaactagcttgtttaaagatggttaacattacttagcaacttgatagaaaatattataatatgtaagaaaagaaagatgtaaaagaaaacaaaatgcgtaccaccgaggatagtcacagtgaactgtgccgtttaattgtgcctgtgcagcattccactcttctgatgtcttgaatggtatatgaggagcagtgtgatgtaccatcgtaaaggtgctcatctgaagagaacagcttacaggataaataaaaatatttgcattatacaagttaatcaacaatgcaaagcgaacaactttgaacaaaattattatatgtttaggtaagtgctcccttgctctgtcaaattggcagaacaagtatatcaaattgtggctagtttaaacagtgatttaaagcgagtttattccatgttagtactgacgaatggatgcttctgacccaaaatcatgggttcatgagaaaaaatggtaaaccagcatgtactagtaaattggtggagaatgaaatcatatctgttgctagtttgtgaacagtggaaaggaacataataagatctgaaaatatgtagctcgactgcttacgtactgctacaaaaaaaaaatacaatgatacactattctccgaaatgttaccttgtaatgtaaccaaatactgtaataaaaactaaaactgagtcagatccattgccaggagttgataatgcacacagagtagtgatctgaagcaatccaaatatcttcgggaatacaaaagcttaaaatatataaactcttgaactaagaaaaaaaatggtaacagggcaacacagaagtggcatataagtgtcacaaaaggtcagtagcctgtcatctggttggctccatgggtcagagctatattatattcaaggactaattatccaattaacatgagtttctactttctacttgcaatatatagcaccaatatgctctaatagctaaacatttccatgaatttggaccatataaagcttagcagtaaatgatgttgacagaataagaaatattacccaaaagtgataaaccatccatggcatgaaccagaacttgaaccatccagctattcctgatttgagaataatcagtggccatccaattgccatgaacgctagcacagatgctaagcttattttcacccttgggagctcatttggtctgaatttttttagatcaaagtgccaaattaacctgacaagcaatcgtagtgaacagcaatgatattgcttggagaagttgaaggaaaataattcctaaagaagatgtccatgttatatgaaaaggtgttcgaaaaagaaataccagtgagcaatagacatccatggcctgataggaccataagcaaatatcattgctttcctcagtaaggaatttgttctgaactcctttgaaaaaacgggttgccatgcagtatcttctatcaacctggaggttatgcaggaggtaaagatttgaatgaccaaagttcaacctggttggaactgtttttaagtcttttcatattatcaaatggcttttaatacatatgaacacagacttacagataactcaaaaaaatgttgatcatgttgttatgtttgttttatttgtacaattgtttcaacacttgacatgtgaactataattaaaaaagcggcaagtaaaaaactgttttggtatgccatatcccatatgtatttaagcatgatgaagtgcatgagtgttcttacaatgtaatgcatgaccgcactggaaagagcgttgtctgagatttggagaatattggagatgataatatagggtggtatgtacatacatgtttgtcttggcatgatgtctgtcatgcttaaatctccaaggttcataggggtatatcaatggcaagaaagctagagttccaacaatatcttccaccagcttattcctcgaaaatgatttgtgggcacaatcatgacctatgacaaagaactttacaaaggcatcaattaaatagtggacaatagacaaaacagcaagcaagcatgtagcacatgaaaggaacacaaacttatataagcttacaaagggaggggagggttcttacccccgtaactgctgtaccagtccatgcccaggctaagggaagaagatnnnnnnnnnnnnnnnnnnnnaagaaaataccaagagcataagaagtaactgatattaaaacagaagtccaagattttagatcatcgatttcaaatacctagcagacaagaaattttacattagaggaatttgtgtataggaagccacagcagcatagctggtgttggtagctcatatacctctttaggcagactatccattacatctttaagagtaacattatctggcaactgttctccaatttgtttgaatccataatcttcacacatttgcttccgtttttcttcatcatctaacaaaggtggagtaacaggcagaactgctgcttgcaaccttccgctttgtttcaatggtaaaaattgatgacaactctgtcctttatatacagaatctctcttcaaaaaaaatgtacctggtgaaacatgataatgtaacatctaaagtgctgaacggtattgccaaataagcacgacagtaatttaatcaatagttttcattgcgatatacaccaatgaacacactaataagtaatcgtttccattattcttctaaaatacaacttaatataacatctttaacattccatgcttccatgatatatatcatccagtcccggcagagaacacctaactggaccgcacattgtggcatgccgtttcaggagctaccaggtcatggaatttctagctgtcaccccaagattaccatttacaaccaagagcccatatgtaagactgaattaactagtcggctactctgctccagtccgcacctctcgaaatatttatgcttagaacgaacaacacatcccaaatcccaaaagcaccagggaacaccagcacaaaactgctaccgaaacagggccatacctgccggggcaccaccggctgctctccgcgggaacgcgttcttgcccggggcctgcgcatcaacagccacagataaaacgacctctcctcacacaggcattcgaacgaacaggtggtgggcattgcaagtaggaggagcgtaccgggctgccggggcgggagcagcagccgcccacccgccgcgtggaggggagctgcaggggagtggagacgccgctcgccgtcgccatcgccctctctggtagcagcggggcccggcgggctaggccgggagggcgcgcggtggcgagggagcgtggagacgacgacgacgccgggcggcggcgggcggcggtttggatggatgcgttggtgccttggtggtgtgggtggctgtaaatcccgcttgcgcgcgccgcagctcgcagcggtggggtcggccgggacaggtcgggtgtgacccaggacggctgcttgtggtggctggtgcggccgcgacggcgcgaccgcggccctgtataaagccagcctataccgaccgaggcggcgaatgaatctctctgaacctatataaagtagaggcttctgttttcgtttataagtttactgaagataaaaaaagattaagtacaagcatacagaacaaaaaaatctttagcgtgtgattaattatgttttaattattttattaaacttaaaaatcgatttatttgatattttaaaataacttttgcctaaaaggttttcgcacgaaatgtattgtttaaccgtttaaatagcgtgataatgcaaactaagat

SEQ ID NO: 70039 - DNA, 3913 bp, Oryza sativa
attcctgcagccctgaatcccctgaatccctcctccacgatgatgccaatgcattcgtcaatgaagaggatgatcctggataggtgatcgagttacccaaaactgatccaccttcacaaccactagttgagctcaaatctcttccttcaggtattcactatgctttcttgcatggtgatatggagttgccagtcatcataagagagaagctttttgatgatgagacctccaaactcacagctgtgttaaaaaaccttcgctctatgctaggttactcacttcaaggcctcaaaggcattagtcctaccctttgtactcatcgcactcctttagacccttcttgtgtgccttctcgagagccacaatgaagactaaataatgcatgttgacgaccgttaagtaccaatctcgaccaacaactagcatatgaataaagggaaaattagcatttcttacacatataccaataataaataatgtagttgtattaggatttgagaattagcttggaagtaggaattatacaccaaagtgaaggagaaatgaaaccaacatgcaatgaaacacactatagattgagaggctcacaagtcagctcaaacggacttaaagtggggccaaccacccgggaatcgaccaagggcccacctggcagccacttaccaaaggtggtggagagagccgttgccgagggttcggccaaaacctgtcatagcagtgccacatctccatcgtccacgtgttgactcctcattggctcccaatggtgtttgtgggtgtttagcagccatataaccgtcactagtagcctatttaaggagttcactctcttcacttagaacacacaccacaaggagcaaatttcctcttccactttgtattctctatagttttagtaggaataaaggttaggagcttcagtcaaatagtcttctcggagttttgggtatgtctttagcactttactattcttgtaagaccatagttgaataaacataattatcttcttaatttatttatgctcatggtttatatatttctttattaaatatatgttctatgagcattatatactttgtatatctacatcatcctggctagtcgatccatgctacggtaacggtccaatgacctttatagctaggttgctctagcttcaagctgttcatcagtaggatgagagtcctgggagagttagtgatattatttactagcataagcatgatgcttaggttagataaatatcgttggatgcgggtgtgccccacggaaagtgaggtgggcagtaggtgggtatgatgtaagagtgtgtaaatgtcataactatgctagcagaccaatagggcggtagtacctgggtgcctggaactaagtcctatgttgtaagcatgtgtatgttaagtgtataatagacatgattagtatagaagtacatgtgtattgtagtttcctaaagctaatttccttctggatattcatatagaggtgaatctcctgtgtgttcactacctatcaattattatcctaacccctatttttcctatggtaaataaattatagattgattatagagatataaaccatatctttgtgccaccgctttccctgcagaaatataaatacgatgcccttggaaatacacatgggtgaaatgctacagcagtatccgtgcgcttgcgaatttatctacgaacataaaaaataccaacaagcatttctcacgttgttgccagggaagacactggttttaagatatagtttatatgtctataatcattttatgattaatgaaaccctagtccaaacatgtttacctcgatgtattttctcttttatgtgaaaataggtaatgcatcactagttttaacctgccgacagacttcgttgataatccagagaagcttacgagaagaatccgacctcgtgtcgttccttcgcaaattaggctcttggcacctgaaccagttttctttgcaccagatcactcgtagctgatggcgcagaagaccattcgtgagtagtcggctccctcttcttccaatgtgcacgttgggccaaccatccatacttgggatgcaaactttgagatcaagactggtctgatcactatggtgcaggccatcctgttctacgggaaggccaatgaggatacgaacgtacaactctagcaattccttgagctatatgaaactattgccatcaggctctgtctgtttctgttccatctactcgggagtgcaaaacaatggttctactccaagagaggtgccatagacacttgggtgaggtgctcaattgctttcctagctaacttctttctgatgggcaaaaccaacaccctttgttggagaatttcatgtttccagcaagccaacaatgagccgatgccagaggcatgggagaggctccaagattacaccatgacttgtccttaccatgggatggacaattggcttatcatctagaacttctaaacggattgatgcagtcagcccgtgaccatattgtcgctgctactgaaggagccttcttctcacttactatcgctcgtgcattagaactaattgagaagatggtctccaatcaaggatggagtgaaggtcgactccaatcttgtcaacggggcatgcacaccgttaaggagacaaacatgctcgcttcttagatggacctccccctaaagcgcttggatgaacgcgctcgacacaagtcgaaaatgtacggtatagtccaggtcttggacgtctgtatgacgtgtgagacctaccacaatactggacagtcgaggaatgattgccccaagacctgtgaagatgtcttcttcataaacaacaacaacgggtaccgttcacaaggagtctaggggtggaatcaaccatgctcatactatcaaggaggcaacaatgataacttcaatcccaattaaccctccttgaaagatcatgtctattgccaaaccaagataaatgagatgatgttaaagagactgtcatccagtggcaaaacattggagagaattcatgtcttaacagtgaaatttggcaagttagactcggatttggagttggatatcgaagcggatttcaaggagattggatcttaccaaaatagattacgcatcggctgacaactgttaacgactaaatttggtaagccatgaactaggttcaacagagtcagggtttgagtgagacaatatggaaagcagccgatacaacttgaggctcggtttggtcctcaattaagataaccatcattgacatacagagatagagctcatttaaggcaattgtatgtattaattaggattttaatgtcagtttgaattagagatatggtaagagtctgccattttgtttttatctttaggaaagttttagtcgtgtccacaatggacgaattttgtactctgggtataaatataaaccccagttcactgttataagggacgacaatccaaccaatacaactttcggtacatcgcgacccttttcttttactttttcgatgagttcttgctttaagtcgaagcatcggctacaatctcttgacaagaggtaacttgtctcgatggcttgcactatctgggcttttatatctttttaaatgtattagactattagtatttttgttgtggtcatcatttatcatatatcttagttaatctagcttagtatctcaacttagtcatatcggctgattcttgctttagggtttacaccggtatcagctaagtcgttttactagattagattagctaagatatttaccatcctgaaaagtgattaattacttgattgtttacactttaggtttctctatatactttgagttgcatcaaccctagtcttgtctagaatccaaaaaactaagctggaaataatcataattaaggataatatcggagtttcag

SEQ ID NO: 70040 - DNA, 20912 bp, Oryza sativa
caggaatccaaattttcggtttagaagtcatcaaacaaagtttagcaggaaactgtggaaatgtggaatacctgtcgattatgtagttgcctgtcaatgtagatctgtccctcagtgatataaccagtaagatcaggagttggatgtgtaatatctacaacagcacgacttatgagtcagaaagttgccggcagcatctaatatcagttatccatgtaacatttattctattaataaaactgattcactatgtttttctgtgcaattaacatacatacttcaaattaaaaaaaggaaaagtgcaatttcgcaaaaagatttatcataaaatgtaagcacatttaaataactaaccatcattaggcatggttaaaatgggtatctgcgtaattgatccttttcttccttctatgcgaccagcacgctcatagatagttgccaaatcagtatacatataaccaggataaccacgccgtccaggtacttcctctcgagctgcagaaacctgatgtgaggaaagacagagaaaaggtaagtagaggtgacttgaatgatataatacttaagaaatcagcataaaccgtggtattaaaaggactagatttcaaaaaaaaaaaaggagcaagcatatgtagaaaaacaatattaaagcatttattcgatacaatattatttagttattcaaattagctcaaaccaatatttctgaatctaaatttacaacgagaagcatataactagtatagctgcagacctgcaatagtgaatagaataactctgtatctgtgttaatgtaattatacgatacctagctaccgatcatcgtctcatcgatgacagacaaaatagtctagagcacaacaaacaacagatcataacttgctttagatctaaccatctaggttctctgtataaacctatgttgtgctcgttttcccccttcaaacaggtaaggcaagacaacatttttcagaattatcatctttcaaaacgtccattttagctcaaagtgatagcagagaattcccaccatgtttctaatgtaaacactaggaaataacatatagcaagataaaggcccttacttcacgaagtgcatcggcatatgagctcatgtcagtcaggatgacaagaacatgcttcccgcactcatatgccaagtattctgctgtggtgagagcaattcttggggtgataatacgctcgatagttggatcatttgcctatgaacaaaaaatacaaaatcaaggagtaagttatagatcttgcaaattccttagagcagcatagtgaaggaaaagaaagaacaaaggtaatgcagatataccagattaagaaataaggtaactctctccattgaaccattttcctcaaaatcacgcttgaaaaattgtgctgtctccatgtttactcccatagcagcaaagacaatcgcaaaattttcatcctcggaactctataataaattgttatattagatagataatattaaggaagaagtgtgaatgtcaaaatgttattcagcatacagcaataacagaatagaaaactgcactaaattgcaatgactgataacaatctttttgtagctagtgttacatatttatgactacttatccataacacggttagcttcaccatgtaggacaaactaagtatgcatcaaatatatttagtcacttcttataaattagaaacaaagatcacaagcttattgtcaattatctatggctacttactgcaagaactaagtaagaagtaatgcctatagcttgctacagtacccagaatgcaacatggaaatggtactccagttaggtatgatgaatattatgtagtttagacaaaaatacctccaagatattgtcactcttctctaaacgctttaccagaccagcctgacggcaaatctgagcagcaatttcattgtgtgggagaccagcagcggaaaacagagggatcttctgaccacgggcaatagaattcataacatcaattgtagatatcccagtctgaatcatttcttcagggtatgttcgttcactgggattgatagaacttcctgcaccagcaaacccgatgtcaaaatctaagcatttgatttacaccataatcaaatcttatgaataatcaaaagcagctagcacctaccagaaatatccaagtaagcctctggtaaaatcggtgggccattatctataggtttcccagaaccattgaagacacgtccaagcatatccagtgacactggagtttttagaacctgaaaaaagttcacgaggaaagtagaatgaacaaaattaagagtgaaccacttcgaaaatttcaatgactaaaacactgtatgtgggaacaagccaatggctaatggtgggggggccagccggtttctaatccaaggattgacaactttatttagtgaatgccagagatccgggtcactattttaaacagtgccactacatattagcacaaattcacggggaaaaagaatattacctcaccggtgaattgtacagttgtgtatttgttgtcaataccagatgttccttcgaaaacctgccagtgatttcaaaagtttcatgagtgaaagagacaggtaggtaacaactgcacaataacatctagactgacgttcacattactctcaaaagtttgaggcaacctgaagacaaaagtaaagaccactgctcggtgatgcttatactaccataagaaatataaaaattgtaaacttaatatttgtgttagtcatacttgtatcactgccatctaagatggttctgacaaaatacaggcaattcagctaattatctgtaaaatgcttaaaagattgcataaacaatgtacaccatctgctttccaatcaaattgtcataatatactaatagaattttgaaaaacagttatattaataagtgatgaagaaggaatcaactttttttaataacaatataaccacacgaatgaattggcaacatgttaaaagaatgcatgctatcttaattatttattgccactgtgaaacaaatatgtacatacctgaacaacagctttctccccatcgacttcaagcacttgaccacgcctagttgtgccatctcctaatcgtatattgacaatttcttggtatttaggaccctgaaataccaacacattatatggaatgtgaatgtgatctgaaataatcaaaattatatttgcatgtaaaacaatatgaaatagccatcacaagatatgattaccttcactttatcaagaatgactagaggaccagcaactccagagactgtcctgtactctgcatttttaaaagaaaaacttacaaagtgtgagtagttcaacaatatcaatactaggctacttacaagctagactcagtccatatatggttattgtgaatcaagcagaagatccgtacccatcccaatctcaagagttccttcctccgtgtcgacattaccatttgcaacaaccatgtttgagattgtagaagaagcctgctgtaggtaagtatttgagtcaataaaatatactcagaagaatattctatggacaatctgtcgtgtatctgttttctcaagttccctagataaatggggtatgcatcaccattaaaccctttcttcactggccgcatacttatcttctcttttagttttgcgatttagattagaaattaaaacaacaaattcatggcattaactgtcacttctatatttcctaaattaccagcaacaaaggccagatactttgccaatctaaaatcaatcagatgctgacaaagctaaagctgatatcaactacaaggtgaaatgtatagttagtagatatgccaaataggcaaacactatcctgctattcgaattagcaaaagattaactctagaaagattatgttgttccaattttctggaaatactagaaggatctagctccatgagctactattctagtaagcagtaaaaacataaaaggcagtgatagaacatcgccaatcgaatcatatgtacttcaccagaaccctttctagtccaaaaaccaaccctacatctctgaaaaaaaaaatcatgtttcagacacattgatcattacatgtaagctccctagaagaactgaggcagaaacgagctttgtactgtatctcacttcttaaacaacaacactacgaagatcctagtcctagcgctctcgacagaacactaatcgacaaaccccatctcctcgcacgggcagctctgcatacctccacagtggaggtagcgggggtcaatctacccaacaaactctgaaaattcggcaacatcggggaacgtggagcgccaattgatcctacacgctacgcacgggtctgaagcgccaaaccacgatccggcggcggcgggggtgccgggcctcgtcgtaagcagatccccgcggcgagcggaggagctataggatcggggccggaaggagtgaggaggaggaggaggaggaggagggaggcgtgcgtaccgcagattcgagcggaggagaggagaggggagatcgcgcaagtttcgtcgccccacccccagcgaagaaggcgatctgggtttccagtcagattagcggttttgttttgggcgtcgtcgtctcgtccccgatttgatccgccatgttcgagagaccagggggtttccgtcgtccacgtggcgggatcggacggcccggatcggcgtgacagcgtgatttgttcctgtgggccccaccttgtcgaagcgtctgggcacgttggccaacgtgcaccgccgtccagactacagcatggccaaggcctagtcggagactcggagtcctcctcggcttttggttgggcttgaagcccaacgttaaccaccattttgggccttaggcccatatgcacataagagttttatacggtttctgtgcgtgcatatcatatcatatcatatcatattaaatctttagttttcctgcccacagtaacaccctacgcgagaacgctgcattctgctacagggtaacagttccatgccatgcgtgagccgttggatctttgagagctggtatgatctggccgtccgcctgcttgcttgtgcagttgtgcatcctcatccactcgtctccccaatccccatccctcctgatccccaatccccaatccccaatcgatcaatcctcacttccccagccagcccgtctgcggagaaatcgatcccgcacttcctgcagccgccgccgatcccgcatcgctccaccggctactgccttttctcatctccaaccttcgctcttcccccacaatttctgcctgtctacggctgtggggttgcctgctgctggttgtcgttcagcgtccatcgggcaggcagcagcgttccagtggatctcattgacgccggccacaacgcccggttcaacaccgcattccccttggctcaccctctccggcgatgagctcgagcgggcgaggcggcaagcggcaaggggcgccgcccccagcgccattcggggctgcggcgaagagggcccaaccccacggtgggcacctagcagatgactccatccgcgctagcggtgacctctcatctcctatcggttcagcgcctaacggtcgctgcctcctcttccacaggtaccacggtgcctgcacctgttactttcctcttgtgcctttcgcatttagcttttggttcgattccccattccttgcactgctccaagcctctaacctggagttttacctcttgaaaatgcaggtaataacgtgtctgtgatttttaggtgtttttcaggaacatcaaatttatgtatgcttttgttatgctcgatgaaatggatgaatcggctgtacataatttgtcagctcgctgccacactatgatcagcaaaggcgcaagttgatccaatttccatctgcatctggtccttggtatgtctgcctacatctccttagggtaatcacaattatcaatttctcactattacctaacttttgtttgcattgcaggtctctgatcagttatcaatttgcaagagtgcttgattttccaagtttcgataccggacaatcttccttgctatgacaactaagatgttctttctgtacatctatgttctcccactgtactttagttcgttgttagttgagttagatttagtgtgaagcaaatagacccgactctctgtaaagttagtattgtatatgatttcctgtttttagggcattcagcaagtgcttatggttaagaactacactacattacaaagttgccaagaaaatgcaaggtgacaatatcttgtggccatcaaaaattgagattttcagtgactgtcaattttttcttgtgttctacagtgtgctacattgctcaggactgcctcaggtaaatagaaaactataatatagcgcaatatcgtcttacgtttcccatgaggccatgactgttttctgcatgatctgctgctacctaccgggcaagcactggtgttatgttttggactgaccatttgtaaatctatttaacctttaatatgtactaaaagagaggattcttcagcggtgttttactgtacatctgtattaatatatttctttgtgcatagcatttcaggccagggacaggctgcccaggacgagtggaaataattatgtaatatttgctaggtattacttcctactcttacttctacgcttctcgcttcatttcagttgaagccatcaagacattgtccagaccgaaatcatatattgttattatccagtagattatcaagattactgtctgttttagttcaagatgttccctgaatagcagaactggatggtagctgacagattcggtaaagttcaatactctaatcaaaactggatatggacatcatttagatcaagttgctttctaggttcaggagatcaagctgggtgagaacatcagagtataatggttgtgatggtgagagcaccatagtatggtggatagggctaggtgaggtttgtacaattcattctacgatgcatatcttgcagttgggagtcatgatctttctttcaaataagtatcattgcttatcgcaaaaaaaaaaatgcagtgtttattgccaaatcctgacatgaaaagggtgaagagaattttggtaatatagttgtaagcaacatagtgagaagcactttattaagttaaaaggatcgctctacattggattgagtttgatgttagaattttgtaccaatctttctctgttaaaatttccatcctcattggctaataaaaagaagatagtctgatttgggacagtgatcaatgtatgagaaggtcaatcagatttctaatgttggtccatttgattcaaaatatttgcaattatacatggtatatgtaatgcttatgtctacgtgtgggctatgtttgcacccgcagcaacgcgcggggtgccagctagttttcagaatattctgtctgtctggtgtcaaccggctgggactcacataccaactccgattaatccgttggtgattgaactcattgaaggacacggcaggacaagattcttctaggtctctccgttggtgattgaactcattgaaggacacggcaggacaagattcttctaggtctctgatcacttcacttgtttggttgctttcaactgctctatataattgtccgttaggccatagtgacagtgcggatgagacttaataatagtgctcctggggtcgttagtgtgtaacgttgatcctggtcgatcgtccggggttacctcatcgctgtctgtggggttaccttatcgctgtctgtggcaagttggaactgtcctacggctgataatgggcgttcggataatgaactaggggaagccacacatcggttttgataggattttgcctccgaagaatagtagtaaaggacccatcttgtttggagttaatttggagtactatattttttttttgcaggaaatttggagtactatagttggaagtcggaactcgaaagatcgccaaaagattccagacaaagggtgtgtttagttgacgtcaaaattgtaagtttggttgaaattgaaacgatgtgacggaaaagttggaagtttgtctgtgtacgaaagttttgatgtgatgaaaaagttggaagtttgaagaaaaatttggaactaaactcggccaaagaaagcagtagcactgttttagaagtatgtgcggtttgtgcccagtaagaagaagaagaaccatgaactcaaattttatattcatgagttaaatcaaatttacaaagtttaaatatgtccatgtcagtacatttgttatagtaaactcaattttactatacttacatcggtgcaatgaaagcgctatgcgggccttgggcccgaactgtcaccggccgacgttaatgccatgccgccgcgtacagtttacacgaatggttttaatcacacgctgcacctctcccgcgcccaccagtccactcacgcggtcactctcctccagttgtccagtctccgctcgctatatccgctcccgcgcgactcactcaacccagtacacacactccacctaatcttcttctcctcacacattcacacacacacaccccgcagaccccggcaccttaccgagcggcggctcagcacgctgctgctacgcacatggacaagagccagggagtcctactgtccagcaacgtcggggccggctcccggccgtggccggagctgctcggctccgcccactgggacggcctcctcgacccgctcgacctcacgctgcgccgcctcatcctgctctgcggcgacctctgccaggtcacctacgactccttcaactccgactcccactccaagtactgcggcacctgccgcttctccaggtccacgctcctcgaccgcacgcagttcccggccgccggcgacctctccgtcgccgcctacctctacgccacctccgacgccacggcgttcccggggagcatggtgtactcgatgtcgcgcgaggcgtggagcaaggagtccaactggatcggctacgtcgccgtgtccaacgacgccgcagcggccgcctcgggccagcgcgtcatctacgtcgcgtggcgcggcaccatccggtcgctggagtgggtcgacgtgctcaagccggacctggtcgaccacgacgacatcctccccgaggggcacccggggcgcggccggtcgcgcgtcatgaaggggtggtacctcatctacagctccaccgacgagcgctcccctttctccaagtacagcgcccgcgaccagatgctcgccgccgtgcgcgagctggtggcgaggtacaggaacgagagcctcggcgtcgtctgcacggggcacagcctcggcgcgtcgctcgccacgctctgcgcgttcgatatcgtcgtcaacggcgtgtccaaggtcggcgacggcgcgcacatcccggtgaccgccgtggtgttcgggagcccgcagatcgggaacccggagttcaagaagcagttcgaggagcagcccaacctgcgggcgctgcacgtcaggaacatgcccgacctcatcccgctctacccgagcggcctcctcggctacgccaacgtcggcaaaaccctccaggtcgactccaagaagtcgccctacgtgaagcgagacaccagcccaggcgactaccacaacctgcaggggatcctacacacggtggccggctggaacgggaaggacggcgagttcaagctccaggtgaagcgcagcgtcgcgctggtgaacaagtcgagcggcttcctcaaggacagcaaccttgtgccggagtcatggtgggtggagaggaacaaaggcatggtgctcggccagaacggggaatggcagctcgaggggcccgcagaggagaacctgcccgtgccaccggtggtgaccgggaagatcatcgacgacgacgtcgctgccgtggccacctccagcagtgccaaggaggataagaagacgggcaaagggtctaagcttctgtctggattgattgatcaactgctttgtgtgtaagtgaatttattacatgatcaaaccatttacttttgcaattgtggtaaataagtagtctgttacatatcaatagaagtgatgatgcatgatgctattacaggctttacagcaatgtggttaattattaaaggcgagacaagtttgtataagaaaaaaaaaattgtaatagtgaatcatatgcgatataatctgaagtaaaatgaagtatatgagcgcagatgacgctctatattgtaagtagtcacgtgtactccaggttactctgaaatgcggaattatcgcgaaatacaataagaactttcaaatgtcataaaagtaatgctagtttcccttttaaatttattggtaaattggcttcctttgaaaataaattgactagtgacatgaaaataggctggcaggagcaagaacaagcaaattcagtggcaatctagtactctcttcgtaccataaaaaccaacctacttaatattggatgtgacacatcctaatattacatatacctcagtccaaattcattgcactagagtgtgtaagtccaaattcattgcactagagtgtgtcacatacagtcctagattcttttttagatagtatgtatgaacgatagaaaattaatattgtttacttttagctctctgtctcggcgcgtcgcattatgtatgaattcatagtatttgaaactaatttttgctttacttgattaacatgataaattaatattttttaaaaaactttgtaaataacttaaaacaagtgacctaaataatgctctaagagtttcttttaaaagaaattgtatttttaagaagcgtgaagcagataatccgtgacaaaaatcagaaaagaacctgaaaagaataatggggctaagtgcgccgagctttgttaaaatcacgctagctttcttttaaaaaaaaagacataaatttgatgattgttggctgaagagtgatttgttgggtccaatgaaaatacagaaagtaaaaaacacagacacacaatcatcttcagaaaattgagtttatctaactccaatacactgatctttcaagtgtgtcattggttgtctttctaggcctgatacatgtaaagccggagctgcgtgagttgttgaagaccacatcagaaaaagactcgagagcggtggcgtcgaactgatatgcttgtgaagtagctggagcttgggagttgggagcgagctagattacaacaatgtcatttatcggtttttctttggaataaaatgagttgttttgttaggagaaagtagtatttttcctttctgcttttagtgtctcttgagaaagaataaaatgagtcctggcatcataagtaggtgggttagtcgactaggttcgagcctcaccacatctcaataaatatcgatatgtgacccctcctttcatatccagtatcttttaagtgtgccttgtctcctagatataatttctgtttaaaacagccttctacctgaacatgtatgatagaagcataaactgagcacaccaatttttcccttccagataaggtttcaaaaacctttcagatatttatgttatcgtcatcgtgtcttacgttgtctaacaatatgtgagagcatgtctaatagaccaactgggctggcgatagcacgacacgttggcttcactgctgtgctagaggagagaatggtagagagaatgcgagccgacgatataattatcgcccggctgtagcacgctgtacaatgaagaaataaataagtctgatggagattggttcatacttggaacaacagtgaagaatgcagtaattagtgagacccatatcaattaaaaaaatatatcagttgttatcgtaaatgatagtaataaagaccattgttatatgagcagcctatactaacagactatagatgatgtggatgttttacagctagcaagttgacgatattattaaacctactttgatgcccatgggtgatatctaccgctatacgttctctaaaaaaatatagcctccacttcataatatccaaccatactgctcataaaaacaaatacttttgtgctgcacacaccttatacaattcaaatcctcgttgcagtactgcagaggacccttactccaccatataacgttatctgtcactctatccagttccctgcatacaagttatcttttgtgctagaagcgcgagtgccgcgtcttttctctttcaagaaactaagcgccacgttaatgaaacgagtaagatgcatgactctatagactacagacaagaaggggaagtgaaggttgtccctttgcccctttccttcttggcaaaatttgctacaggatatccaaaatatgtataattagctggtggactcacaagaacgtgaatttgctaaaggccaccacaaaaacccagtaattagctgttggacacccgtcggattattttattatatttggaggaattggagagagaaacacctatgtaagtacagttctacccttcaatttttttttcttttttcttccttatcttttctctttctctcattctttctctctttctcgttgcattttcttcaaccgagggcgccggcgcagcgaggcgcgggccagtgcggcacctcagctggggtggcgctgcacggtcgtgcgcaggggtcggggcctgctgcgtcttcctgtggcgcaggatgtaccgcctcacgccaaagcacccctgacaggacgagctgatgtgtgggaacacctgatgatgccgccggagtgttgccatcgccggggaaatgatgcaaaaatgcggcggcggctgccatggagatgaagctcctccgtctgaaggcaactggccgccgagatgaactccgcgacacgatccattaggtgctagcgcgcgccagccggtataggtggaagtagtggttctcgccctccgactcaccaacgtcacctcgcgcccaccaccgccgccgcgaagctgggcggtgtactggcggccgcgttcactcagtatgtccttctcagcgacggcgaccagcgcgcggcagcatggaagcaacgacacatcctcggcgggagggtcgatccgcagggcgtcattgccggcggcggcgctcgtcacgtacggccggagcgtgtccagcctgtccgcgcgcgagcatcggcggctcgtcgtgccggctggccgcctcctcctccgacggctgccaccgcgcgccccagaagcagggctatagcagcgccatgccctcgatgtcaatgttgtcgccttcgggtccatgctgcgaacgccgcgctacctccgtccagccgccggcgtagccactgaaagtgcattaatccccctagtgggttttggtgattaatgataaatgtggttaagagactaatgagtttattgagctacttttaggtgcattagtccaaggtgtggaagatggatgcttggagaccccccaaaagtataaaatcaaagcagaccggaactcgaggagtgcataggatagtttatttattgcaatcgagtttttaggaaaaaccgtattattaaggggggttccaggtggtgctctaagatatgtcaagtgttcttaggttgaaccaagtgacaagtttccctaggagttatttttgcaaatactccatctgtccaaaaatgcaagtccggaacttcctgtcttccaggtccggaacttcctgtcttgtgaaaaagattttcctaagtgtagtccggaagttcctgtcttccaggtccgaaacttcctgtctagtttccaattcaaaattgtgagtaacggctagatgacgtcacctagccgttatacatatccagctcgtttccagctcgttctttggccattccactttcacttttggaccctagagctgttgctagcctctcccaagtgtttcttgccttctccactcaatcttgagcctaattcttgtgagaaagagagattgagagggagagaagaagatttggagaggtgtgaagattaggatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatctcctctcctccgaaagggaacgaggtaagttaatgaagttcttgtgctgagattctagaggctttccaagtagagcaacctacacttgtggcggatttctagaagttggttgagttcgatcttggtggtcactcaattctagaaatttgcctaggagtgtttgcgattgaaagctgtggatttcctctgggtttttgcacaagtgaggcaagagattaatcgagacctagctctttggagctcctcaacggagagtaggatcgcaagatccgaacttcgggaaaaatcgctcttgtcttttctgtgatgtttctgtggatgtttctgtgatctatcctctgcttagaatacctgtgcttcatcttgtgaagattggcttagtctcttgtttcgaaatttgaatttcatccttgttctgttactcggaagttccgggcctggcagaccggaagttccggtgttccttactaggaagttcagggtctgtttgaattttaccgctgtgatttgtttttaagttttcagggacagcctattcacccccacccccctctaggcttcatcagcacgttcaattggtatcagagccttgtgctcctgattcaagcttcaccgcttggagtgatccgatgtcgcatcaagagggaaacggagagatagatgaaggggacaagggagacgcttccagcaccgaggagattgcatcaaagggggctactattcactttgattacagcaaacttaatgttccttctcataacttcgtctccgtgccttccgggcgtgcacctcattttgatgggacacactatgccgcttggaagcacaagatgaagtggcatttaatctctttgcatccaagtatttggaaagttgtttgtacaggtattgatgtaccccatgatggcatggagctcacttcggagcaagagcaactcatccaccgcaatgctcaagcttccaatgcaattctctccgccttgagtccggaggagttcaacaaagtggatggacttgaggaggccaaggagatatgggacactttgcaattggctcatgagggatcacccgccgttcgtgaggccaagattgaattgttggaagaaaggctaggaagatttgtgatggatgacaaggagacaccacaagagatgtatgataggatgatgattcttgtcaacaagattaaaggacttagaagtgaggatatgacaaatcactttgtggtcaagagacttctccgtgcttttggtccaaggaaccccactcttgtatcaatgatacatgagaggaaagacttcaagaggctcacctctagtgacattcttggaagaattgtgtctcatgagatgcaagaagaggaagctcgtgaagtgaggcaaatggtgaagaatgccgccatgatcaaaaatcaagaagtggctttgaaggcaaaacaagaagaagagtcaagttgtgaagaaagtgaagatgaagagatggctcttattgtcaagagattcaagcactttcttcgcaagagtggctatgggaaaggaaggaaggatgatgacaagggaaagaggcaatcaaagagagcttgcttcaattgtggcgaatatggccacttcattgccgattgccccaagtcaaatgaagctaaggctaagggaggcaagaagaagccggagcgtgctcatgtggcggaggcacacatggcggaggtgtggtactccgaagatgaagaagcttccgaggccaagcctaagcccaagcccaagccaaaagacaaagttgaaggagagggtagtgttgctaccatcgccttcaagtcatcctcttcaagcaaggagcgtctcttcaacaacttgagtgatgacgatgacgactcctaccactactcatgtttcatggcccaaggccgcaaggtgatgactcaaagccctctcacacttctcttgatgatgattctagtgatgaagaaagtgataattaattagatgatatgcttaagagctttagcaaacccgctatgcaacatttggctaaattaatgatgggagggtgacgatgtgaaagaggaagatggaagagtgacgggagtggcatggttccaaatacgtgaattgtaatgatatttttctaatatgccatatttataatggtatggatccaattaaccctaaaaaaatatctacgtttagtttgttgctaaatttgatgaatgcataagaaatcctgctaaaatttcagcattaccaaaactttgtaaggtttagtttagctataatctaaacaggcgtaaaatctgtatgctagaggaggagggagtagaggtcggaggttcggagcctgcgccatcatcatagaagagcttggagctggtcaccgcggcgatgaagacgtcgtcgttggtttcgtcagcagtagcagggtacaacgcagcacaacgacagagttgaacggcgagtgatcctcggtcccgtgatataagagcatctccaacagcctacccaaatcacactctccaaatacctatatagctaactctctaattaatttagcaagttaaacctgttgctcactccaataggctctccatccaccctctctattctgagtgtatgacactgggaccgtatgtcagtctctcgctccttcctcccccttcactttcctcccaactacatcaccaacggcaggccacgagaagggaaaagccggcggggggcgacgcaggcgaaggggcggcgcggaggggcgacgccggcgaagtcgcggcggtgtcgtaggcgcgggcggcggcctcggcggagtcgcggcggcgtccctcgtaggcgcgggcggcggctaccttcccttcccccgaccccagcccgccgccatcgcctcgaggttggcgacgcaggcggagggccgactcgtcgtcgccgtcgccgttgttgtcgccgttgccgtcgccgccccgctccagatctcggagagtcgaggggaaggcaaagggcggtggagccggaaggatgacggcggcggcggcgccgggaggatggcagcggcggcgacgggaagacgacggcgacgacgctaggcggaatgggcggcgggcaggaagggagccatgatgggatggggaaagagggagagagaggagagaggggtgggacccacatcatatggccagccgtcctggctggccaactttggctagtgaggtgggaaatttagccagctagatggcttggagagccatttggctagtctattggagtagatttttttgtccaaattagctaaaatttaacttagagagccatttggctagtctcttggagatgctctagaggcaaacacaatgttgtatttagaggaggttctataggagagagaagggacaagagctaaccatactcattaattatatggttctactccctccatttcaggttttaaaatgtttttgacttggtcaaagttaaactattttaaatttggccaagtttataaaaaagataatattttgatacaagataaattattataaaaaatatatttaattattaatttaataaaactaatttggtaatttaaatattattatatttgtctataaacttagttaaacttaaagcagtttaactttaaccaaaatcaaaacatcttataacctgaaacagaagaagtagataagagagaatatatctggcccgcatgtcagatgcctacagctatgaagaagaagagatccgtgctaatatcttggttttcgcaagttgaacaacatgttatattcaagaatgagggacctaaagtaaacttattccctgtcaaaatcgtaaaggaagcccacgtccattggcccaatttgtgatcagggtatagaaggaaggggtaaacactagatcccggtcccagccgcccgcgtcgttcctcttcttcctcaaaacgcaatctctccgaattctccccatcatcgccatcgacggcttcccaggccgggggaggaagaactccgtttcggacccggcgtccgtgtccgttatcgtccgtcggtttccgtgtccgattctgttcttctccatatgttgatatagatagatcgatcgatcggatcccccacccacacaccacaccacatccgccgcgacacagcaagaagaggagagcagaggagaggaagcagagtgttggaaagaaacaaggaataagccggcggccggagatgaagtccggcaagccgatctgcgagaaggtgaagcccgcagtagcagtccgcatattcggcgggctacgttacgctccgccggatggcctggtcgtcaacaatcctctactggctgccttcatccgagctgtttacgtaagtgttttgtttcctccttgcaatatatatatatttatatatatgctgttgcaagattacaattttggttctgcctttgtttcatcggacaatctatggatcgactcaaggaggaaaagggagtttccaaatttttatctggtgcctactgcctagtactgtgggaattgattgtggtttgctactttttaaccatcacctagcatgaacctagaattgcgccaagtagtttattatatattatagatgatgcatattcaggtcggaacctaaagcactctatctctcattctaaaacagaagaaatcgtactatcaattcggtaactaaccaaatgatgaaatagttgcgggtcgttgggtctgacttaattaggagcatttccattgtcatttgctgattcatattgctatcttatttagttggtagtttaactcactccagtgattaggccagcagatggagtgacagaatgctaaatttcatcatctttcggtgctattattattgtgcaccaggaagtttgggtgtcatcatttttctaaaatctttgatgtggtataaccaatttttccttgttattatctagtgctagttgttttgttggtacttcaatcatgtataattttctttgcatccagaatttcttatcttgtagtcccagtgaatggtcgctcactttacctgttatttctttctttgcagaccttatacatggctacgacagtgtttctctacatttttggcatggttactgctatcaaggaatacgaaatgttggtggcactgtccataattgtagtcatgcagcccttcttcatattgatgtggattgcagcaccattccttaggactgtagcaattgtgaaatatgcgatgggactccctgatagtaataacgtcaacagaattacaacaggaaggatgtcagccctagcctgaacaaagtatgcctaagaagggttgttcaagtttatcataattgtgccctctttagaaatagggcactttaagttgctgtcttctttagaagaccttttagattcagatgtgtatttcttagaacatatgttaacagtggcgtagctagcttatagtccatatgggcacaggactaccctagattttagcatagagaccttaatccctactatcaaaattcatggatcatttgcaaaacaaactatacatacttatcatgcttcttaaacttgttagttgggactacctatacatttgtcgacaaatttttccccaaaaatttgacagatgtaattatagtacaatcgtagtgtaattacactgtaacttatatgtaattacactgtaacttgcatgtaactacagtgtaacttatatgtaagtttcacataattttgaatcgttagatctattacaagatttgttttggtgaggaagaaaacaaatcatagcacacacatatatgaaagaatttgttcccacgacctccattttaccgaaataacatgttacggagagatttttgaaagttacatacaagttacactatagttacagtgtaattacatgcaagttacagtgtaattacactacgattgtactgtaattacatctgtcaaatttttgaggaaaaatttgtcgacaaatatatagcaaaatcgtttgtgtttgtttatacgattagattggagctagctgtctttttttttatcatggtgtcttatattacgatgatttatttgaattaggtggtctttaacaattttgtaaatgcatattatattgtatggtgatattaaaaattgtagcataagtaggcacgaccaaggacaaattttgtaaatttcgtagtataatttgtttttgcattattatatttgctatctaccaggtacttggccacacctaaattttttcatcctccatgggaaataggactgcccaatgaaaaattcctagctacgccactgtatgttaaagcaactttgtatgtttatattagttatatgatgcttcatggttcttttgtggcgagtttcatggtttctgctttctccattgtaatatgtgttgattattttgattttggagaataaaaccgcccgttctttttatttatttgtgcaacacatttgtacatgcgtagaggcatttttgcagacgtatccagccatcggggcttctctattcttaatcctaaagcttaacatgtaaagatgttacatcatcatccactaataattattatatttaaacatcatacaagcatgctatattatctacaatttaataatttattaaattttagagaattaaaatgtaagtatgtcaaatcattccacataattcacataatattttaatatagtccatcctcacttagttcatgctatttttcttctctcattaaaccatgtcatctctttttttctagcccatagatgtatagtctaaattatc

SEQ ID NO: 70041 - DNA, 3481 bp, Oryza sativa
agcacgcatctcgacaacttcatcgacggtgcgcagtgcgggtggacatactactagatgttagaatccatcctccctgtccatactatgatttggcttaccaaccctagatctttgtcatgtgtattaccttgttgacggctttctgatggggtgggaaatattttatctacctggagagaggctgcagtcaacaaaacagatagggagagcacgggtagaaaagtaaatggttcgcaaagtttatgttgaaaaataaatggtttctcgaggggtgtttagatttagaggtgtaaagtttctgcgtgtcacgtcggatattatatagggtgttgcatggggtgtttggacactaataagaaaactaattacagaatccgtcagtaaaccgcgagacgaatttattaagcccaattaatctatcattagcaaatgtttattataacaccacattgtcaaacatggagcaattaggcttaaaaaattcgtctcacaaattagtcgcaatctgtgtaattagttattttagtctatatttaatactttatgcagatatttaaatattcgatgtgataggttgaaaaattttaaggtgggatctaaatagcgtcctagtttagagataaaattggacttttcacaatgttgaggaagcgtgggagaccgaagctgatgaggacgggcatgggatgggagatatgcaatggctggcaactacgatggacggtttgactactcgtcttattaaaataatatatgcaaatataaaaaacaaaaaaattgtgcttcaagtactaaatcataaataaaataaataataattcaaaatttttttaataagacgaatggtcaaacaatacaataaattatcaaaattctttatattaggggacggaggggtagcattcttcacaggtgatgtgttactctttgttgcttctgatcactacaacagatagattaatttgtaacggaagaaaaagttcaacattaagtgttggaccatgtgtcagaaataattggttaatgatgatagagccacaccaggtaaccatccacactgatcctgcacatctgttcaccccttttgcatccgtcagttatgtacaagaaaaaatttcatgcatactgtgctagctactcatagccattcagaacaaggtactgatgtttcgataggtattggatagatcgattatggagacccgacgttcatgatccaaacaaaggctctggaatgatcgaactccaggcaatctgctgagattataggcatataatgatttaatttatttcataaataaattatgacattacagatgtatactagtatgaacgcatcattagatctacacatgtaaactaagcagtaaaacgtaaacagatcaaatatgtgcaacatgtcgaacacgaaccaaggtggcggaaagaccggttgctcggcaggaactactcgcggttgcgggcatcgacgaaggcgtgcagcatgcgagctaagaggaaggcgagccgtcgcggacgaacagggagcagtcgcgcgaagcgcttcccaaaaaccttattgccgccttagattgatttcgcgtgtgttgtatgtaagcggcggctcggtttatatagagataggtcgcttgatcagggcgccgcacgatctccactccgcataaccgaaccggataagtcgcgtgtaacttatccggactccacaccattttcacgcatcggatttttcggaatgtttccaaaagaaaacaaatctgaatttcccgcagcaaaacaaaactacaaaaggaggctgcatctgtgcaaggatgaggagccaattttgcggaccattcgacgcgtacgtcgtgcgcgcgccgcctgccctgcaggcaggcgaggcgagcgagcgcgcccgtgtgttccccctcttctctccactagacatgcttcaagtggctaggagggcatcctcctttttaaggaggtcccactctcctagaataagcaaggtggtactaaactctccatgcatgccatcccatgaggttggcttttgtgattttccaaagaattaatcttcgaataggctaaggcccatctattaattccaacacaatcattatggcacttctccattgattatcaaccgagcgaaatgcggttgaccttgccaagaaggttatctctacaaacaaatggtgaccgcaggacaaaacgtagaagaaacaatctggataattctgaatttaaaatgaatctcacaagttgagattccacaaaacgaactaactaagcagcgaaactgcaatggcaaaataatctatgccaaaccaacacaaatgagatcccgtccaagtcctgccccggttctccttgtcatcatttctgccagcactgatatgtcatcatttctgccatcatttctccttgtcatcatttcttctcctatctagcttatttttcgttctctttttatatttgttatatgaatatagaaaaaaattaaattttggaacttaaattatataatatcatgtttgtattaatactataaatcgacacccttgcgtctttcttatttttagctttttttatttctctctttatttgtaaatttacttgtttttaatttgaaaaaaatgaaaaaaagtaaatttgttttaaaaaatatatgtcgtttaaaaacttctttcattttgaactttacaaataagaaaaagattagtactttccatacaaatattaggagagtaattttctttccatgtaaatattaggagaaaaagttaggagactaatgttctttccatataaatattaagagggtattgggaaaataccgttctttccatattagaataagagaaaacaatacaaaaaagttactctttccaatttaaagataaaaaattaagaaagttacgttctttcgatttattttttacaggacagtaaaagaaacaaataagaaaaagaagaaaacaaggggtgactgggaatcgaacctagctggatttttcacaatttggtccttttaaaaaacttatttcgcaaatatacccctgaaaaaatggtccttttggaggcgccagagtcactggcgctgtcgtccaatgggacggcgccagtctatctggcgtcgtcctcctgctgacgtggtggggcggtgctgaggtggcagggggagcgcgccactgtggctgccccacccccagcaatttttatttttattttatttttttgatatttttttcacgtttaggagcacacaagaaccaaccatagaaaaaataaactcaaatagagattctaatatcgccgaacctgataaagcggggagaatcagatgtaactttttctgtagatgtccgtggatatattatttgcctgattctgagcacgtatgagaaagttaaacctattctaagaaatgacacccgaaaaacacctattttcggtagagttttggaaaattctacgagttacatatttcgtc

SEQ ID NO: 70042 - DNA, 32769 bp, Oryza sativa
tttgacacttactcacctgttgctagattgaccacaattcgtgtgctactttccctagcagcctcagatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggtagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccaggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacaacgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttgaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgccgggccgggccgggccgggccgggcaggacgtacgcgtcgaatggtccgaaaaattggcttctcacccttgcgcagatgcagcctccttttgcagttttgttttgctgcaaattcggattcgtttttgttttggaaacgttccgaaaaatccagtgcgtgcaaacggcgtggagtccggataagttacgcgcgacttatccggttcggttacgcgcagtagagatcgtgcgggcgccctgatcaagcgacccttctctatataaactgacctgccgtcttcacgcaacacttgcgaaatcaatctagggtttttctcctactctgtactacgccgtcgctcgtagactactccatcccgctcgccggcgtgcaccggcgattgggagagcaggtctccggaacctctgccttcgtcgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtatgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatatatatatccaactaatttttttatattgtaagtgcaaccaaatacaaaaaatggaaaaaaaacattgcaccgtttttcaaatatatatttaccagcaactacagttatcacacttgttgtatttttattctttattttgagtcctttctggtacaagttagaaatttgatcgacaagagattggtgtgtatagtttacttgctctaggccctgttgttctttcagatctagagttcttgagttttttttttgtcaaaccgttaaatattatgatttttcaaaaaacttattatagagaagtttcttcaaaattcaattaaatcaaaatttaaagtttgtaagagtgaacacttatctaatcatacgttaattaagaggcttgtctaaattctgataagctagatgattgctcgtccgaaactcattcaaacaaggcacctctttattttcatcctagattcgtcgctgttatgcgccgagccacccacgttgactagctagcaatttgtacgtatactaaaacaaggaggtgcaggaactaattaatctggtcagctctcgtggtcaatggttggaaaagtacacacatatcatggtctagaagaaattaatccaggtttgttagttgtgtcctgtgtgtttcaaaccatttccaacgtcaaattgcaccgcggtctggcctggctcactatataatacttcctccgtcccaaaatgtttgacgtcgttaacttttttttaaagtaatgtttaaccgttcgttttatttaaaaaatttaagtaattattaattcttttcctatgatttgatttattgttaaatatacttttatgtatatatataattttacatattttacaaaaaaatttgaataagacgaacagtcaagtatgtttaaaaaagtcaacggcgtcaaatatttagtgacggagggagtaagtcacacgagccatcgatctcgaacatttgcaaagcacctgagaccatccctgcgccacagccttcctccctcaacgcagggcaggtaaacaacttcctccgccctttgttttagttcatcgaatttgcttagctcattataccggagtatattgttcttactagctattttcaggaaacacgtatgtttcaattattcaatccgtgaaggtttccattgaagtggcttatattgggtgccaaggccggtgttcccaatggaggcgaaggtagcagccggcgcagacactcaccgtggccgtggcggcaaccttgcttcagctgtggtgggaatcacggccgcctcatctgccgtcaccatggtcgccgccggcgacgtcagcccgccggtggcatttgggctcttcgtccttctgctcgccggcctcactctcgctgcctcgcctgttcgccgtgggtaaggtgaacaggtgatggttacaaataggcactccggagtgagaggtgtcaagttttcaacttcatctttgtatctttggtttgggtgcgtactgaataatttgggaggaaaatggtgatcgatgtatgttttcaaggtttgataatgggatgattttaacattctcctaccgaattttgctgtcaattcaaaatctcaggctccatgtacaacatactacaaaattcttttcattatcatgtgagaactgagtagctcctggtaaaacctcgtcagaatgaattttcgatgtaacaaaagcatatttcttctattcatggaattaaatatagcatcaatatgatgcacataaaaagttttagatttggtctcctctgcacagaagggcagaacagaagaacattgaaatggctactgtgcccttgtcctgttcagtctcaaatgctacctaggagatgttcttttctcctgaaggtgaagatgaatattaagttttttatacaaaatgaggtggtattaacgtatgattgattgagttttaattattacgaacttgaaaaattgattgagtccacttccccttcccctgacgggacttagagtgacatgaatgtgagtgtacctacataacagttgggtacaaacacaatgcagattttgtattgttctagaaagtgtgacaattttttgttatggttctagaaagtgtgactaatttttaagcgattattgtttgatgtctatagctgatcctagaattagaattgttcttcggtgattttgttcttcgttgatcctgtgagtccattaatatatgaaaaaccataactgcagttgaaaaggagccttgagaaagcttgatctgttgctcaaactcatccaggaccttgatctggtactgtacagtgcacacagaccttggttgtaggtgcctactgatctctttcagtgtctaatgcagaaagtgaaagtgttcccatccaaagtcattcaattgccatatggtcattgatttctgtagatgatatttaccgcaatccttaagtgcttccctttcttgcttctcgatattatctattcacatcattatcttgttctaatgatttctttttgcagatattattggaaaaattattgccatctcctgtgcagcaatgaaatcaacaagttcataagaattcaggatgagaagattagcgcctatattatccaataaaataaagcatgacgtaataagtatccctaatttcttttaaataattagtattgcataataattaatactttatttttttatgtagagctcatcttcacaaatggagtcacctcaagatatccagagcatgaaagttgagccatgtcatttggacacaaccaacatcttaagcaaacagacctatgaagatccaaacatgattatccaaacttggattttacttactgtaagcattgtggtttatgttgtctttgatttactaatgacaaacatgattaatagctgcgttaattacatgttcttggaactaattttgagtcatgactgagcagggtaatgtataggctgcctagagtaagaattgcatttattcgagatggagtatacatgtacaacctagaataagaattacattgttggtctaaagaaaaaatttcattcgacacgttcattgtactttgactcaacgatgttatccttttttttatataccacaagatgtttggggtttgcctgctatgttcacagttgaaagtaaatttgaagctttcataagcaagctgtgatgattctttacataatcttagtattatgaaatctaactgtttggcataacgttattgtccttgagtcctgaaaactccagcaaaatattgttgtggttagaattaggtacagacacctgattaagttattataaatcacatccaccatttgatttagtgaaggtatccccgaaacaaacaacatggatacaaattaatcaccttacaaaggatgattcctctatctttacaaagttcataaaaatacatccattgcagcaaaagaagtttcttttctacatagttcaaatgtttatgctgaagaactttactatacagtgcaatttatatactttggagtcatatatatatattagttttctgaaacattggagcaaatgtaatacatcgaataatatgatttatgatgccatttactcattacttatatcattgcttttttcaatatttgctattataaaggttgttgattcattgattcttaactatcttaattttctaggtttttactttagtagaaaagtagtagtgaagaagacatcgatcatcgtttgattcaaacaaacagtaaaaatatataagcgctctgcttgataacatatccgataaaaactgcacactttttttatatggattatgcacatcactaactttacttttggtgtatttataacagatgcattacatgtccatcgagaaaattgaaatatggctttatcaaaagctatgatcattttaggtcctgaacaatgtatgtctatataatagacaatttgtatttatatattcaataatctacaataatatgtctaggcactagactcaagtaatgcaaacttgtggttttatatatttttgcaaggaatgtaaagttatggttacgtactattgaaatggctctcataaagttccagtttagatgttcaattatcattgattaatcaagtgccagctttatctgtttacatgttgaagtactccactgtactgactgtactcatttcaatgactttgtgatatactcatatacatgtaacatgtaattacaatttgttcatggatcttgaattcctgattcgattgggcactatttcatgcagtgctggggctgtctcctgaatagttttaccatccataaactgaaatttctatatgttgaaaatggccattaaatagaaaagaatcatttctgtagaacagcacaatgataaatatggaactgagagtgtgttttttttccgaggtgaactaagggattttaggctttgcaatatgagcatatggcaatcagaacatgattaatgccttatttagctgataaggcttaataattaatacgatatacactgcgtccaattggactggtcttccgcgcgaagccgcggttactttctagttcaatatagtacttgtagtaatacattataggcgcattcactatcagcaaatacagtttcatcacatagagtttcatcacatacattataggcgcagtcactgtcagcaaatacagtttcatcacatagagtaacattatcatttactggtctctgggagacgcagtaaatacagtttcatcacatagagtcatcgaaatgaaaactttgacaggtttaaaaccgaaactttgtgcagccaatcatgtgattttcagattcgaagacggaatcttcaagttccatcaccttcgtatgaatccgtaactgctaacggactacacaaaccgaggcggcggatggggaggtttgatcacgccggcggcgaagggcagcacggaggtaaggggggcggagtcgggaaagagaactccgaaaccccattattgggccgatcgacgagttcccgaatgggccgcatgtaatggcctgttagaaaagtaaacgtgagatgcacgtaagggaacagtatcatggcccacgtgcaggcccatgattgggtttatgtgggcccactgcgaggtataatagagataaaaaataatagagtaaagtgcacgagttcttaaacttgtaattggtgtatcatttagatcactaaactttcaaaatgtatatctaagtcttaaaacttatcatattgtgtcatttaagtcccaaatcgccacaacctcttcgagatcctacgtggcaccgatgtggcatgccacaagtcccaaaacttatcatagtgtgtcatctaagtcccaagtcgtcacagccccttcgagatcctacgtggcgccgatgtggcatgtcacacggacaagacgtgacaaatggaacccatttaaaaaattttatttttattttttcttcttttcttctcctccttttttttctcctttctctttctctgtgacccgagcagaagaaaggaaaaaaaatagaagaatgagaagaaaaaaaagaaaaaagaaaagaagaaaaaaaaagagaatgacacgtcacgtccatgtgacatgccacattagcgtcatgtagaatcctagttgatttgggacctaaatgatacactttggcaagctctgagacctgaatctgtattgagagtttgaggacctagataacacaacagtacatgtttaaggaccgcctatgtactttactcttaaaaaatatgattgcgcccttatatgtacccactccgtaaaaaaaacaatcataacactggatgtgacattgtgatatatcctaatacgattaatctagatagaagcctgtctaaatttgttgtatatgttatcacattcagttctagttttttttttcagacagagggagtattttctgcctacgcatgcaagacaagattgcatatgagcgtttcaatagtgtgctggacagacttgatgtcttaatgaatatgtgtgttcctaattaactctctgcagatgaagatgttctcctagatttattaattagctgtagggtgcacaaacattttggcagagcgaattatttactgacatgcacgcattactctttaccttagattggtagtctttggtttgttttcttctttgtgattggttttgcctttatatgcttctctgaactatactgtatgatcatatagagtattgggatgttttattccattataaaaaaaagttaataatcctgtcctgatatcctgatggggtctctgccagtaattggcttattttgtttacattgatatggagtaatcaaatatatttcagattatatattttctcatggaatcttacattcttataaatggaacatggcctcacgtccttcaggtttgtcgcttcgcttactttcccattggctcttcttcttctcctacacttttttggagctgtctatacatttatcgagtgatttctaaaaaaaaaattcacctatttttttttagtcttagatttacatccaacagactacaaaagaaaataacaagtacatatttacttacatattatttttatcaaaattacagtacatttaaatgtcatatcaactgaatttgtaaatgtaattttagttatatagttgtaattttatattttaaagaaaataacaaatatatatttaattacacattaatttttattaaaattatagtgcacttgcatattatatcaactgaatttacaaatgtaattttagttatataggagtgtaattttatatttcacgacggctatgagagaagcggtgtcgctcgccaattcagaggccaccttgccaccgtgcttctctattatcgcgcgagcgtgagctagctgggtgacacgaaggccgacgtgccggccggccggcgagctgtaacgtttcaccttgcaagttgccgctcacgtcactaagtggttgtatatatagcaggcaaaaaaaagttaggctcctatcggttgcccattttgccttagaaaataaaaattaatttataagtaaaatttttatagatttgttcatagcgacttaaaagccaacattaataaaaattacgttaaaaacatcttaaaattaagtttaaaaatttaaattttagtttattctttagctgtttaggccaaacaatggggctgtcaaatgccaggaaataaatcacagatggatagcaaaattgacacttttttttttctgcctcagcctgagacaatggaagggcatacggggcaccaggcccatcaggcatgcggcccagccgaatgcttgggccgccctgtcccggcgtccctagcgagtagcgacctagcgccgtcttgggatttttagcgccgttttgggattattttttcctcagatcaattgatgatttatctgtgacatgattaacgataagtggcccaatcatctcggcttgagatttgagaatgattgatgattatgaagtaaactctgtcgaggtggacaggccgcaaaaacacctagcgggataaataaaaggaataagttcaatttcactcccttaattagtggtcgaatctgaatcgtatttctaaaccacaatactggatattttcaccccaaactattaaaatcggtgtaatttgaccccctcgacagttttggagggtggtttcgctgacgtggcgcatacgtaacggcattgacttagtcttcgttccacgtggcgcttacatgtataaaaatttaaaaaatatgagcggaacccatttatcatacacacaaatataatgtggcaaaaaggaaagttttgatagggtaaactgcgatgaatggcttacacagggagtacattctctcgttgataacacttgtagattaacatctccatccctccctgctgtattttttggttgcttacacctagagcctaagttaaacccaaataggttaaacatattaattaagttacatacatttataatcaatactaatccagtcctcatgcgcgaaatagaagtggattagaattttatttatttaattaattgtgtagacagtattcgaactaagagtgtcctctgaatttgctatcattttaagttgtatgtaccaaccagtttaacctaaaatttaagttggtgaataaaggtaggcaatccacttaaactctaacaaaaccaaataatgtacttgacaattgaaagcttaatcaagtacgtatcaggtatcaagtatgtttgttccacttaacagataacaaacgattcactttcaggccattagactacatatatgcaaaagtgttgagaagatccttacacaaaaggaatcgtttgcactaggcagcaggtataatcgccaacgtgctctctactcccttaaaccaagtgcaatcagttaattagtgatgaaaaagatagcactgaacaagctaagataacactggagaaggaagagaccaatgaggagacaacacactgatgaacatttcgggtgctgtagtattattgcaagtgggcatttcaatatgctgcattgaatttcgtattcgtaacctgaaacagaaggaccagctgggaaaaaaaatgcatttcgtcgtgtttcaatctcgatctgatgaacattctaatatatgccactactatctaccgctccagttatcagtatcaatgaattgtttgtgcgctacgtcgcatgcagttgcgcatcgacatcaagatttgaggtatacagctcctcagaacgcaactcttatctctacttttgaagcattttcaacatgtttttgtcgctcagatttcttctactatcgaaattccctgtgcttcttgatccgttcaatgataaaagatggccggggctgtaaaaagttggtcgaagacaaacgcacttgggagcgctcctatccctaaacttattagggtaaatggaaattctggataagcacaaaaaaattctggtcaaagatttcccatttgcggaaaactcaagtacgttttcgcatattctgatttgaaacgtggtcaagatcctaggagaggacgtcaccctcctacgtctgtcctcacgtacgctgtcacgcactatcagcaggagagagaattaatggaaaagagagggaaaaagaagaggatgagcaaaaagaagaggaggagattccaattgacaaaataaaattcacagtgttagatagacctcccacccgtcgggcccaacggcacaacggaccttgaccgcgccttgatcaggggtgtccagcccaatggctggtgggcccccgtcacactgcgccatataaaagaggggtggaggccggcacggcacaaggtacgagatttgtcgccgccaccaactctaccctacaaaccctaatccaatcgagagggggcgcagccagtgacgggaaacgccaccgccgcgccacgacctcgccgggatcgcccacgaccaccgctgcaacaacaaccgccgccgtcaagcacaccgtcgtcgccgtccacatcaagccgcgacgacaacgacgatgtccggcgcttcttcctccacgaacacctcaaccggttggtatctaaacccctctccctttcatctataatgtcaaacatcaacctaatagatccacccgactagatctaacctaggtgatcctagtgcaaagtctaacaatggtatcagagcgaccctagtgtttagatcagttcggggaaagaaacccacagaggaaaagaaagaaagaaatgcaaacgatccaacgatcgaaaagaaaaccctaaccctaattcttacctcgtcgccggccatcgttgacgccggcaacggaggggggaggggcacagaggcaccgccgagcagccactcgatggccgtgcgcgcacccgcgagtgcacgcgcgtgtcggcgagggggcccgcggcagcgccaccatctctgtcgtcgccggtctctcactcttcactcgcgtggaggggtgagacggtgggggggggaagagaaaagaggacgcgcggcggcgcaaggtcgccggccatggcgcggcggcgcaagggctgccggcgtcgaccatgccgctcggcgcgaccgcgcgcacgcgtgagagagcagagaagaagctagggttcggcgcggcggctgggggtcggggttttgatcgcccgatctccctgcccggccgtccgatcaaaccctagcggattggacggccgacgccggccgggccgaaatcggcccaagagggcacgccgggagggggtgctttcccggcccgggcccacgttgcggccgcgcgtgagcgcgcgcgctcagccgtgggccgaccgtgggccgcctctcccgatggaccaaaaaaaaggaaatgaacagtagcaattttcattatattctgtctattttcatgcaaatttcaatagaatttgaatagatttttgcatgttttacctctgtttaaatttgaaccaacgggtgaatttttacagagagtaaattacagagttttgctactgttcatatgaattttatatagttttccgctggaaatagatgaaattgatgaaaattagtgtttctaaaattatatgtcgaaccaacgggagaatttaattttaggaacattaattatgtgctatgatgttgtaattttctaaccaacgttgataattgcaatgttatagttatggttacatgtgttatgtctaattctgccaattccaaagtggcaatcatatacatcaaaatccaactttgatacacttattaaatttctttgcaaagaaggaatataaaagacatctcgaagtaaaagtgtgaagccattcgcgagttctagaggaagatctccaacagcttcaactttttcttcaactccattggcaactctaatggagctttctcttctttgcgtagtcctcgtcgaacggaatgcctttaaacaattacaagcatgaatagttgctctagaattaatccaccatgtggatctagagtaatcaacataatgagattcatttacaaatgtaataatgttctcacctttccttgccatgatcattttcaagaagtctggacaatctttcttgtaatgtcctgtcttcttgcagtggagacactgatctttctcaacagcgaactgttgttgctgaggtagatgctgagactgtttagcttttgaggtgggagacttgtggttctttttcttattatctgtaacatagttaattgaaccaccatttgactctttgtttctctcctcctcttgcacacagttagcgatgagcttttcaaagtttcatttctctggacttatgttgtagttgacaataaaattgtcaaactgctttggcaatgaggccataaccaaatggaccagaaagtcatctgttatgcccaaatccattggcttcaacttgaaagccatgttgctcatcctaagtatgtggtctctaacacctcctccatagtacctctctgtcacaagctgcttgatcagctgtgtagcataagtttttgaagagccagtaaactgactcttgattctttcaaggtactctgagacagcgtcacactctgggattgagcccaatatggtaggctcaatcgtgttctttaccacagccaaacatttcttgttagctaaggaccatttcttttgttcaatgtcatacgacatgacgagaggagcatctgttactgggttacttggcagatttcagagtagtccaggcccagagcactggaaattggtaaagaaagtcttgcgttatttgcaaggaacaaaatgcctcatgctgtcttacagaagatcagaatcgctccagatagtggggtattcagattctgattttgcaaaagataatacaaagtcaacatcgggatatgtgttcaccctggcaagaggagctatttcatggaaaagctcaaaacagactatcactgcagggtctactatgtatgccgagtttatagcatgctatgaggcaacggggcaggtgaactggctaaagaagttcatacccggtttaaaggtggttgatagtattgagaaaccactaaagttatattgcgacaatgaacccgcagtaatgtacgttcacgacaatcagtcaagtggtgctgcgaaacacattgacataaagtactatgttgtgaaggacaaagtccgggatcaaacaatcagtctcgagcatattagaacagaaaggatgctcgcggatccgctcacgaaaggcctaccacccaacgtgttcaaggaacatgtagccggcatgggtttaagggaagccttatgaatcctggactacagggcccaaaagtaaaagtatctatttttgaatagagatgtgtatagtggctgttgaatccatcggtgattgaccgtgacgatgaaacatgctctatttacaaatctgtgatggaatagaaaaagctaaaagaaatagtgagatcaagggggagaatgttagatagatctcccacccgtcgggcccaacggcacaacggatcttgaccgcgccctgatcgggggcttccagcccaatggctggtgggccctcatcacactgcgccatataaaagaggggtggaggccggcacggcacaaggtacgagattcgtcgccgctgccaactccaccctacaaaccctaatccgatcgagagggggcacagccagtgacgggaaacgccaccgccgcgccacgacctcgccgggatcgcccacgaccaccgctgcaacaacaaccgtcgccgtcaagcacaccgtcgctgccgtccacatcaagccgcgacgacaacgacgatgtccggcttcttcctccacgaacacctcaaccggtcggtatctaaacccctctccctttcatctacaatgtcaaacatcaacccaatagatccacccgactagatctaacctaggtgatcctagtgcaaagtctaacacataggactagtaagcaggaggaaaccagatcgatggacgatcacattttgacttgcgttatatataaaggaattgcacctacaaccatatctcacactctttatcagtggtgagctagctcatccgattacttccttccattatcgcggggagaagatcgatctgcatttgtcactatggagcctcgaggtaaatcatacagattcttggtgaatttattttctttcttcgcgatgggttctctcggcggcaagatcatcgccacagctgggtgcgccatcgccttcttcgcggccggcgccagcggccatggtttagtactcagccttctgggtgtcctcgccggcgtcatcatcgccatcagctccgcaacgctccatggcatccctctactcgtcgctgtggctctgcgccgccgcaacctcgccgtccttgggctcgtcatggcctcctccgccatcgcggcggccgccggcgaggcgagcccggcgctcagcttcattctcttcgccactctcctggtcggggtctccctcatcgccgccggagttcttggttcataactaattaatatcgtatgtaagctgcgattcatgcatggacaaaaatcgatatatacttatactctggtgattcaggtgaggcgatgttatctgattcttgaaacattcacgtcccttgaactgtttaattacagtgtctgcccatacctgcttactatatagtaatatactagtgtcatttgtgcagtgtgctttgtaacttttcacatgtgtgtatttgttaattgccttgtatagttgtcacatcctgaattttcgtttcaggatttataaattatttaataaaataataatagaatttatattaaaaaaaatctttaatttacaagtgaagttaaatgtgggaaataaaatttcctaaatataaagcatggatggatttaattttttattaaattctccatggttaattatactctctgaaattttctcggatttttcagagctcaattcttaaataatacaaagaacagttcagtaattatttgatcattaatgatctaagtatatttgttaagtgcttttcttgtttaaaatccttaaaattataaattgttgtttaaaaggaattattagaaatgattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggccaaaaaccctctctctctctttccttcggcccagtccggcccagtccgccgagcctccgctcttctctctctcggtgtcgctgacaggtggatcccacctgtcaggttcgtcttccccgagccgtcgtcgcccggccgaaccctagctgagtcgcgccgccgccgctttccttttccgtcgctcctttccatctccggccgaattgattgaggccaaatgatccttgagatctcctcttccttttctcttttggaaacatcggctaattttctttggaaaccggtggatttgagttcgattcggatcgacttctctctctccgggcccgacctttccatcccgccgccggtcgccgtgggcctccgccgccgcctcctagcccctttaaaaggatccccggtgtctcctctacccgctgcctctctcgccttcgcctctcatcgtccgaagcgccctagcgccgtgccgcctcgcgccgccgtcgtcgccgtcgctccagccgtgcgccgccgctgttccagtcgtcgtcgtcgctcggggagatcgccgtcgtggtcgccaagtcgccgccgtcctcgtccgccgtttcgccgccgccgaagaccgccggagcaccgccgtcaccgtcgacccgatctccgccgccgcttcttcctcgtcgccggcgccgtccgttgctcctccgccgttgttttggtcaccggtgagttcgccgcgtcgccctctacgtcttggtgccctccgtttgtgccgtagagccgccgttcgccggcgagcgtgcgccgtccgagccgtccgagccgccgagccgccgccggaggtgacgtcgtcgctgacgtcatcgtcgccctctcccgtgagccggtcgtggacagatcgatctcagccgtccgttttggatagggttgatctcggccgttcgtttccgtgaaccgccgccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgtttaagtctcataattcatctaaaattatgatctacatgtttgtttactttttatgtattgtttatttggtttttattagtctttttcttcgttttgcgtgttagcttgtcgtttccatcgttgtgaaggttcgcgagtgcatcggaagtgttcaagaagattaattgaagaccgaatattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttaatccttgataccttgggttattataatttgactagttgagctttatatattggttcagctagatattagatgtgattgcttagccatgcttagaaacattagcacactattgggataacttatgactcattattatttaatgatggtttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaatggctttaccttttgtatagcatggttcattgcagagcaccagactgagaagtggcggagataagcccacgggggtcgctggggagtccatgcctctggtttttgagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccatgcccgcggttatgggcgagttgagcaatgtttttcgtgattagtcccacacctctcaccataattatggatgttatacctggtaataatttgcttagctcctggtttggagttagatctgttcagccgggtatggttgttcagaatggttgggcctgtgcagcatgggtgtgctgttcagtgttgattaaaatttccgattaattactccactgttttacttctcttaaatgttttgctaaatgctacttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacaatagttttgtctccattgagggagacctgttataataacttgattaagattgatgttcctaattatcagtgtgccaactgtcctggattagtaggcagagtaaaccagcaattgaaatccagtaggcagagtaaaccagcaattgaagctagtagctagtacgtacttccgccctttttaaatgtttgatattaactttttaagtacatatttgactattcgtcttattgaaatttttttgtgaaatatgtaaaactatatgtatatatgaaagtatatttaacaatgaattaaatgataggaaaagaattaataattgcttaatttttttaataagacgaatgaacaaacatatttaaaaatatcaacgacgttaaatatttagaaacggagagagtaatttattcacaaatgattctgcttgcattctgtttgcttactggctttgaatccaggggtggaggtagtatatgttaggggggtgctcaggaacccggtcaaaaaaaatttttagctatacctcatctattttcaccatgtatgcaccccctcaatacaaatttaggcacctatatcagcttaaactcgatctaaattagagtaaattaagcaagtggcaccaccctctgtttcgctctagctccgccctgtttgaatcattcagcatggcttctgattcctgaatcgacgaccaggtttcctgaactgattgattatattattgtatccaaatctctgtctgtttgcaacatgcaaggattgtttgtcatgtgtgttcctctgtgctacaaaacatgcctgtatcatgtatgtcagtatgtgagaatctcttaagattcacgacgtcttttgaaaaatgtgtttatttaagctatattgcatccatgcttaggtactattattttcttattatatcattgtctgaatattactgaaaattggtagtccaaaatagatgattccaaaaaaaatggatgaaatctttagaattgctatgtctattactagcacacactttttttttaaaaaaaaacatcatctcaaaactttcatatgaaaatcaattcgaaaaacatttacactactaaaaaaatacaaatagatgcttcccaaccagcacccatatagcggcactgatgagagatatcaaaggtgctcccctgcaccctgaccagatcaaagaacacacatgaacatcaacagcatccaaaaacacatgaacatgaacatcatgaacatgatgttgacgcttggatggactactgcccgacgatgatacacggggcatcgacatcatactccacccctgccaccatcgccggatggagaggaggagcgagcctccttttccccctccagctgcaaccaccaccgccttccctcccgccggatctagcggaggagaggacaccgccaccaccgctaccatcgccaaaggctgccacctcccctcccgccaaatctggcagatgggagaacacagcccctgctgccatcagaggccaccgcctccctcatcgtcggatcaggcggaggggagggcacggtcaccgtcgctgccaatatcaccaaaggccgctgcttcccctcctgtcggatctggtagaggggagggcgtagccgtcgccgctagagagagagagagagagagagaggcatcggagagagaggcgtgggcgagagggcaagtggataaggtcgggtgcttggctcgccggttcggttcggtttggtataggtgccagtttgtttaaaagattaacacctataatatattaaaaaccgacacctataatatattaaaggttatggtttttataggtgtcagttttatatgttttcagcccgtggatgtgggaaaagcattataggtatcggttttagctgttctggcacatatagtgttaacttgtatgtgtctattttagtaatgttatttgaaagctttaatctgaaaacttccatatgtgaacttttaattatatgaaagctttcatatgaaaaactattggccgggaacgtacgtatgccaaaccgaaatttcggttcctcacgcaaaattgccattcaacagcaccaacaaaaaaaaggataaccttttcatgcagctgttccacaagcaatgaaaaaagcaccacgaaatcgtaatccaccgattttttagtactttcataagctttacttggtaaatagaaagcaatactcaattatttatcaactgttaggtatgatgaaatttatccttagccttgtattcaaagagtcaaatgaaggcaacactggtggagaaaccgtctttactcccggtttgtaacccactgtagtcccgatttttcaaccgggactatctttagtcccgggtgaaataaccgggagagtaaagatcgatctttaatcccagttggtaattaaagagagggatcaccgggagtaaagatcgatctttagttccggttagtaactaaagagagagatctttagttaccaaccgggactaaagagaggatagggacagtctaggttggtccatttcctttttattttctcccaaatcgagtgggatgtatatacccaaatcaaacaccaaatccccaaattgagtgccatgtatatacaaatcaaaccccaaatccccaaatcaaaataacatcccaaatcatccacatcacaaatacaaatcctaagttggttacacacaaatcaaatacatcaaaattacacaaaaatcaaatgcatcacagatcgattatacatctcagatccatacaatgaatcacaagttctaaaaaaaagaacaaattatacatctcttaatctcaaattacaaaaaaaaaagcggagaggagaaccagtgtgctgccgctcgccatatgccgccgcttgccagccgcgcgcctgctgccacggccagcacctgccgccccaccgcctgctgccgcctgcccaccgccgtcggctgccggatgtgaggaggagacgggaggaggaggaaggggaggagggggggaggaaaggggaggggagaaggaggaaggagatatgagggataggaggagaggggatgatccgatcttatataaatatcttggtggggaggaagtctcgtttgggacttaaccgatcagatatgggagagaaatatttaattccggttggaattttcaaccgggactaaagatagatttttagtctcggttgataatatcaaccgggattaaagatctaaataatttttacttccgttggtaaagttgtaatctttactctcggttggtagtatcaaccgggactaaagatcctcgacctcctgacatgcctttgacaggttatgaaccgggactaaagatcaattttttttataaccgggattaaaaataatctttagtcctagttctattgtggaaaacgaccaacccagcaaagatcacttttctagtagtgtagagaaactatatgccagccaaagaatcactctaccacttgacttagacatttttttttcatttcaatagcagaatgaccatgcttccctattagaaaatatgatggattaactgtaaaagaatgctaattaaagtagtggggggtggaggaacaacaaccaccactagtagtggttttcatagttgtatagattagtagtcgcttttccctgtcacaatataatgtacgatccatttgtacttttctaagtactttatatcttcaccatatcaccgtttactttatcgcagcttctttactatttcacatgacaattttttgcaattttcttgcctacttgtttccccccaatggtttcaatttttttcattaagcatctaccctcttcagttgatattcgaatattcttatctcatctctacttttatgtatataatgtattcagttccaagctataattgtatgtcggtcatagtagttgctatcctcttttcccactgcccgcgcgcagataagaagcatgaccttccaacctgaggaatctgaatgttgacccttttagagtttacgggccgcatctgtggacgttctttggaatttatttcgctggcaattgcctagctatgttggagtactgtacgacagtacgttattgacgcgacgcaatatcacacttgatgccgttttctcacgagttttcagttcgtcgaatccaatacggtccttgtccttataccggagtactccctccgtacgatgaatctgggtagtactttatcgagattcgtggtaagaaatcatatacacacctaaattgtgaatttctttttcacgcaggaaacaccaaagtaaaagtcgttgatgtgatgcatatttagacatcagtacatgggtacgtaggctgtgtttagttgactttaaacttctaacttttccgtcacattaaatgtttgaacatatgtatagaacattaaatatggacgataaaaagaaaacaatgcatagtttgcatgtaaaatacgagatgaatcttttgagtctaattacgtcatgatttgacaatgtggtgctacagtaaacatttgctaatgacggattaactaggcttaatagattcgtctcgcaatttacggaatctgtaattgttttgttattagtctacgtttaatacttcaaatgtgtgtccatatacgtcaatttttttttgccaaaacagctaaacacggccatactctctctatcccataaaaaataaatttatgattggatgttacacatcccaatactatgagtttaaacatatatatatatatatatatatatatatgtttaaactcatagtactatgatatgtaactttcggtactggaatacttcctcgatccatatacaatgattctggataaccctttgtccaaatttgtctggatgtgatactacctaggagaggacaacgagttcttagatggtgttaaattcgtactatgtatttttttaaaggagtgagtacgtacacgagaattatcgtttttctaaaaataattatccttttttttcaatgtgtgtcgttgcacctagattaatcttagccttgtgttcttcgtctcggacttgtgttgcgcacttactcttgtgttgcgagtcagcttgccccctccaacctgaagaatctcgaatgttcacgcttttcgagtttaccggccgcatctgtggacgctctttggaatttgtttcgctggcaaaattgcccatggtggagtacagtacgttattgatgtcacatcggaaaattgcccatggtgtttagttcacgaaaagaaaatattttggtgtcacatcggatgtttgaccggatgtcggtagagaatttcggacatgaataaaaacactaatttcttaactcgcttggaaaccatgagacaaatcttttgagcctaattaatccgtctttagcacatgtgaattactgtagcacttatggttaatcatagactaattaggctcaaaagattcgtctcgcaatttcccccctaaccgtgcaattagtttttttaaaaaaaatctatatttaatactccatatatgtgtccaaagattcgaagtgatgtttctgggaaaaaattttgggaactaaaccaggccttagttcttaaatttttttttccaaaatcatcacatcaaatctttagacatatgcatggagtattcaatatagacaaaaataaaaactaattgcacagtttgcatgaaaatcataagaggaatattttgagcctaattactccatgattagtaataagtgttacagtaacccacacgtactaatgatggcttaatttggtttaaaagattcgtctcgcggtttctagacgagttatgaaattagttttttttattcgtgtccaaaaacctcttccgacaccggtcaaacatctgatgtgacacaaaaaaaatatcttttcgcgaactgaacacacccttgataactttttcgcactaattttcagttcgtcgaatccaagacaggccttgttcttttaccagagaacttcctcctctgtgtacgacgaatccaaatatttttttatcgaaatttattatattagaagggatcacatctctatctatatatatctagattaattttttttaacggagacggatctctagattaatttttcttaaacggagagagtaccaaagtaaaatcgttgatgtgatgcatgcatgttcaaatattagtatgtgactacatacttcatccatactgagataaaccaaccttataccagtacacgagagttgtcgtttttcccaaagaataattattcttttattttcagcgttgtactgtcgtttgcacctagattatatattcttcgtcttggactcgtgttgcgcaattgggcttgtgttgcgagtccgcactccagctgcttgccccgtttgacaagaaatctttcaggagaaaagaaacgagccaacaaggcgctccgcgcattttgccgacctatcaaagccgaaaaacttcggcgtctctggcagtttcgtggaagtctcgaagcaacgaaccgcgtccggtgtgtcattattcggccgtgtttagttttcttcctattcacaattttccatcacatcatatcacatcaaaaacttttctatacaaataaacttccaactttttttttctaaacttccaattttcttcaaacttttaactatttcagaaactaaacacacacttcgttcccttataatactccgtacttacatatccatatccgtacaaatatgatttaattgcttccataccggttttcatgatgatttaggtttctagagtatttttttaggtaagatcgaattatcaccgaactattgggtgaatacgagttacctccttagacctaaaaaccagatatctttcaccattaactattaataccggatgaattacctctaacttaatccggagtgattttagtcctatgtgacagtgtagtaggcaattcatttttttaaatcaataggccccatctgtcagttggagtgaagacatggaaataaaaatatattctgaccttatactattactagtatagctaccaaatttaagtaatcttgcatgtacatgcctatgttttcaacaattaaacatttggtctgtaaattaaaatcatgtagcaattgatctatgttgcattgagggctatgtctgtaatgtactattgatatgtgaatcatctagaggcctatgttgcatagagctacatctggtctcagctagtactaactaaagtaagttttgcatgacattttctaaatggagaaaaagggaattttagagaaacatatcccttccatctgctcccactacttagggctttgcttggatggagccagtgaatggatcttggcccagaccgatggccattgattcgagccaagtccaagtttggaagcggcggtggcagtgttcccaaaagttcttgatctagttcttgttcacaaccttgctggccttctcgtaaatcgctgcctgcagattgacgtagtcctgagctttcgagcagctgccggtgatggtgcggccctcgatttcctccatgcaactgtccaggaaggctttgagctccgcctccgtccggtgtgtgtgcccaccagccatctaacaacccaagtcaagcaagctagtatgttgaaatgaacaaggcagaacctgtgctttacctttcgtaggtagtccgaatcgaggaggccccagtctagagaacactggtggagaaaccctctgtagtcccggttcgtaacccccctttagtcccggtttccaaaccgagagtaccaatccgggactaaagatcgctatctttagtcccgggtgaaataaccgggagtaaagatggctcagccggccacgtggctgagccatatttaccaaccgggactaaagatcgagctgaccttttttttttgcatggccctgttgctgcatggtttatatatatatatacatatatatatatatatataaaccatgcatatatatgtttcaatacatatatatgcatacatatatatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaaatatatgaatgtatgaaattgattagtaattaaacaagaaatcgctacgtaatgaaattttgaatttatttgtacgtacatcgagctctcttgtggtgatgatttggtttgcaaggcagtggcaatactcgcacatgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgttttctttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacaggtgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggccgttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtcccctccagggtaatccagctcgaggtcctcgtacgcgccttcgaccaactcaacttcgaccttcgagtatcctgctggaatcggcctgcagtggtaagtacctgaagggtctgttgggatggccatgcccgacgccaccttcatgttgtgagagattatttattagtaatcaacatatataagcaacaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacctggaactctaggtctgcaatcttcgcctcggtatctctcttgctcctcatccgactcctgtacgtgtggatgtcctccttgaaaccaatcttccaaggaatcacccatttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttgcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttgcacttccgttatgatgtgccgaccctcaagcttcttcgctgcacctcattgcccgcgtgccctcttctgtccaacggagggttgactaccactagcctcctcctcctggttcccctctgcatccctctccacgtttccttcctcgttcaagtactggtttggatcctcgttcccctcttcttcataccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctactt

SEQ ID NO: 70043 - DNA, 2011 bp, Oryza sativa
atttgcgaaataagttttttttaaaaggactaaattataaaaaaatccaatcgaacctagcaccttttagttgcaagatgatatcacccaccactgagctaagaagagttgttgtaaacataggcgcatgtttgcgcctttatcaatgaagacctcagcgccaagtagtgtgccgctgagctttgctgatttggcttttccttgttgcgcagcgctatcgggattggcgctgaataaaaggtttatttttgcaattagtttttatcacggttcaatcctcaaataagtttcctaaaacgataattttgtcaaattttcggggttattagtctcgaaagctttgtgtcggtttgactttcgatattttctttagtagtaacctatttgagtgtaagtgaaaaataaatcaaccgagtgacagatagacagtcaaaaagattcaggagattaaatttttggtagttcgttgaggatgctctaataacaataataataaaacctcgtgtagtaagaacaatagtccccatttactgcatgaaattttttaaggtaaaatataactctcacatgttcactggcgctgcaactgctcaaacatttcctgcagagattacagctcaagatgtgtctcattgctctctgtgtttctccgctatgccgccacgtcttccacaatggaaaggcccatatatagctgtgttcggcactgctcccaaccgaagcggcctatattagcgtgtaattaattaagtattaactattttttaaaaaataattaatttaaactttttaagccactttcatatagaaacttcttttgaaaaactcactgtttaacagtttaaaaaatatgcgtgtaaaaaatgagggagcggggttggaaataagggtaccgaacacagccacgtaatcatgcaggttgcagccacgagtcgtcatctcggtgaaccgcaccgctcttccagctccatatattcggccacacccacacctagcttcgttgcagctagctaacaattggacgtgtcatcacaagcatcaaaccaatggcaactcaccagcagaagatgcagatgccgccgtcgtccaaggacgacgagccggcggcggcaacacgcccgccaccgccgaagcgggaggagcgcgccgagaaggcgccggagatggagaagaaggtggtcgtcaccgtcgtgaacggcgaggaggaggacgacgacagtgggtccacggacaacgggcgccgccgctgcgtctgctccgccgccggccagccggccgggcacttccggtgtgtgtgcgcggagacggacggtgccgacgagcccgacgagtgaattaccgagaaggtgttttcacgtgtgcctttgctacgagttttgttttgattgatgtatggagatgagggtgcacgaacttatgattgttttaattttggttgtcttaattgtcgtagtattttgttgcaagctagcaataatcataaatgggcaaaagaagagtatctcttttttttttacctcatgttccaatgttgtgtgttgttgtttcaaataaagattacaaaaatgttgtgtgcttagctaagatcaatcggtttaatcttaagccagcactctcgtcggcgaaaaagaaaagcgtgattcttttcacgaaaatgcaaaagcatgcgaagtccttaacctttttttgttgcatatttttcaacaggaattgctgataactttcaatagaaaagtttgaacttccaatggttgtttcactttcaatgtcaaattcttgacaactttccaaatacatcttttgcacacaacttattattaagaaccacattcaaataatagcaataataaacactaccaagaatagtgaaagccaaaaaggcctcgtgcagggctggactggggtcgatctggggagtattaattctcccacaacgcgcgcgcaaaataccattttcgttaaatcacagattaactgtttaccgaaacaaatggcgtacacaaacaagaac

SEQ ID NO: 70044 - DNA, 15734 bp, Oryza sativa
aattcctgcagccctgggtcttctatggtctccccatcgtccatcccaacagcatcctcgtcgttaccatcaacggcattggcctcgtcatcgaggccgtctacctcaccatcttcttcctcttctccaacaagaagaactagaagaaaatgggagtggtgctcgctacggaggctctcttcatggcggcggtggcactcggcgtgcttttgggcgcgcacacccatcagagacgctccttgatcgtcggcatcctctgcgtcatctttggtaccatcatgtactcctcaccactcaccatcatgagtcaggttgtgaagactaaaagcgtggagtacatgccgttgctgttgtcagtggtgagcttcctcaatggactctgctggacatcatacgcgctcatccgcttcgacatcttcatcaccatacccaatggtcttggcgtgctctttactctcatgcaactcatcctcttgagctggtaagataagaatcaagataagaatcttgagctgccaaccgtcgcccctgtcgccaaggaaaccagcatcgtcacccctgtcagcaaggacgacgacatcaatggcagcactgccagccatgtcataatcaatatcacgaaggagccataagctagttaggtgatcgaacaagtctaacgctgtaagctagttaggtgttaccaatttctacatttaggtgttaccaatttctacattcaagtcatagtacttttttttagtaaccaatgtaattttgtgttttttatctatttgtgaagttgcgattatatatattatatcctgtaattttgatttgtcaaatggattccaaaatttcggaataaaattttctagaatgttgtttgtcatcctcttcagggttgttaatagccgtgcaaaaggactagtagccaaacatgtcatggtgtacagcaccatgtgaccaataaatcagcacgagcaaccatgtccataccgtctagttcagagcattgcgcaaaatctctacagagaaacatagagaaagacagttcttaataaaaattctaggtccgtgggacctaagactacgagattatatcgatcgcctgctctgccattaccttagaaacgaaaccttcacgaatatgtgggcatgcattgtgggttgtatttgagaaacttataaagacgtaatatcaaccgaataacacatgtcatgctttaactgtacgattctccacaaaatttcttcgtcatcattgcttaaataatattttcaaactatttttagttttatactctactactagaaaaaatacccgtgcgttgcaacaggttgtaaataacatttattcaaataaattaaaattctaaaccacatatcataattgggcataaatgataaaaaaataaatatcataaaaattatataactaaatccttttttttcatttagctataaataatttaattcagaggaaaattataatcaataaattttaatggatcaaatagagctgaaactaatattgtaaatagagaaacaactgaaattagctataaattaaaaaagaacttattttatagtcagatgaaaattcgaactgatgcaattttggtcactaaatcgaattagcaacttttgagaaaaatattagctcatcatcctaccaccagagacattccatttttgacagtgttctcatcgttgagattaaaaatgaactggaaggtaggaacaccgcaaatataagggttaattagatccatgccattaaaattttagcagttttgaaatataccattactataacgatgccactgctacttgtttgaaatcttagtggtgccactgagatacgtattttacatgtattagacgaaaatgcgctcatcttctacctctctctcttccccatcttctacccctctctctcccctcgctgcgccgttcattccgtccccgctgctcctaatgatgctcgtgatgccgccgctcaccgccgttgcagctcgccactgcctccgccgtgtcgccgcagccactgctgccgcttgccgccgcggccctgttgctgctgctgctgccgccgctcgtcgcggcgccgtcgcatgaacgtgttcggcaggtggcgaagcctagtgacgagtcgtgtcaccgaagcgcggtgaagctcggcgagcgacggcgaaccgaggaatcccaggagctcgcaccgcgtctcacccggcgcaccgtcggccacaagcgcgagcgccacatggaaggagcaagcgccccatggaaggacagcgccgctgacgaggaggttcaccgcgccatgctgttcccgccgctgtccctgctgccgcgcgccgtagcttgctctgccgccctcactgttgccgctagctccgccgctgctcgctgctgccactcgcgccgccgtccccgctgctcctgctgctccaccgccgtcgtcgagcaagaagaaaggagaaggggaggaaggaagaagaagaagagagaagggcaatttggtccaaaatttattggaaatgcatctaaggggtaagcagtggcatatctggctcaaacatatgtaaaattataatggcatggtttcaaatacacgaatgctggtggcatatttcaaaattggtaaaattttaatggcatatatgcaattaacccaacatataatggatgatgtgtgggagggaggcccgagcagcccaccaggcccaacattagcaaaaccctaatccaactccccttttcagccttctccatctcattcctcagccgcaccggcacaccccgcaccagtgctgcgccgcttctctttcacaccgcgctcgccaggacgatggcatcctccttgcatcatgccgctgccgcgccaacattcttctccttcttcatcatccacgcgccacgccgccgtcaatcgtccctccccctagccatcgacatcagcccctcctcctccatgttgttgtgccggtcaaagccgatcgacatgcggtatttggggagggtagggtgcggcaggaggtggtcgccttcgcctctgtactgtcccatggcacctgtttcaagaggtgaacgcatggcctatgagaagaaccgccgttcaacgatattttccacgcctacaatttgtgtgatttttcttcctcctatttcttctttcgctagggttctccatcgtttatctgtgttcaattggaaccgctcgattggattctttccttgttctccccttctagaacatgtagttcagtctgattggataattttttcagggttctcttagttcttgtagatatgcccgattaaaattttataatagggagggaatcggacggaaaaatagcggaaacatcgcaaaaaacacgcacggtgagcgaatcagattgcgcaacgtacgaaaatacttgacaaaaacatcttaaacttttataatatataggtaaagataaagataatatctcttatatactaaaagtccactaaactttctataaacactactaacccatcacgtggtatttctatggacactttttaattgtcacattctaataagtcggtggtccttatctttagaaaaaaaataccacaacccacctcttgtcgaaacaagatttcagcaatactaaaagggggtgactatcaagctggaaaagtggatgggttgaaagacaaagaattttatacaggttcaggccttcttaatcaagaagtaataccctactcctgcccggggattgatccgccgagtgtattattgatcgtatgatctgggagaaaaacgtgccccaaaaggcacccggacacctccttatataggggaagggattcgtattacaaaatacagtccatatccctaacggaataggtagttacagataagattcaatcctaaccgactaggatcccgggtatttccttgacatacaagtttggaatttaacccaagtccctttaaagatattctatctatacatggcaccccatacccagtcggactatacataccgtgttaggtatggggtatccataatctccacagtagcccctgagacctttacagtcgacaaaatagtcttctctcgtaatccaaacgataatccgagtactccgatttcttctgccttgatctcccgagtaccaaaatcaaagactgtgaagggctaaaaatagagaaaatcaagtgcatcgatcagatacacctaattaggtgtagacctgactatgtgattagttaaaaactaagcgtataatcaaggtgtaaacaatatccaatcaagtggttttacaaccggatcatccatggtatcatatagctaagcatatgcgacgtttaataaaacatccagccgactactttagctttgatacaccataaaaggagatattaaaagacccgagtgaaaaacactctaaaggtctataaaccaacacatatgataagaatccgagtaaaaactctcaaaaaagatccatcaaatgtggcataaatcataacaataggtgagtctaaattgcctgagctataactcacaccatatcaaaataagcatataacatgccgagagaatgactattcaaaaactagtcatctcaacaaaacccgaacagcttttgcagcctaaaaaggcttacaaaattagtataacacctttctgttgggcacctttttatttgcatcgtagtaattccaaagaattatctaactgcgtcaaaaaggattttaacagcattgggctataccgtcgtgagcaagtgttgctgaatcaaaatgcctaagtccctaaggatcacaacttggccacgtcgatagccaaatttaggcctaggcccattagtactcccgataacctaatgaaataacaccgaaagcaaagcgtcggttcgtcttccccgccgaaactctcgccactttccccattctctgctacagtgtcagaccacaccggcgaagttacggttcacagtttcgctccaatccatccaccaaagctccacaaaattctcccacgcaaccaccgcatcaatctcccatccattcccagccacattttgaaccaaatcacatcatccaggccacatccatggcgaaagagagagaaagctttgagagtcagtgggcgtcttccgatgtaacggaggagaacctgaaggagatggtggcgcacggcgtgcttccggcaaatgagatcatcgggtggcgtccagcgtgcggtgaaacgtttccgacccccgacacacacgaggtggtggtattctcccatttcttctatggcgggttttcccttccgacctcaagtttcttccgagggattttagatttctatgggctcagtttgcatcacctaaaccccaattccatagtccacatcgccaatttcatccatgcttgcgaggcctttctggggattaggccgcattttgctctattccgtcgcatcttcttcctcaagccccagccaaataaaagcaaaccgtgcgtagttgggggagccagatttcaactgagagggaccttgagccaaaaatacttctccatgccatttaagacctcgaacaaaggttggcacgcgaactggttctatgtgcaaaaccccgagccaacgcttcctgggtactcctgtcttcctccagcatatcgcgatacctggaatcacttcctatgggagaagaggctgcccaagcgcttgacctattggatcgcatgctgaagcttaaggaacagggtctgcagggggagcaaattacccggcacttcatcaggagccagctggcaccattcaaggaaagatcccgaacagcttttgagttcgatggcaagcatgaccccaaccgagagaacccagttcaaaattatgcaggagagaatgtacaaaatcttctcgatgccatcgtgatcagctattcacacttactgccagtcgtgccatacaatgccttcaaccctcctccaccggtacgtatcatacatctcagcctttctcaaagcatgcttttatcttctgtaaggtcgactgaaaacttggaataccatgcacaggaattcgctttgatgaaatccgatgctccaatcgctcaacgccgctcacctcgccggcacactggccaagccagtggagggccgaagatcaagtcgaacgtccaacccaacacctcgaggtcaactaaccagtcagattctcgtaagaggaagttggtttcaagtgacgatgaaggtgatgacgcggaaaagacgggcaacaaagggtaattgggaaacaaccaaagcaagccaattcgaagaagaaaacatccagtcgtctcatgccaaaaataaggaaatcatccagatatgtgtcatctagctatttcccctgtttcgctaatcactcattattgaagcagagctaatagcatgtttcaaatttgtaggaaaccatctgacatagatccttttggaaaagaccccatgccgaatggcacggagactggtccttcagcagaaactgagccgactgccaaggaccacccgggtaataatcaaccggcgaccgacaatgtagataccagcaacgagcccccgactggaaattagtcggccgaagctgaagtcggcactgatcaggagcccccaactagaaactagtcgggtactgaacaaactagagatatcccagaagtagaagctcaagccaacagccctcccaagacgaacgctggcgctgaccctggaaccaactctcctgttaaggtgcaaggacctgcacgtccccgtccggaaattattacaggtaaacaagtcctccaaatctttccttgatccgacaaactttcttaaattgctttaccattattttgatccgacaaacttttttcaattgctttaccattattcatgaatgtataaggaccaatgatcggtgatgaagaagaggttcttcggatacaatcggctgaagattctcgcccaccaatattagtcaagtggtgggatgatgaaatacgatcacagggaattgtaataaataaacaaaaggaagacgaggaagtatgcctgctgaaaaagacactcggccaagctactcatcttgtaaatgtaagtctctttacacatagcttcaatcatcctgtcggccactttactgaataaagacgcacttgtaatgcagagaatccatcttaggaatgaggcaaatactgcaaccctcgagaaattggttccctaccttggaaccctggaagcaaccagagatcaactgtgtgaagcgaaggagcttgccaggaagactgagcatgaccttagggactggatcgccgagctccaggactccaactttgagctaagtggttcatcaaaacgtaactctcatccttatctgatttgtttcatgctgctattcatgtgcgactaaccagtggaaagcaatatagtgcaagctgccaagatatccgagctagaaaggcgaatccaggctctggagaaagacaaggtcgaacgggcaaaacagagggactcggctctgaaagacgtcgaaggtacttgtagctgaaacttcaaaaaccactctcatcttcatgcccagtcgttgatgtgaatttatttgtacagatcgcaaaatcaaatcccaggctcaattcgacgtcttggttaacaaaatcaagaagcttgaaggagccagagatgaaatcgccaatgccgctacgccactcgtccaggccatgtttttcaataacaatggtccgagttcaattgatgctgccaaaatcttcaacaagctgagaactgctccggatacatattttatgaacatcaaagaagctggaagtatgggggcgagtctagcgttggcgatgaccaagtccttgtacccgaagattgatattgatgccgttgatggcttcgcagacgggacaagtgaggaaaccgcccttgacctcatcagtgatgcgcaaaaagctgctgacaaaatagccgctgatgtagttgagaggttccgggacaacgatcttaagccgactaggtctgataactctgatgatgaaaaaactgaatctgattgattgtgtattctgatgataatgatgatgataatggaggcacaatttgtacaatactgatgaatttatgctgtgcttgatgatttaatctcagctccagatttcttaaaagtttttgtcaaaccttattgagcctagaacccgaagttgttaaaaactttcagtcctcattggctaagctaaaaaatcaaacaaggcaatgataaatcaagtaagcaaattgaattgataaaaatcacactccattattattatagtagcccccgactgataactgaaggaaaaacttgatgttagcagtcaaagaggaagatacaaaaagtaatgcctaagcataaaaacgacgaagatgttcgatattccaagagttgtcgatttgagtactgtcttcatgcttgagtcgataagaacatggctgagtaacttcagaaactatgaacggtccttcccacaagggagataacttgtgccgatctcgtgtagcctgaattttcctcagaaccaagtcaccgactaagaaagctcatgatcgaacattgcgattgtgataacgacgcatcccttgtaaataccgagccgactgaattagcgatgcttcacgggcttcttctagtcggttgagatcatctactcggtcttctccatagcactcctcgctgaaattacgaaatcgcaaagattcgaattctacctcacttggcaacattgcttccgcaccatatactagaaagaatggtgactgtcgcgtagcccgactgggtgtggtgcgcagggaccaaaggacggatggcaactgttctacccatttgccaacatagggatgcagttggtcaaaaacttgtgcttttatcccttgaagtaccataccattggcacgttcaacttgtccattgctcatggggtgcgctacggaggcataacaaattttgatgccgaagtcctcgcaaaaatctttaaatactccgccagtgaattgagtgccgttattagttattatccgattgggtaccgaaaaacggtgcacaatgttgataaaaaaatctctagccttgtttgccgtgattgtgacgaccggtttggcttcgatccacttggaaaatttgtcaacagctacaaagagatgagtataaccaccgatagcctttttgtacgggccaaccatgtcgagcccccaaaccgcgaacagccaagataacgggatggtttgcaactcctgagccggtagatgagtttgtcgagcgaaaaattgacaacattcacatgttcgcacaattttgtccgcgtcagatacagctgttggccagaagaaaccttgccgataagccttgccaacgatgggtcgtgcggcagcgtaattgccacagatgcctgaatgtatatctcttagcaattgtcttccctcctccaaagacacacaacgttgcagaatccctgatggacttttcttgtacagctcggtctcatgtatgacataaagtttgctgcgcctggacatccgctcggcttcatctttatcttgagggagctcttgtttagtcaaaaatctaatgaggggctctctccagtcggcttcaatcatgcctacttcttgagtgtccgtggcctcgattatttatttccttggtatggttggctcataaagatattcaacaaacacgtcggaaggagctgcttctcattttgaaccaaaattagccagtctgtcggctggctcattattatgtcgaaggacatgggttagctcaaggccatcaaatttatcttctaacttgcgtacctcctgacgataggcggtcatgttatcatcaaggcaggaccactctttcatgacttgattaacaatcaactgagaatctccacgaactatcagacgccgaattcccaaggagatcgcaatccttaatccgtgaagtagtgcctcatattccgccacgttatgggacgcagaaaaatgtatccataatacgtagttcaacctctctccagtcatggagattagaacaacccccgctccggtgcctgaaagcctctttgacccgtcaaaatgcatagtccaatactccatcttctctgtaggcgtgtcttcttggcactcggtccacttggcgatgaagtctgctaaagcttgggacttgatcgaagttcgcggcttgaaggatagatccaaagacatcaactctaaggcccactttgcgatccgcccatttgcttcgcgggtgtgaagtatatccccgaaccgagtgaccttgaaaatagtgggataatttcctaacggtaatcaaaacaccatacaataacttttgaacctgaggatatcttatcttgaagtcggccaaaacctcgctgacgaaatagattggtcgttggactttttgaacatggccttcttcctcacgctcgacaaccaggactgtgctcacaacctgggaagtcgctgacacgtataacaacaacggctcttgcggatctggtgaagctaagactggtggagtagtgagaagtttgttgaagtcttcaaaggctttttgtgcttcgggtcccctctggaagttgtcggttttctttaacaacttgaaaaagggcttcccccgctcgccaagtcgtgagacaaaccgactgagcgccgccatgcatctagttaacttttgaacatctttctaggaactcgacagtttcatgttgaggatggcgttgattttctccgggttggcttgtatgcctctatgggacaccataaagccaagcagcttccctgacgatactccgaagatgcacttttcagggtttaatttcatcctgaaagcacggatgcccgcaaaggtctcttctagatccgtaatcaaatcatccttctgcttggtcttgacaactacatcatcaacataagcttcaacgttgcgaccaatctgagttgaaaagcatctctggatcatgcgttgataagttgctcctgcattctttaatccaaaaggcatggtgatgtagcagtaggccccgaagggcgtgatgaacgaagtctttaaacagtcggactcctttagtcggatctgatgatatcctgtgtagcaatccaaaaaactgagtaactcgcagccggccgttgaattaactacctggtcaatgcgaggtaccccgaagggatctttgggacaagatttattgaggttggtgtaatcaacacacatgcgccattgccccgtcttcttccaaaccaggactgggttggccagccagtcgggatgtaggacttccttgatgaagcctgctgctaacagcttggtcaattcctccttgatcgcatctttcctatcctgtgagaaacggcggagtcgttgcttgataggtttagcatcttccttaacatgtaaagagtgcttcacctctctaggaatacgaggcatatcagatggtttccacgcaaagatatctttattattttgaagaaaggtgatgagcgcgctttcctatttataatctaactcagcgcctattacagcagtcttagtagggtcaaagggatctaggggaatcttcttggtcttggcgtcgccttctccgccctttgacatcttggtcgtaggcacttctccttcggttgctgtggacgcagccagtcggatttcttctcgagcgagtgtgatctcgcgggtttgggctatctcacagctttccttgttgcaagtgacagcttgcttgatgtcgctccgcagggatatgactcctctgggacctggcatcttcatcatcatgtaggtgtagtgcgggacagtcatgaacttggctaatgccgggcgtccgagtatggtatggtacgctgtctcaaaatcagcaacttcgaagcaaatattctctgtgcgaaagttctcccgagtgccaaaagtaaccggtagagtgatctggccgagtggagtagaagacagcctggggatgactccgtgaatgggcgcattacttggcttcaattccgtgcgagggatttgcatgttgtccagagtcttggtgaaaaggatgttgagtgcgctgccaccattgatgagggatcttcggagctagacactgcgaaccactgggtctagtaccagggggcaccgccccgggtggaccactcggtcagggtgatccgagcggtcaaacttgatagttgtttctgaccaccgaagatattggggcgtgtcgggctgaacagcattgatctcccgttcagtcaccttttgctttcgcttggattcataagccagggttctgccaaagatgtggttgagttccttgcgatgatcttgaaaaccagtcggggcatcatcttcatcatccttcttctttgtcgtgctttaatctccgtcagtcgtcttgcgtgcgttcttggcgtattgctctgcgaactgtttatagacaaagcagtctttggctgcgtggttggaatttggaggatgcggacattgagagttcatgatcttgtcgaaagtgttgacgcgcgaatgttgtcgggaggatggtgtagtggttgccacaagttcctcaggtttacgcttgcgatccttgtgattggtacttccactccctcctgtggtcagtgtatctttcttcggcttccaagtagtgcccgactgcttggatacggtgacagcatcttcagcttttgcgtactcattggctttctcgaacatctgcttgactgtcctgggaggcttgcgtccaaacttgccgactaagagatcgtggcgaatgcccttggtgaaggcggtgatgatgacgtcgtcggtgatatcggagatcttgttgcgttgctcagaaaaacatcgaatgtaatctcgaagggattctccggacttctggacaacgttgtaaagatcgaactgggtgccagggcgttcaaaggtgccttggaaattggcgatgaagtggtcgcgaagttccgcccaagatccgatcatgccacggggtagcccgtgaagccaggaccgggcagaatccgctagggctacgagcagatagtttgccatagctttgctgtctcctcctgctgcgcgaattgcgagactgtagacggtaagccaagactcaggattagtggtgccgtcatacttctcgattccagtcggcttgaagccggctgcccaatccactcgatgcaggtcacttgtgaaggtagcaactccatccacgccgtcgtcgtaacgatctggtgaatggtgggggttgtagcctcttgccgcgcggcgctggttgatagtttcgcaaagatcgatgggatgcctgcgatatggggagcggggacgttcagctcgacgctccctgtgtcggtcaggaggcgagtgaacggatcgctcgtcgtgatccctgctcctgcgactggttccggcgtcgacgacgctgaggctcggttggtgatagtctcgagatcgaagaggaggaactcggctgccagtcggcgtgcggacgcttgcggagttaatcgggaccgaagctgcgatcatggtcttggtctggttcaagatgttgacgacgtgattggcctgattgagtgcgtcttccttgaggagggtgtcgaggagggtgatcgctgcaaccgcgttctgctgaggagtgcgaaaaaccgtcgtcccctcgacgtcttgctgcccgatgagttcccgtgctcgccgcccggcctccaaggcgcgctttcgccggtcctcggcctcctttgtagccgctcgcgctcctgttgctcacgctgcagccgtctcgctcttgtgcttgacgctcctcctctagtcggcgacgttcggcttcttgtcgcacgcgctgttcttctacttcttgggcttgacgcttttcttccgtctcgttgtcggccatgaaaatgccgaagtagaggggcatgtagttatcttcaaagccttcggcgaagttgtcgaggttgcggtagtcgtagtggtagccgaagtcatcgtgctctacgatctcgattggtcgtgagtcgacaccgggggagctgaggtagccgtccaattgttccgtcgaaaccgtgccgagaggttggagtatgacgccgacttccctggagctagacaggatcggggccggggccggatcccgcctagacctacggggagaggacgcccttgtggtgaagacggtagccaagtcatcggggagtttcattagaattggcggataggctccatcgtcttgatcgggtcgtgttggagtagattagatctcgtccgagtggtttggggccaactcgactgagatgatcttggtgtagatctcggccgagttcgggatactgaacggggcagagacctggcctcttcctgactggttcgattccgagtcgaggagagaaatcctgccgatgtcgttggtgatgaagtcgaggctgccgaactggaacgcctgctcgggagggaagacgaagtcgtcgatgccggagacgaaacccatcgcactagtcggcgaagaacttgacgctgcccctacctggcgcgccaactgtcgaaacaagttttcggcaatactaaaaggggtggctatcaagctggaaaagtggatgggttgagagataaggaattttatacaggttcaggccttcttaatcaagaagtaataccctactcctatccggggattgatccgccgagtgtattattgatcgtatgatctgggagaaaaacgtgccccaagaggcacccggaccccttcttatataggggaagggatccgtattacaaaatacagtctatatccctaacgtaataggtatttacagataagattcaatcgtaaccgactagaatcccgggtatttctttgacatataagtttggaatttaacccaagcccctttaaagatattctatctatacatggcaccccatacccagttgtactatacatgccgtgtaggtatgaggtatacataatctccacacctctttcccttctctccaaccagcccaaacctcaagtacggtcgtacattacttacgtttcctccttctaatcctcctctctcctttctatataatcgaaagtttacaagtttaccttcgtaccattgaaagttcgggggtaaactttaataccattgaaaattttccaccgttactttttctaccactgccggttacttctgtctagattttctcatttctatttcattttccctcgaaaaggccgaataaaatgagtgtctacccttctttcacattgcagttccctgggacacgatctttttctcgttctttccatcggcccatttgtggaattggaaacggattgattttgctcgttgtttcgatcagcccgatcgatctttgcgtacgttcagatgggagaaaatcgtggctagctggagcctggagcgaggtcgttccgtcgttgcatgtcgacctcgtcgtcatggtcatcggcggacggcgggggacaagctgctactggatagtgttgccggagcggcggcggcacgtcgagcccgttctcatctgaggggattggagtggaggacctgctaatagatcatgttgccggtgctgacgacgctgaggctcggttggtgatagtctcgagatcgaagaggaggaactcggctgccagtcggcgtgcggacgcttgcggagttaatcgggaccgaagctgcgatcatggtcttggtctggttcaagatgttgacgacgtgattggcctgattgagtgcgtcttccttgaggagg

SEQ ID NO: 70045 - DNA, 3778 bp, Oryza sativa
aaaattacgttaaaagcatttcaaaatcaacttcaaaatcaagttcaaaaattcaaattttggcttattctttggctgtttaggccaaacgatggggctatctgataagatcaattttttttcaaaaaatatcttcagattattggatagagaataatataccgattctgttggactgttggtgatgctctgaatccccgccccgagtcctccttgactatccaaaagcaccgcccgccgccgtcgccgcgacgccgcctagaaaaaatggacgcgctcgtggtgcggcggctcggggaccccacgctggcccccggcggcgaggcctccccgttcgcgccggtcaccggggaccacccggcgccggcgctcgcgtcgccgacgtccgtgcgggtgcgcgtggcggccaccagcctcaacttcgccacctacctgcaggtacagggcaagtaccaggagcgccccgcgctaccgttcgtcccgggctccgactacgcggggttcgtcgacgccgtcggccccgccgtgcggaggttccgccccggggaccgcgtctgcggcctcgccgccgtcggctccttcgcggatctcatcgtcgccgacgagaagcagctgtgagttcggtttttcgcctctcgctgcctcgtatggtgatctccgtttggaagattagcttactccaagtggctctctctttggaaatccccatttttgggttaatttatcagtacatgccttaattagtgggatacagcatcacgagttatatttggttttctctttcaattgtcggatgcattttcttgtatgtagtcgattagttgttgaagcatttctacatcggcttatatctgttcgctcttctcatgtccgatcgtagagttaaactttctgctagttcggtaggtgctatgcagattttatagcttatgagaagggttgtttgcttttgggagtaaatgtttctttttaaaaactatttattctatgatatgtctaaatatggggatgtgggagtgggagagactatgctggttttcgatgaaaaagatgagaatgttgctgtctgtctctctatagatagttaagccttgatcccctaataaagaggtggaatctttcaattgtcgggatgccttaaaaaaggcgatgttaatgttgtagtgaggactggattgtattttgttttgttatttcagcttgatttcactagcaaacaaagcgcacagtatgtctcctgtttgtttatcttagcaatatgcaatgtataaatcaactaatacaatagctgcacttgtggtggttgcagttgcagagtaaaacagttagcactgttgtgaaataaaataaaggaagcaaatgttggttagatacttgtatatatgtgaatttctgaatttttgtatatgaggggctatctgtagttaccagaatttttttgtaagtataacatgcattttaaatcgttggatcagaatcataatcagacaggcgcacatctcaaagctaatgctttgtgcaggtctgcaggaaaaaaatgaattgtacttggccaataatcagggaacttacacaatagagaaacatcttatttattctggtatgttctattgaatcagtgctatgttctttcgaatcagattttcggtgcctgatggatgtgaccttgttgctgctggagcattgcctgttgcatttggtacatcgcatttggcccttgtacacagagctgaactaaaggctggccaggtgcacccctgtgttaatctctttgtttataaaatgcctataagatatccatttggtacttgtgcattgttcatgttattgttatggacattcatcatggatacggcacaaatctcctttggaatggccatccacattctcggagcactgcattgagtaaatcagcatctctctgctgctgctccacatctctatatccataattactgttagtgtgttaagttatgtggcagtggcatcagtgtcttaccttcgtttgtgacatatcatgtacacacaatattatgagctagaccgcattacctcaaatggctcattttgatggccattattggtcaaacataggccttgtattttatatttatgaaatttattatgtcaattttctatataacttaaattctacagtttctatcatagaggtgaacttctgcaacagtacccaaacatccacaccgttctgataaggtcaaaatgttatggatgcttattcgtggataaggaagggtccacagattgggataaaggtccacagataggataccacttaactattccctatccttgaaaactaaaatcatctaggggcatatttctaatgctacagtgtacaggcactgttcatctgcagtaccgttaccatagcaccattttgttggtgtctccaattaaaacccttccatttaggacccaccatctgatgatctgatacaggggttttgattattttattctcacattaatgaaatctgtcagtactgttctgttttttaatggtactgtagcagtaggactagggaagcatttgccttccaaaataagaatatctatactatattgattaattaattagcttcctggcatagagaataattgtttgtatcctatctatttgagatatggtttattccgaaggtcaggattctaagcttgtttggttggtgacctgggcgtcatgcctgagaaaaatatgtgcctgagtgttgcatgaggtgggagtggttcatgcctgagagaaacttgtttggttggtgacctgtgcctgagaacacttaaaactaatattatctggcatttttctctttttaagcttggagtttaatcataaatccaatatagatacttaagagatttaacaaatatttttttttacatagtctcataacatatctttagctaatcaagtggagagcagttcagcacgtttgccaatcacaagatagtgcatgcaaaagaaagcaaccagctgcagcgtgagagaattactttaattcagcagttagtagagaagtacttcggctaatcaagtggcctggctctgcatgcaactgaggtcaccaaatttggtctcctgactcaggttggttgagctgccggagagcccaggcctggaaaggtatggagcgcaggagtggctcaggcactaaccaaacaaggtgtattttttctcaggcttgtctctggctaggcagatttgtctcagggtggcaaccaaacagcctaaggctgtgtttggcaccgcatgttcccaactcctctcccttctattccgcgcgcacgcttttcaaactgctaaacggtgcatttttggcaaaaactttttataggaaagttgcttaaaaaaatcatattgatccatttttgaaaaaaaaaagctaaatacttaattaatcatgtgctaatataccgctccgttttccatgcacaggagattggttcccatctcttccaaacgaattcagcctaaatcttctaatgggtgaagttactattcactcaaacctgttcagtaatataccaaatcatccctatgaaagggatgcatgcacctctattatgattaagcaataagaagaaataagttaggtctagtttgatcagaaattcagaatccctcagcaatccagcttggcaccaatgagtgcgatcccatctttgtgcaggtcttcattctccatcggtaaatcaatgtccattacagtttcccttctttgattaagagtcagctaccaaagctcctagtaacgat

SEQ ID NO: 70046 - DNA, 2814 bp, Oryza sativa
cgtcgaagtcgtcgaggtcgcagctgtcgtagcggtagccgaattcgtcgtactccacgatctctgttggtcgtgagtcgatgccgggggagctgaggtagccttccagttgatccgtcgaaatcgtgccgagtggctggagtatgatgccgacttccctggagctaggcatgatcggtgttgaagccaacttccgcctaggcctacggggagaagacgcccttgtagtgaagactgcagccaaatcgtcggggagtttcatcatgattggcgggtaggccccatcatcttgatctggtggtgtcggagtagatgggatctcgtccaagtggtttgaagccgactcgagcgagataagcttggagtagatcttggccgagttcggaataccgaacggggctgagacctggttctttcccgactggtttggatctgagtcgaggagagagatcttaccgaagtcgttggtgatgaagttgaggctgccgaaccgaaacgcctgcccgggagggaagacgaagttgtcgatgccggagacggaacccatcgcactgatcggcgagaaacttgacgcaacccctacctggcgcgccaactgtcaaaacaagatttcggcaatacttaaagggggtggctatcaagctagaaaagtggatgggtttgaagataaggaattttatacaggttcaggccttcttattcaagaagtaataccctactcctgtccggggatgattccgccgagtgtattattgatcgtatgatctggggaaaaaaggtcgtcccgagaggagcccggacccctccttatataggggaaggggtccgtattacaaaatacagtccatatccctaatggaatatgtgattacagataaaatataatcgtaaccgactaggatctcgggtattttcttgacatataagttagaaactaacccgagtcctcataaagatattctatctatatctagtaccatgtatccaactaaactataactgccgtctagatatggaatatccataatccccacatgtagcaagcgacagcgcggcgatgcccgacgcagcccctcgtgcggagccgagatggaggtgtggatgtgtagcgtggacggcagccagggagaagtggaggcaagccgcaagcaggccgaggtcggcggcgcggcgtggcgcgaaggaggcaggcggcgccacggcggcgcgtcgcacgtggcgcgaaggaggcaggcggcggcgcgacgcggaggaagggctggcccctccggtggccgggacgaggtcccgtgcgagtcgaggctggggagcatgtgccgtcgtcgtcgaggagttgccgagttgaggataactgaataagatcgagactcccctttttcctttcttttgttcacccggacatgtggtggggaactggagattagtcatgtgggcccaatcgaaatggacggtgggctactagggcagccaatgggctggaggcctggagcaacatggaagttgatactttcggtcttcggtttcttcaatttgtagccggtactgagagcaagtacagtaagtcacctataacgatatatcaagaagaaaaaaagaaagagaagtaagtgggctataaatttaattgccagtaacaacacggacttcaacacgttgtatgtatgaggtgggaccggatattaattgtgtaggatatttgtgtaaataactattgtatgaataggctattagattagttatagatgatttggagctaacatttggctatactattaaacttgctctaaccgaaccggtctctcccatcgtgcaaccgagcaaacgaccgaagaccgctactttggttttttcggtttcggtgtcgattttttaggtacggtattcggttctcggtttttatgctcacccctaatcgtacgtacgctaaccgctgctagagcatcaccaacacatcttaaaattttattcccaaatttttagttatggggatgcaaaaacataatttgaggtgttaaaaattttctcactccaagagattaggtaaaattggtttcctaaaaattaaaagggtgggccacgataaaacctccacgaaaaaaaatatgttttgcgctccttcctcccgtcagatcacgtgtgcatctcttccccgcacgtgaagcgccgtgattaggagccaaaacaagacaacacatggatatattccgacgaaaaaaaaatttagcttattatttaattttttttaaatgttgcacgatgttacaccaggtatatcgaaattgtttcactaagtagatcgaaaatgtttcactcgtttaaatcaggtgttgtttcaccttataaaaaaacaatgtttcagcaaatagcgaaagaatgtttcagttcactgcaacatttgatccatacatagtgaaacattgtgtacactaggtgaaacattttttttgtggaacaaaaaataaaccaaattcccttaatagggggtttccaaaatatgtgagttttttttttgcaatggaatatttcgttcactacaacattagatttatacatagtgaaacattgtgagtacactaggtgtaacatttttatggaacaaaaaataaaccaaattcccttaatagagagtttccaaaatatgtgagtttttttgttgcaaaagaatattttaattcactgcaacattagaaatagtgaaacattataagtaaattaggtgaaacatcttttgtagaaaaatgagagaggaaagtgggtgggccgaggtacacacgtggggatggttgtggaaaaatgggagagggtagtaggtgg

SEQ ID NO: 70047 - DNA, 17048 bp, Oryza sativa
acaaaaaggtcctcgcagcctgtgctacaatgaaacaaataagggataactgatgtgcagcctaccttaactgacatgcgacatctgtctgtttaaaaggggcgaaacagaataggatactaaattcaagaatcacatgaacgagaacaaatattatctacgaagaaatatccagaatgacctttcatcaatgtacacttagcctacaaaaaatgcccagcaatttgaaggcttggtaacctaatcagcataatgacactgacagaaaataaggaaaggaaatcttttttcacaagcacatgcaacacagacacagatagacacacatagagatattcatagtgggtcaatgatcctaacttttctcctaaattaagttaatcatcacatttcaacaggacatgtgatgccaaccaaaatcgtacatgatgaaatagtggggagccacttccactttatcattaaacacatgttttcgctgctgcagccatagtttgcaactttgcaagaaattgagtgattcgggttatacaggggtgtgttgacgcaaaattgtctagtggtttcatatcaacatgttgccaggtgaaaaaagcactacagcttatttaggcaaaatgagagcaagatccaggaagaaatatcctcaaaaacaaacaaacattgagcatcgagctaagtaaacatgtaagttgctcccacatagattaaactcacttgcagagctccgaaagaaccaagttcttgcaaacagaaaataatattttcatgcaacctccataaggacttcagtttcttctgagaatccttgaaatcgcataggctcgctcttagcatgcgctcgctctgtattaagcccaataaaaataatgagaagggaaaaaaggaaacagaacacataaggttttgtcaattggagtaatgacaatttcagcataatggtggaacaaaactttacctgaagctttaagctatcaagctctttgatgcatattgtggtaaggttagagtgattaactgggccataaaagtacacctccatatcaggagatgcaaccacactttcaagttcttcattatcaactgaacaaacctatccaacatgagagtgaaaagttttacagagaagaatatcactgagtaatttcccccaatccctagaaatcttgccatgagcaccagcaatatgtacctttgcatgaagtaattcctcaagactgttgatacatttcgtgtagttaagtttattagacccacctgccatataaaacatatgtacattaatcgaccagacatgcttaatataaaagataatcgaagcaaccaaaaataattttagggtaagactacttctattcttagcggtccaaaaggcaaggctgaaaaagagaaaaaccccaaaattaactctaaaattaagttctaaaaggaattcaacgggccaacctaatttattaagattggagcagaagaaaactcaaaggtgctcaacaacagggttgttgaaggtacatatgctacaattacaaccgcaggcaggcgaccacacatttagcactaggtagccacagaacaacagaaagctctacactccagcatcaggagggtcaaggaacttctagaattcaaatgctggctgaggcttataaaccaacgcgcagctaatatttcaaagtgttacataagttactccagcaaacatttttttgagccctgaccataacattttagcattaaatttcaaaagatatctcaggtaatcatgttttaacttataatgtactaatggtgtaaatcacaaacatttgttcataactcatccagctttgaccttttggaagaaaaaatattagaggctgacaaggagaccttcctcctttttctgtaaagctgtgtgaaggcatgacacctgggatggtgaagatggttacagaagcacccacgcaaacatgacatgcacatgagttgaatactcaatatatgcagaatttcaatgcgtaaagcaaaacttcagtgcgtcaagaatttattttatgtgtttttggtccaattttcctctttgctttggtactatgaggcttcaagtgcaatttctgaccaactgtagtggagcagagacattttatatttgagcacatttccgttcggtttttagaactaggagttgatataatgataaatactctttgatcccaatttcttgttcaattatgagtttcagaaaacctttggtgtttctcttccaatggatcatattttttttcaaccactgacaacataaagatttaaggatttaaaatgatcccaaaaaatttagtggcatttaccctgtgttgtaaatttaaaagcataccaagaaatagaatagtatccaagaattgattgtatgtaatgaggcaaggttatgtcctaactcttagataaataaagaagataatatacgtcaggagcatattgactgtacaaaatgcattacagaagaaaagtggtatgcagtactggtagaaagaatcattacctttcccaataattggtgaagcagtcatgccaaaaacccgagggaatttctcaacactgttactattatagaattcctgaaacattgtcataaatatttttaatccagaaaaattgcagttcattgaattaactacaggtactatttaatataagaagctgtcctacaatcctataggtttacttatgtatgaacaatttgctcacctattgatacaacaggagcaacaagcaactggacccaaaagcctactcctaccatgtggatatagtttataagaaacaatttaaatgaaaagagtatcaatgatgtactgcagcatgaggtttaatgggttaaaaactaaacaactaagtattccaatagatgtagattaccaagaattcaaaagttgtaataaagcaagaaaatcatgaacttgccttcataatttgcgcatatggatgccgtttttgcggttgtgcatgatggcactcatcaagtatcagaagtgcaattgagttcatcttgatgaagcaatgacgcaaactttgcaataatatttggggagtcattacaaggacctgacgtggcagaggaagtacaaaagttacgcaaagaactaatgtacagagtagaagaaaagatgaattcaaatggattatatttgaaaaaaatgaatacaataatgatatatgtgctgtctacatgttctcggagtcagacctctagtttcagaataaattaggcaggattaagcaggaccttttagctgaagattcttctccatcgtgtgcatcttaaattagtttatgataagtcaactagttatctacaaagcttctctttcgtttacaaatacttttcatgctggaataataatttgactggtctgcagaggtaatgtactgcaaagtgtacctcaaactccctcatgtcgttctcccattcctgatgatctctcgagtttttaccattcccataataacattgaactttgaaatcggtggaacttgcgatcaccacagcttgctgtataatataataaagaatacttacttttttagtgagcaagagcacagattaaccatggtttttcttttttgataatacactgattaaccatgtaaagttttatttgattctgaaaggtggagctataaccattcataagcaaattgagatgcacacttctagtgagaaattaagaacccatgttcccaattcaaatcggttaccctgacatattgcaaattggaaacttaatggtaacaaatgattgggagcagctgcaagttgatgtaaacctacagtgcggaccaggaaaggaggatatctacctggcgtacaagggggatggttggggcaaggaagatgcagacctcgcggcttggcttgcggatgagatgaccaagctcataaatcagcagcacggcaatgtgcgtcttaccgcatcctgtcccaaggtacactatgatgttctcctccacagccctcttgcagagatccaattgatacctaaatacacaaaattaaaacaatcttcaatgctattctataaattacgccctcacaaaaaaaaacataaattacacatagttgaacaaagcggaggaatggattaaaaaagctaaagaaatgcaacaaaacaagatagttcgccaggtgctgcaccattctgaactcgatgaaagggtgccgtgtcctgccagagtatgggtgcaagggagctaaaatgggtgcaaatgccacagaatcttttctcttctctttttttttttttgacaaagagaggcagatctctcccgcttccattgcagaaacgaggcaaatggcacacaatctggtataataaagggaatgtagttcatttatgcatggagatgatattactactacagattatctggcacactgcattgccaccgagtaacggcgcagtctacataaacacaggctttgaatgcgcatcaacagccatcaatatgtgaagagtagtaccaattattagcagatatgcaaccgcttcccctgagaaagcatctgacagtatcgaatcgtaggcaataaaaacggggattgctttgcaaattacgagtagtaaaaccttaaaattaactaatagaaaaacattttacggactcactgtctccttaagattgatccgctgacctatgcttgaatcagatcggtctaccagacagcagagaatagagcatgaaaatgctccacacaaaaaaaaaaacgctccataaaacccacctaaaacctcccaatactcccgagtaacaaaaaccacgaatcaatcacgaaacgcgaaggtatcgtcgtttcgagggaacaaacagcagcgatttcacttcgtcccacccaccaccatccacgacgcatcaaaaatcccccacaaaataaccaaaaaaaaaaactaacgaggaagacgcggacgcggtagtagtaggaggaggaggaggacgggcggtactcacttgcgcgcgatcgtcctcggatccttcggctccccccgcgtgctgctcggccccgccgccgcggctgccggggcggcggcggcggcgtcgcccatggctggcggcggaagcttcgagccgaagcaacccgcttccccttccccctcccgaagtcaccccccacacacttgggcgctggacacgagacgtaactgtgctccgcgaccgccgctgcggcggaaagcgtgggagggagagagcaagggaggaggggggcccgtggccgaggaggagaggggaagaggaggaagagcgtgcgccgttgcgtgcgtaaaagagcatgtataataacaggctatagcatgtacaatagctgggctattagctagctactaaatgtaattcattctagcatttttcacatttatattaatattaataaatctagacatatatatctatctagatttattaacatcaatataaatatgggaaatactggatgacttacattgtaaaacggagggagtataaacatattttaataagataaaagatgagagagaaaagcagcaggctacagatctatagccagctgcagcacggagtctaagacgtaatgtgtgtataacaggtgggaccggctacagatatgtagctagctgcagtacagactctaagacgtaatgtgtgtataacatgtgggaccaggtattaatagtatagtaagcaactattgtatgaattggctattacattgtctatagatgatttgaagttagtagtgagattagagcaggtacaatagcagactattagccagctacaaatatattttaatgagataaaagataagggagaagagcagcgggctacagatatgtagtcagctacagcacggactccaagacgcaatatgtatatgacaatgggaccatatactaatagtatagtaagcaactattgtataaattggctattagattagttataaataaattggagctagtaattggctatattattaacctttgctcttatcaatcaattaaacttgctctaaacgaggcaagcgaagcgaggagcgggtcgagtcgcgtcaggagtcaggacggcgtttgtttccggcgcacgagagcggcggcagcgttgggagagtcggagagagagagagagggggacccacctggcgtcactgcagaggtggggcccactcgtgcggtagggggacggactgtcctctcctccgggcttttggtctggtcgttttcgtctatactgtgcgcgagcggagcgtgtggtgcggtttgggttgggacttggggtacgacgaggtgacgaagtattgagagatgactctagccggtgtagtactgctggtgtgtggcgtgtgtggcgacgaggaatctgagcccgcgtgggcgtcatcagtgtgcacgacgtgccttgggcagttgggctcggtggatgggagcgcggtaagaactgcaacgtgtacccagcgtggttttcccaggtgttacatacaccgtctgtaaaaaaaattaatttgaacatgaacttgtccatgcgtattgcttagaattggatttttttttccggatagagtataggtcggtatgtgggccgtaaattccaatacttgtttggtttacatctaatctcatctaaattatacgtctttcatttggtttataaaaatactcctttgatagctagccagacaagaggatagccaaattttcccaaaaaaaaagagtagcaacaaccaacttcatatcactctgagaaagagatggttgcaccacgtgatataccagtgcattttatataataaacaaatgtaatggtataatgagatgattggttaccgaataggaaaaggtagcatatctcgttttcaccataggtcgaggacaacggtggtggtagtcacacataggttggctacaaatcaagagacttctatttataatggttgtaaaccatagtacacaaaattatcagatgagttggaacttgtaaaacgtaaggcaagcaatggatggttaatagaggttttattgaactacttgatttgttgacgggtctatttctaggggaacacactaccaaagacaacttatgaagaaaaaaatgtatcatgtccactgaggctagggtacagagaattcacgcatacccaattgactgtatattgtaatacaaggataatgtcggcttagaagcatgtccttcgtgcaaagctacttgatacgagagaaaaggtactagcatagaagacaagaatgaattcgaagaagagtgtctaacaaatcttttatactatttgcctataaaaattcatttgaggccatcatatatgggccggtatgtgctagtgtcataagtttacattacatcaacaagaactcagcaacaactaaccaatgaacaatgatatagtggtaggttatttttgtaattcctacgttggtggcatgtatcatcttgtaaataacatgtactcaataagttactattactcttacttctgttgtgtacacaaataatagtgtggttgggttaaaccaaatattggctaaattacatgcattggatccagggtgaatcaaatggcttggtgatcagcccgagcaaccactcggctcgtaagtaatgacactatgatgacatatattttcagtgttcaataatatctatcattgtccgcgcatgtatatgtctagcatatctaaattcctctacctttttagataatggatataaaacccgatatttgcttcaattgaagctacaaccacttattacaaagttattggcacgaagcctaaacacactagaaataacacaatggtagatgaaaagacgacacaaccacaccaaccaaaggaaaatagcttatcaaagttcataaattcctccactggtagggataaggcgcactcaacctagcgattttcctttgataacctagttcataaatatatctaaaaactaaaagaaataaaaacaatttaagagatgttcaacactataacatctaccacgacaaaaaaaaagatactcaatatactatgtatgtagggagggaaaaaaaagataaatctcaggtgaataataaggtgatatgtttgaacactacgtactagagcacaattttttttcttgtatatgaatccggacatctaaactaggcataaatccaagccgccccttaatttgctgcgaccaacccgtggcagcaagaaaacctcgctcctcgctcagtaatcgcctcatcgatcgggctagtccgttcgacgacgggtgtgtacgtgggtgcaataaagaacaagaaaatcgcgcacagattccttccctcccttgccctccataccagaagctctctctgatcccacccccaaagtgcgcttggagcctctccacctccaggtgacgctactggctgcgcgtccctttttgtttctctttctcctagcaacaagctatagatcacctagctagtgatgccccagccttttaactagcttcggactcgatcgtatagtagctgcgagctcgtcggacagtacagcctcgatcatggggacgacgtcgagtccggacaccatggcggcggcggccggccccagcctgtccatcaccgtcgagaagaacccgccggaggcgcgcttgcttcagctcggcatcaagtcgtggcccaagtatgtacatgcataagcctggctcttccttaattaatctcctcgttatttggttgttaatttccatccggtgtgatttgatttgtaaaactaagttagtttaattttggatgtgattggttatataagatgggggtgtccgccggggaagttcccgctcaagttcgacgcgaggctgacgtgctacctcctcaagggcagggtgagggcctccgtgaagggcaccgggaggtgcgtcgagttcggcgccggcgacctcgtcgtcttccccaagggcctcagctgcacatgggacgtcgtcgtcggcatcgacaagcactacaacttcgactcctagtcagttaaacaccaagctagacatgcatgcatcattcatgcttcgctcgatcgtctcttcttaattaatttgtagcgttacatctttgttaatcatctcctcacttcacagtttagtgacacgctaagcttgcagcaagtgttttgttcttggcaaagtcggtaaatactaaatacctccatttgtgtatgatttttatgctcttttcttttgtaaaatacgacgatgccacatggtgatctagctaggtagcaagattttgtgtcagccgttattagttttcagaactcacatgagtggaaacaaacaaaaattcactggctgctaagttcagaagccctcacatgccatctgttaacgaatatcaaaactgcaaagatgtttttggatgctttatttgaccgtcacggctctcatcaatcatcatcgtcataggaccaaaaagcaattaagcaaagcagcagcactgtctctagttcagtgcacctgtgaggttcctgcactagcaagctttgagcttaatgatgatcattggccgtttttaccggctgcttttggcgatgcgcctctcttttttttccacctccttttgattcagtggtctcgaacccagctttggaccgggcggccgggtggtgactggtgagtgcaccgggcggaaatgcgcgtgcaatgttgctgtcactgatggagctagcgaaagggatggtccacgacgcagtcctcggcgtggtggtggtgatgaattggcttcacacataacgctctcatcacgcagaaaagaccaatcttgtgttagatttaattgggtaattaatccatttaaatcaattaaatcaaataaattccaaggctcattatgctaggaattcatgtgaattcattcttctatgggatatcaatgggatgaagagttttgagaattaatccatttgattcaggaattgataacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatttcgaacactggagacaaggagaaggagactcccgtcaacaccaacggaggcaatactgcctcaaactccagcggaggaacattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacatcttggtgacctgtgggcgttaaatttccagattctttgaattttgataacactgtttggggtgtctaatctttaaatcaaatcattttctaaaaaagctaaatcaaatacccagtgtggtgccaggctagctttgaagctgaatatatacagaaacacgtatatctatatgcatgctctaatcttctttcttttcccctttatgacacaagtctgaaattgattcctgccgagcattgcatgatccgtcattggtttgtagcttggcccagcaaagatgaaacaccgccgctgcccgcacgagccggtgatggatgatcagcggatgcaggccggttcatcggagatgggtcgttctgtcgaaaatgtcgggaataagttcactccgactccgggttcaatctaatccatatcttgacccctaaactataaaaaccagtgtaaaatgactctcttggtggtcttaagcgtggtttttgatgaggtggctcaataatgtaacctaatcggctgagtcagtatgtaggacccatatgtcagcatgaagattttcttttttctttccttgtcctctcgtcgttgaacaggctctccttcccgtccagtctcctcgtgtatgacagcccgagccgcgaccgcacgctgcaaaggtcgctagtgctggagtcgagccccatgaactcccccatcacggcggtgagcggtggcccgatgagcggtctgtcgagggatattgtggttgagggatattgtcgctattgtggttgagggatatgatcagattggcatatttaagggagtgaaagtaaacttattctaaaatgtcggcctagacaggagtccgagacagccggcccggcctaccaaataacacgtaagacggcagaattgggccgttggattagggggcctataggccttgcatgcagccctgcacgaagtctttcaccgcgaggcggtagaactaagaaaacggaatacacgcttccttccagtaaataaaataaaacaaaatgaaggaaaataaagaaaaaacataatagaacgtgataaccgttgaggtgtggtgtagtatatgcgctgacgtcacccccaacgtcataccgtccgcttgctcgcaaaaaaaaaatggaagtaattttcagagagagaaaaatgtagtgctacgtattaccactagtcagtcagagttgctgcagtgtaggttagcacaaaatattgcggcgtggtgagctgattaactctgataatccaatcctcttagatccagaaagcgagttcatcacgcattcacgcgacagccgacggcgccagttcgcgaaaagaaaatttttaggtgtcatgtcggatgtttactagatgttgaaaggggttttcgaacactaatgaaaatactaattttataactcacctggaaatcgcgagacgaatcttttgagactaattaatccatcattagcatatgtgggttactgtaacacttatgactaatcattgactaattaggctcaaaagattcgtctcgcgatttctcccttaactgtgtaattagtttttcttttaatctatatttaatgattcatgcatatgttaaagattcggtgtgatatttttgagggaaaaaattgggcaactattcaaacttctaacttttttcatcacatcaaaactttcctacatacagattaggaaagttttgatgtgatagaaaaattgaaagtttgaagaaaaagttgtgaactaaaccaagcatgagtatgaacatttaaaccctgtggaggaaaaaaagaccgcaccttctgcaagtctcaaccactagtatcaggattcaagatcccctatttttgaccaggaaatatcaaagccataaatgaatgggtgatacgttcattcacgctctaatcttgagcctctatctccccccaaaaaaaggtcagctctgactttaagatgcaggaagattaaatgcaatggctccgaccgtacgacggtagcagtagcagcagcagcaggacatcgacatctggtcgacacggaggaaactctggttatgcaagtgagacacgcaggaatcaatgaggatctctatcagataaatcaccctcgttgacacattggacagctagatctgcacggaaatggaaattaacacctgtaatgtccgagaaaaagagtgaattaacatcagaagaaagaacatagtcttgagtgacattgagtgctgggtgctgttgatgttcttccattcgatcaattctgtgattgatcctgtttacttgtacaatacgatgacaaaaatcactttctagaatacaatcgagcattgactagtactttgtaagaacttgtctcctgggaaaataaatcattgatcgagaggggaactttgctaagcatctttcagcatgtcatcagtttttgacagcacaacgtcagaccagctaggatacttgtgcgtacttgtgtagagaaacgctgactttgcatcttatggagtatatactactgatttctgtcccttttaactgaatcttaattagtatttcaacagctcggctcgaaatggaagccattgttcttccaaaaagaaatggaagtcattagttgtccagaaggccgagagcgacatttgattattaattagctcaaccatgattttttttacaaggaatctaatacaattatttggccaaatgaactgtatctgaatcaacagacgtaaacatttgagtatttggcagaagagaggttagctaccatttcctctactcctctttggtgcattgactatgtgacattccctgtgataccttaggtaggtatctgtatccctggttatctcataaactatactatgttccgaagaatctccaccaatcatgcattcagtgcctaatcgatcaattaccttcattctaatgaaacattcaacttcccgcacggtgtcgagcttccaacttggagatttagacagtcttggataattataaatggggagctagcgagcaacagcaaccagacaactcataaatcattttgttacattgcctaaaaataaccctctagtctatcttagaataaacaagaaagcgacaacgcattcaggaatcaagaacatgcgtacaacagaaacccctttgaagtagatgcaatgcaatccgtcatcaaagtgcaccttatcaatttataacgactaagctgcctttaaagcttgtaacatttatcttcagtctgtatagataagatttcagagccaaagcaccacagatatatcttcaggacactctcagaattcagaaagaaacaccatgagtgaggtataaaaacaggtcattctagattaatccatgcctacatgcaacgtgatccatgccactagatcattaaccaaactagattccaagcaaatgcatagctgtttctttccggcgggaatcacccagatcagcatgatccaaaagagattcaggtcaatgcgaagctgttagcccatgggattctgaatttcgtattgccgccaaattaacatgtcaaatgtcactgaaactcataaactaggggggcacacaacggtatgaaaacatgcttggctgcttgcaggaatgtatcacattacaggcatagaatagtagaaaatactttcccttgtagaaatattctccttgttttcttttcctgctcacatggcacactaatctaatcttgtcaggatgaacagctagaacagaaactgatagaagataactctggcgaatgggagtggaggacaacatcaagcggaactcagatatcgctttaatctatccaagaagcaggtagatcagatgctatcgcgttacgtctcacccgatttcttaaaacagaaacccgatttaactaaaccaaagtcagaatatccacgcgtagatgcaacaatcatgtagtgattcttcacataagcataagcaacacgaagagaaatagcagattaatcagcgaacatgcaaagcggaatttggcaacgggagatgcggcaagtggggaagtttcttactctgaatatgtttacctgcagagttcattttttttctctctcaccccaacaagtgcatattagtccatccttgctgatggcgatttaataaggaatccgataggtgacagggagataaacaaatcggacgctgaccttgctgtggcgaactgggtgatcatcgatggcgatgcgagacatcacccaactgcgtcgggtctccacaggagggagttgcttgtgcttggtccgtttggggatcgttaacttaaacacttttacggcgacctcgacacagctaaaccctaaactaattgcgagttagaggcttatctcgatctcttctatgcagatgtttgacaacttgggagtagtttactgctggtttggagtatcttctcaacttgcaatttgattatgtttaaacggggagtgcatgattggtgttcgcatggttttaaatcagattttataaactgatgctcgtcaagagacgacaaggggccagattagggcagcagagtacgtgcttgcttgaattctgaagcatgtacgaaataaatacgatagaaatttcttaagaaattatgtatttttctgaacctccaataagatcgcgtggttgccagtattgcacgtcgactactacatatctgaattcagaacaatccagaagagatgttactgttgatatttctacgtataaaaaaaacatcaaaatgctttgtatattacgaaaacagagcgagttcccttattgaccagagcaaaaaggttgagcctgattaaacaaagtctatgagcttgcaggatgcgtctcttcccaaatttattcacaccaaagtcctcttcgatgacatcgccctatttgaatcttatcgttgacattgctcattttgctctttagttaatctgggcaaatgattggcggtggtacttcgtgatgtggaacagtgaaactgtttgtcaatctgtgcgctcgaggtacaaccaggtcggttcctttgctgttttattaataaaaggagcataaattagcgccaaaactcaagttttaccacaaaaaaacagtcagttttaataaagattaagcaaacccttgaattgcactctgtaaaatgtttgtttcccctcaaaagctgataaggacggacgccgatgtgaaacgaaacctgctatttcaaccatgtacatatataatcaagaatttcctacacgacttccattttttgtgtgttgactagtttctctccttcctggaggtgttaaaagagttccgattctgtcaaaacttccatacagataaatccaacctgtcaaactaccagctgtttaattattccttttcccattttgttatggtacacaaaggcacataaccatttacacggagcagaacagaataggatatgtattaaaaaaacagaatggagaaaaatcctgagtcacaagcacgaaaaatgaaggcgagattaattcgaaaccatacacatcatcatccacatctcgtcgtttgtctcacaggacatgacacagggagcgaaaaccacatcattaatcgcggcctacagctacacatccagattctcccgggatccccgaaacggctcccaccccgcaaccgccgcaagccgacccagccaaaggagatccccctccaccacggaagattcactgcgcggtgggccccgccgccaaaaaccaaaacgacgaaaccattccgcgtcatctctcccgcacggcgagcgagcgagcgagcgacctgacctcctcctcctataaatccggcgccagcgtttctccccaacctcccacgcccaatcctgccgccgtttcagcagctctagtttgaacgagggatcgtagagaggagggtttggtgagggagggaggaagatggcgacgtgcgcggcggacctggcgccgctgctggggccggtggcggcgaacgcgacggactacctgtgcaaccggttcgccgacacgacgtcggcggtggacgcgacgtacctgctcttctcggcgtacctcgtgttcgccatgcagctcgggttcgcgatgctctgcgccgggtcggtgcgggccaagaacacgatgaacatcatgctcaccaacgtgctcgacgccgcggccggggcgctcttctactacctcttcggcttcgccttcgccttcggcacgccgtccaacggcttcatcgggaagcagttcttcggcctcaagcacatgccgcagaccgggttcgactacgacttcttcctcttccagtggg

SEQ ID NO: 70048 - DNA, 857 bp, Oryza sativa
tttgaattctcaatactagtgtatggtttccttcaattatgtagatgccattcatctcttaggcagagtaactgtattctttttttttaatttctaaagcttaatcagttaattgagcataatatttccttcagataaagtttaatgtgttctttcgtgaatatgatgtcatgataccataattaagtttctttttgttacccttcattctgttaccattaacatgttttaaaattcttatgctagatctttcaaggttccaagttaaattggaaagagatgatggaaccaaaagaagcactgaatttccagatagcaggactgcacacatttatggcgttgttcctgctgagagggatacctatcagcctcatattgagtctagtgaatggtattctgggagatggtcatgcaaaggtggtgactggaagcgaaatgatgatttcagccaagataagccttacaggaagaagcttgttctcaatgaaggctatcctctttgtcaaatgccaaaagggaatcatgaggatcctcgttggggctgcaaggatgacctctactaccctttacgtgctaaaaagcttgatctgccgttgtgggcattctcatcaacagaagaaaatgatgacactgtagatgatgccagtaaaagtggtgttatgcctgggaggtcaggtcagactaaacaacctcctaagggagtgaaggggacaacgcttcctgtcgttaagataaatgcccgtgttgttaaggaccaatcctcttctgaactccgtataaagcccaaagtagctgatcggccaccttctagatcttcgcgctcccattcaattgggactgataggagttctacccat

SEQ ID NO: 70049 - DNA, 2731 bp, Oryza sativa
  unsure (1)..(2731): unsure at all n locations
cgccgtcgccgtcgagattaggcggacaaaggagagggctcaccgaaacacctttttcttatatgtatttctnactggacacaagttggccagatggtaaagtctgaaaatccacctctcttgctttactttatttgttttcctgatttgtgggtaaaaaacttagggccgctttgaatcgcaggattgagaaaacgtagtaacagaaaaaacgtaaaattttgataggaatataagtttaaaacaaagaattgcaaaacacaggaaaaatacagaaacgaccgtttgattgaaccacaggaaaaacacaaaaattggatgagagagatagactcaaaggaaagttagcaagaggttggagctcttgttaaatttcctccaaaatctctataggattgtccattccataggaatttcaaaggattggataggattcaatcctttgtttcaaagggcttcataggaatttttcttataggattgaaatcctctaaaatttctatatttttcctctaaatcaaagggcccttagttaggcctcaacaagtgaagtaggcctttcttggctggcccgtctattggccaaaccacaagttcacgttagcctggttcaccggtttttctccaaataccatccggtccttacggttcacatcaatcatcatgctacatgggtgatctttgtagcaaaccacttcaattaggatacccagctctaatttcttcgtgtaaaacggcaggccggtctagtttttcagcataccagtggctgagttcgtttaggagggttcccaatgtctctccctcattttctacacgcaagcttttcaaactgatctattaaaaagagtattttttaaaaaagattctatacgaaagttgtttaaaaaaatcatattgatttatttttttaaaaaaaagctaatactccctccatcaatttttgatagtcatatttccaaatctgaaaattttatttttgataggcatatttcaatctaacaacttattatattaatgactttcttagatttaatgcatgactcttcattcttccatacatgattggttacatgggcattgagaaatgtaaatattaatgaatcgcttgtttatgagaatgactagtagcatatttaaatggatgataagtagaattacttatccttgctctgtgtgccaagatgaaatatgactatcaaaaatagatggagggagtacttaattaatcatgtgctaatagactgctccgtgttctgtgcgggagggtaatattcccaaccatgaggaacggcactcacacacacctccttctctctccccctctttccccttgtcggctcaggcagccacacgcacacctgtgagatgaccagtgcatattcttcttcgttttgctgagtgttttccatcctgtccggtcaacgtcccatcaccgttgatggcttactctcttatcccttaaaaaaattaaatcctagcgatgaatctgtacaatagttcattgtcaagatttgagtttttttttacggagggattatgtctctagtttgctttatctcgagccttcctagcagcattagtgtcagatgtgtttatcttcctcgtggagccaagaaccaaacaatcgatctgtcgagggattggaagagtatggatacatgttgtgcatattgtttcttgctagtgtgggattgttcagtggtatatgtaactgaaattgcaatccaacaaactacctacagagttttgtttggaaccgtggccaagcagaggcacacacatatggcatgtattcctgtcatccggtatgcatgattcacatgctccgtaggattcatcttgtgttgaagtatcttatttgtgacaaagctaccaaacatatatcttgaagtctaggtgtcttgagaaaattcctaatacttcctctgtcccaaaatatagctacctaatacatgatacctctggtccagatttgtagtactaggtaatatcacatactgtactagatagctacattttagaatggagaaagtactataattttttaattcaagaaagaaagactcaagctaatctgtaggataggtgtaactcattccacttggtccccaaacaaaacacacactactacaaaaatgatttttatatacgatgacccctttcggttgcaaacggaccgtaactggcggcgtctacaaaaaatcgaactacattttcgcatacagttccttaagagaccaacatacaaaaatcttttctcgcagatgggcctcttaagggccgcatgcaaaaatatgcttattttcaaatgtggatctcttaagtggtccgtatgcagaactaccacccattcacatatttctttatctctgtccactctcttttccctctaaccacttcaaatttcttccaactcctctcctctctccccctcttgcatgcaaaactaccaccccttcacatatttttttactctatctactctcttttccctccgaccacttcaaatttcttccaactcctctcctcactctccccctctcctctcctctctctttcttttcttctttctctccctctttgagcgggcgccggtggctgggaggggcaacagtgggtgcgggggcgggagcaagggaggcgatggcgtcggtgggtagcggatcctgtggcgccgccctcgggagggtcggatccacctccctagggagtggctgcggctatggcg

SEQ ID NO: 70050 - DNA, 1577 bp, Oryza sativa
agcttaaagtatactcacaaactggattctcgtggttatacagtttaaataagttataaggatgtttcagatttgctatgatgtttttgcctttccatttctattaaatgtactgagaaagccaattttgtaggtgcttgttttgtattatggaagttataacagaatgatatgaatagcttatgacatacgaatatatacttatgtttcctaaagtttattactgagttagtgttttgtcttttagctgccacaatggaatgaaatgttgctgaaagagaatctcggatatattcaatggaaattaaagtctagagaaaaaaagtagttcatgccctagttggattctcccatatcagtatgtggaaattgaaatgttaacatgcataaaataaaattggctttatttaagaattccaagtttgattttttatgggtatattgggtgctgtgctctgattggatttgctaactgttgtgctgactcactttctatataatttacattattcaataatttccttaaggatttatcttttctagcctgcctgtaactattgaaatggaagggagtcttaatgttatactatatttactgccccaaatatctaatctgttctccacccacaagaccacaactaaacagtaatgcccattgctcatcatgtcggagaatgaggttttcttctatttgaacacccattaactttcactcacccatcatgtcagttgcactacttgaacacccattaaatttcatatcttgatctcaagctacattttatttcattcatgatgatagcaagaatacccaagtatctggtgacttgtttggcattgatttgggtttctacaacacttacagcttcagctttgattatttgcatttaaatgtcttgtgtaatgatccatttctgcatttctgcatgcacgacaccatgacatcgaccgctgccgccaaccaaattaacccttaattacttaatgtcgatcgaccatgcatcagctgacagtgttggtactagttcaatatgatgaaagctaattgattccgtgtccatgtagtggactcatgcggcagggcagattaattagcatgcagctgtatgtatagtgtatagtggtagtagtatacatactgcattcttatgctcactagaccgctgcatgcatatgcatatgcgccggtggatcgatgcgcacatgcatattgttcaattcttcagttgaaaaataaatctgagtattttacttccataaaagtacattttggtagtattaaattacgtggtttgacttattgttgaattttgaaaatatgaattgtagaattttggcatggctggcaatcacattagtttggaggagattgcagagcatgagagtgtgataaccaaggagtttagaagcgaggcagaaggatataagttctataatgattatgcttggtcgaaaggttttagcatcagaaaggacaatgttacgtacaatggagatggtaaggtggtatggaggcattcatgttgctcatatgaaggctataggttgttgaaatactttgaaagaacagaccaaat

SEQ ID NO: 70051 - DNA, 9910 bp, Oryza sativa
cccatgaagactctaggtccatttgaagtcagtactgtctccggaggccgagctggacttggacttggaattatcattggaacgtgtgaagttatgagcgtatccgacgaagtgatgtcctcatcatcctccccttcttgaattggagtcgtcctcgactcaatcccatctttttgattgtgtgcactctctcgtctagtggccatccttggaggtatctcatcttgaaaaacattctcatattcctgagtaacagtgggtggcaaagaatataaagtactaggagcagtagcgaatgtgagtataggatctttgcaaaatagagcatagcaacaagaatctggctcatctagtgcacaaatattatatttagaagccaacgaagcacccttcaacttaatttcattctttgtggtacttggttctattttactagttgaagcaagatgtttagcaataatctgattatcacttttcactttcttttcacattcaagtcttgcaagatcatctttcaaagcagcggctggagtcatagaatgcaaaacaactcttttaccatcgaacataaatttatatgtattagtcctaccatcaaaaacaacttctctatcatattgccatagtcgccccaaaataacagaacaagcttgcatatgcacaacatcacattcaatttgatcatggtaggagcctatagaaaaaggtattttaaccaagcgggttaccttcatcttaccacatgtattaaaccactgaatataatacggatgtggatgtggataggtagtcaagccaagattcttgaccatctctttacttgctaaattgttgcaactcccgctatcaataatcattttgatggtatggcctttcacaagaactttgctttggaacaaattgtggcgttggttttgctcttcacacttctctttagcactaagtgctagcttgacaattaggctaggatactgatctagcgactctggatgcaaatggacttcctcgatgtcatcgttatcttgtcctcctgcatggtcagtggcagctaaagcatattcatcatcacaatcactagcagaagtatactcaccatcatcattcacaaatagagctcgctgatttggacagttgcgggcaatgtgtccaatgccatggcacctatgacatgtaatatcacgggtacgtccagtggaagctaccgaagttgcactcttggttggagtctgaactgaagcgtttttgcttggttcttgagcatgggatggcgtggaggtaggtggcgtggaggtaggtggacgaacggcagtagtagattgacgtggtgttgactgtcgtgtgaaagtagcacctgcaaaagaactcctatgcttgttgcgtctctgcacttctctttcagctttgcaagcaaaatggaataatctattcatggtattgtattctttatattcaagaatatcccgaatctctctattaagacctccatagaacctagaaattctagcatcctcagtttcttgcaaatcacatcgtgacaaagcaatcatcatctcttgatagtatgtttctacagaattggaaccttgtcttaaaagatgcagtttatttaacatgtcacgagcatagtaagaaggaacaaatctagacctcattgtacgttttatatcatcccatgttctaggtctaagtcctctaccacatatatcattccaccatagagatgtaaaggaggtaaattcactactggcagctttaactttcttattatcaggaaaatcatagcaagagaatttttgctcaacagctagctcccagtctagataaacagaaggctcaaacttaccatcaaaagaaggcttagtaaattttaccttagataaaggatcatctttatccctaactcgacgtcgtcttctatttccaacactctcgtcttcctcctcatcgtcagcaacagattgctcttcgtcttcatcgtcatatctttggtgtcgatgagcagtggcacctgcaccttcttcacctgcagcctcaagtaaaccaatgtgtcgcacaatattttcatgtccaatattcatattctgaatattttcagttaattgtttatgtgattgattcatttgctcaatttgatccactactttcaccaggctttcacttaaggtttttaaatgtttatctgtgctttcattgtatgatttactattacgcatcaactcttcataccaattttccatgcccttcagtttatgcgctagattctccagtgttggttcgtcggaacttgtacctgacatcgttagcaagcaaaagaaactcacaagaaagtgtcagttcctaacaatatatagatatgtggagcttttgaaggcactcaacactaaagcatataccaaattcttataatattctcaaagaatgcaaaacaggtcaatcaccatggctgtttcgtggcacaatgacacgcttgatgagtggagcgattgcaaaaccggacctgtaaaggttagtagtatgtggatcttggtaggctttactatatcacaaggaatagcaaaaatcaaacagaaatacgaaaattgaataatagtccaaagtactagtcaaaattactggtctagcctagactcaatcctagcttaaccaagcaaatgatcatactcggacaaaacacaactagctataacaagcaactctctctccaagattccaacaaaaaaaatatcacactttctttttctgattttttttcttctcttttatttttttaattttttcccttttctgatttttttggtgcggctcttttttttcttctttttttttgcacctctgatacctttttctttttttccttttttttttctttaacaagtggcaagtgcgtgcgcgcatgcacaaatacaagcagctgctagctattactgtaagaggagttcacgtgcatgtatggaacttgcatgcatggctaaacaaaaggaaacacaccaaggtaattagggagattaactaccgaaacaaagaaactgaaatgcaagaaaaccggacttgcatttgcatgcacgagataacacgggacccactcagtttctgtgttgcgcacaacaggaggaaaacaatacagatattccccaactaaatggaaaccgactcaaaatttagaggaaacagatctctataattccttgcgcaagcaacaaaccaaatcatgaatggatcgatctgctatttttttttccttcaacctagcacaaccgagatgcaaactcaaaccaggatgaaactaggactaaagccagcactccgactcgacagtggacagaaactcaataaagcaaaactgaatgaaattgcgtggctcaaaactaatgtttggtgatggaaaaaaaatggtgtggctatatggtagacaatgggtaaatgaaataaaattgcaaactaaaatcctcaccaggcaaccgatgctctgataccaactgatgacgctctctctcgtggcccaatcttctggtgaggggataactctcgctttaatcgagtgtgacgtttgcgacgtttgcgacgtggctaccaaccagaacaagtccaggacgtcgtgcaatcgctacaccacaaacgatgtcgtaccaaccgtgacgcgcggttgatgatccctgcaatgcaaacgagagaacactgcaagaacaagataagatgcaatctaaatattgcgaataggtgatgaagcacaaagaaatagttgcgattgaagtggtagatctaatcgacacggaaaatcaacacaccaactattgggggctctgaatctacagtcgtcgactaatcgagcgaggactagagacaaggtgaatggcacttggcaaaattcaactaaacaaaacccaattatttttgaggatgtacaaagctatttgtagaggaaaataaagctagggttaagtgctaattcgtggaggtggagggagacacttccgagatggggctagtctattacaaggtccaaggcccaagttcggttttagcaacagtactgtcttattttggcgattcccgttgactcgagatgaatttggacatgagagtggatgcgtttgaaaggtagcgagataagctttccacgaagtccaagatcacccaaatcagagttggcatgaagacgctaggtccatttgaagtcagtattgtctccggaggccgaactggacttggacttggaattatcattggaacgtgtgtgaagttatgagcgtatccgacgaaatgatgtcctcatcaaggaggatgatggcgtggcccgtggcggcagaggggcgacgaaggatggagaacgactattagagtggagctcaacgacacaagtcctgcgatgagcggccacttgcgacatggaaaacaacggtcgagcgtgcccgtattaacccggcgcgactgccactctgattgggatcgatggatgtggttgcgttccggtgtgatttggtagcaagtgagggcggagcaagctctgcctctatgtggcagggctagggtcttccggcgacgaggcggctcagggtgagcagcccgcaggcggccgatggggagaagaggttgttgtcgagcttgcttgggtgggcatccacgggcggcattatggttgggggcacggctaggcgaggggaagaggagcccgagcgtccgcgagcaacattatggttgggggcgcggctaggcgaggggaagagggcatcatggttgggagagagccgactttaaggggctgggatgacgatggaccggaggacccgcgtgggtgctaggagtggcagagagccgactttcccacggtccgagagcagtttgtggcatggtttggtctagtagtcacaagacagcgaggcatgcggcagcagtcgtcctccctcaacgttctgcttctctccatcggctgcctcctccgtcgccgccgtgggccacgccaccatccttcgccgtgtggtcatgtggatgagggggatgagagcactggagaaggggatgggagagagaagtggaggcctggaggagatgagggggaggaagtaggcccactgacatgtgggtcccactatttttaattttattatttgactaaaaatgctcgtgtgttgcaacgggaaaaacatgagaaatttaagaaaaggttaagaaatatttatattatgtaattaattaaaatataaaatcacaactatacatgtatactatgttgaagaaaaaaaaaagttcataagaatcaaggtaaatgtggaaaataaaattttccaaataaactatagctggatttaatttttattaaactctccatgattactccctccaggttgataatacttatcgttttagacaagggcacggtctccaaaaaacaactttgactattattttctattataatatgtataaaagtgttaacaaatatatgattttactaaaatactttttaagactaatctatacatgtagtcaccatatttgaaagacatatattttaaaaatgattcataatcaaatattctaaagtttgacctcaacattgtctaaaatgacaagtattatcagccccgagggagtaattacactatgtgaaatttctttcagtattttcagagcaccattgctatttttaataatacaaacgtcattttagcatttatttaaatgtaaaccctcctttctccctaggccattttgagcccattctttttttagcccgtagccgagccggcccagtaacctgacttctcctcccttccacctcggcctacaagcgcgcatccagcccatcaagcaaccacaaagtctaatcagcgtcccttctcctcctctcattgtcacatgggttccagtactacaaggtcgttccctacctccgtccgattccgcagcttcccaacaccgccggaaaccgtcccctccgtgaaatccgtccgcatctacggatataatccaaaattgattgaggggttttgattcttattttcttctctttctgtttttccaagatatagagcaaaatcgcatcgtatcgaccttgaaattaagccatatagcaaaccctagagttgtccgtttcgcgtacagggagggaatcggactgtgcctagagacgatgtacgaagaaagttggtaaaaacatcttaaacttttataataggtaaagataaagattgatatgtgcgcccattttattttatttattaaattattaaattttgcttcatgtgctacgtcaaatgccacgtctgatgaagatcgagtcaaattagccacatagatgtcatgtcagctaaaaaggccatctaaaccatcatgggccctatattgcaccggttttgacagttgaggggcgagttgtatatggttttgtggttgaaggacaaaatcgaattcattcacgagttaagggacctcagatgaacttatcccgcctgacaatttacatgaggcagtccaatgattcaaaccaggccagccagcccaactagacggctctaaatcagacggcccgttacatagagcccatttgccaaggtccacccaaggcggtcgcacggcccgatcgaaattcacccaagtccagacacagccgacccgagtgcgcaacgggccaagagcgtctggcttgattggtctcacggcctcacgggcgatccacggctccacgctgaaccgccgatgacggtgcacgcaacgtggtaggctgcggtcgctgcgattctgggaaatcgacgagacaaggacggcgagaaggagctaaaagacccgccgcacgactgcacaccgagtgtccgagtgcgacgtcgtcgatcggcgccgcgcgcggtggcgcaaaaatacacgatcgacgcgtggccagcctcgcctcaccttccggagaccccgacgcgacggcgacccgacccggccccgcgcgtcgtcgcgttttggaggctaactaacccctccatccacaaccagcccgcgcgccgatcgttcgcgcgcgtgcgcgcggtggcgacagcgatcgccgtgacacttgtcgccggcgcgatggcagcggccggggtcgcgagaaaactgaaccgctggccgcacgcgcgccgttgccagccgcgacaaagcagctgatagatcagatagcgcgtctcatccagagctcgggttggggagggcggcattggccgttggccgttgggccgttgctcgatcgattagggatgcggtgcgccgtgtaggggcgtgtaccaccacacgtacggccgcatggcaaccaaattctcgtcgatgatatctctcgatctctcgttctctcattttcacggctccattatttctgtagctggagggtagcgatggccgggcgggcggcgaaagggtgtgtttagttcacgctaaaattaaaagtttggttgaaattagaacgatgtgaaggaaaagttggaagtttatatatgtagaaaagttttgatgtgatggaaaagttaaaagtttgaaaaaaagtttggaactaaacacggtaaaagtcattgcattttcaaggcatggaacacgggtaaaacatggttttgtaatatgtacagttcgcggcagccggcaactgcgatctgcaacttctagtactatacattgactgccgctgtagttttactgatgtgagagcgtaccagctcaggatgctcatgcctaggtaggcttgtagccttgcagctcggttcgatatgtgagagcgattgacttgcgaactcttgggacagatgagccgaatcgcattatcctaatcgatcattatcacagagaggaaatgccggttgaattctccggcgacttgttactcgtagctataaaagccaaagctgaaattggtaacgattatttgacgcggctcataagagcaaactcgatcagtgctgcatttcgaattaagttgtgagtttctaaaagaacctcatggtaggccaaaacgatgtcagctcaaggatggaaatgcttggtcgaagagttttacttggacataacacgatgttgttaaagttttattatcattatctaattatatatgagaacatctatagtatttagaagtatattattacttattagtaattatcgtgcgcgaaggtagcgtaactcaactggctaggtttcttgtagtggaaccaaaccacccaggttttaagtcctaaacttggcatgagtgctcgtatttatccatcgacagtgagatactcgtgatccatctacagcgagatactcgtggtgagttcgtcaatctcatgatataccggttcagtttttcggagatgttaatagatagcaagacactacggttaattattttttcggtggtaggtggtgtatccgtcgacaacgatatactcgtggtgacttcttcaatctcatgatataccggttcagtttttaggagacgttaataaatagcgagacactcatggtgacatcgtcaatctcatgatataccggttcagttttctggagacgttaatgggggtagggtgtgcgtgtgcatattcataggactagtgagtgtcagggcgttgcgagcgcatacatttgtattttgtttcttaaacaaacaattataatgcgttataatacgcagcaaaaccgattgtatctaagatagatgtttattggaagttgcaccttcaacaaatcgaaatgacacaatgaatccagggtctccgagcaaacaaacgatgcctccgctcctacttgcaaaccatcatctgtgcgctagcagccagcaggcacctaacagaagccttgccgccttgcgtgcatgtgaatgtctctagcttagttaaggaacaacaaacaaaacatcatgtacatatctctttatcagcgtgacctgctgccgccttgaggtgagctagctaggatgatgtaggaagagcggtttgatgaggacgaaatgagatgccaacatctccaccaaaaaggatgaaccgaaaacgttaggataaatgatcaatttttctctgccaaatttgccaagcaatcaatcaccttaaaaatgtacagagagaaaatcattattacaattcaaatcagggtattctaaaatcgatctcaatagttaatagtatgaacaacggtagctagaagataatttttcctcatataaccaaattaaaaaaaaatcttctcctttaaaattctgatacgcggtgaaaaatgaaacagattccgcacctagacgcaaaggccaaaacaatgggctaaccgcttggagagatacgagtatacgacgcgttgcgatcatcctgcccaaccgttgcataagcccggaccacggttttccccgtatgcccccacctcgtggcgctaagatccaaatcgggccgtccatccatctcgcgtcacacggtccaccaccaccccgcccttcaatcatagagcccgtcgcgcgtcgcgacaccgccgcccccgccgtccgatccgcatccgacggcccagagacggggagaaaccgtcctaccctcctagggcgccgcagcccagggcccctacgagtctagcccccctacgccaccgcgcacctccctcctccgatataacccgcgcggcgcagcgggagggcaacggcaaatcacgagccacacgcgcatcgcaagaccaacgctgagttatcgcatctcggcatccgcatccgcgcgacgacgacgacgaggaggacgacgccgacgccggaggccgtccggggcaaggggaatgcggagcgatgaggcgggcacgaggcactgacgccggcgtccagcgcaagctgcgcggcggccgcacctgccaccggaagcacgtcgaggacgggtagatccatctcttggtagtagattagtagtagttaggtagattcttgaggaggaggaggaggatgatgcgccgcggc

SEQ ID NO: 70052 - DNA, 17773 bp, Oryza sativa
cgacttctgccactcccgcggcgtctaccaccgcgacctcaagccggagaacctgctgttcgacgaggccgggaacctcaaggtggtcgactggggccttagcgcgctcgccgaccacgcccgcgccgacggccttctccacacgctctgcggcacgccggggtacgccgcgcccgaggtgctccgcgacaagggctacgacggcgccaaggccgacctctggtcctgcggcgtcatcctctacgtgctcctcgccgggtccctcccgttccccgacgacaacatcgtcaccctgtaccggaaggcccagcgcggcgactaccggtgcccggcgtggctgtccaccgacgcgcgccgcctcatccccaggctgctcgaccccaacccgaccacccgcatcagcgtcgcgcagctcgtcgagacgccgtggttcaagaagacgtccatctccaggcctgtgagcatagagcttcctccggcctttgccgatcctgctccggctaaggaggaggccgagaaggacgagccggagacgctgaacgcgttccacctgatatcactctcggaggggttcgacctctcgccgctgttcgagggggactcggccaaggggaggcgggacggtggcatgctgttcgcgacgcgggagccagcgagcggcgtgatctcccgcctcgagggggtggcggcgcgcggcggcggccggatgcgggtgaccaagagcggcgcccgcggcgtgcgcctggagggcgcggagcgcggcggggccaagggccgcctcgccgtggccgccgacatcttcagcgtggcgccctccgtcctcgtcgtcgacgtcaagaaggacggcggcgacacgctcgagtaccgctcattctgcagcgaggagctccggccggcgctccaggacatcgtctggggcgccgccgccgacccaacgccgaccgccgccgtctgatgccaccattgttagcgtccaaagtcattgtgtcacagtagccgatgctgttcttcctcctcctgtgcttgattcgatagcgacgtgcatgaactagtatcgctgtttgggtggtgggggcagttggcaagaacaaatctgtatctctgcctcaaaagcaacagcatttttttttcttttgcacaagttgcaattgtttttgtgatggtctttgcttacatctgaatattccgtgtcttctctgggacaatctctgctgcatgattgatggtctttgctgtttatatgtattcagacgccgtgcaatactgtatgattggaatggttcacagtttcagtgttcagtccaaagttgtttcgctttgacatagatttctttaccaaaaaaatcggcctggccattgattaaaaggatttccctacaactcttgaatgatagatataagaaggtaatttaaacagtaaatgtgttgtgaaagagaacgtagtctagtggttgcaacgagggtaaaaagacatcaaatttacagtaaatagttcgtagaatggatcggtaaaaaaaaaaggtagttcgtatactctagggctcatcttttcgtttatgtttatgcttgtaagttaaaatttaaatttttaaccataaatttagagctggttttgaggttttttctctcttcaattgcagttcgatttgctcgtcttatcgttcactacttaacttatggattttgatgtctgtcggcgatgacaaaatgtgaaagcgaaactgtaaagcttcaaagaagctaatttgcttccaatttcgatctccgaacactcgtgcgctgctctcaaacagcagcctagttagagcgcctaactatgattttattcccatggcaaacttctaaacgaaggacagaagtttcgcttcgcttccttgatagagagagaaataatacactaatgcgtcacctggcgagaagaaaatacgcatcaaaagcttctgcgacaatcatcagctcggtggatttttccgacattagtaaaaaaaagctatgtgcggttgaacaaccagcctgctttaaagtatctgcgaaaatctttattttcccttgcagtggtgtaattgcacgtaaaagtcaaattttcgcattaggtgtttacgtcgtccgcacacaaaaaaaatcaaaaccctagcgcctccatagtggaggaggtgtggatccggccatcacgggtcagtggcggtggatccgatcatcgcagggccgatggaggcagatacgcccaccgctcgttgctcccgctaccgagctctcgaggaagccgagctggctaccaccagcccgttagccgttcccgctcgatcgccgctgccgccggctagtaagtaggaagtgagaaataatgaggagaggagaggaggtgagagagagatagaaagaaaataaaaatgatacttgaaaaattttaaagtgttgaaagggaacgttcttctgtctacatctctctttattatgctaatgtttaacgaagtggttgttttgaacttgttcagagcaaagctcaagctcctcttgttactcgttccatcagtcggcaactcgggatgcttttgtgcattataaccgttcaacattttgcacgtgggacaatcagtcaatcaggccagctcccttcctgtgttcttccaagccgatgtctctaggacctgtccccgaacatcatctttctcttttacgtttttgacataaattttttattaataaatgacataaaaagtttatctttttttcttctgtttgagatgaatcatctttctgttggggcttgctaattaagttcctcttagatactgccctgttcattctgcagactgcagctcctcatctgagttggggatttgagagtaggggacgttgaggggcatgttcaacggctaacctggcctgttcttgatgatggataaaactgagtataaaacaattatttgagggcacaaaagaataaattaaataatagaagaattttaagaaatgttaatgaataaaggtattgaaaaaatcgtatcatttaggagcttgaaaaccatactcgcgctgatccataatccgtaagcctatgaacctgctatcagacagtttgcaggtaaaattttatagagaatgattaaacagcagatgaataaagatatataggcaatacacacactattgctggattgagcgtgcatacggcatgttcacgagacattctttgtcagggtatctccaaacctgattcatctgctgggctatcctgtccactagtgtgctgtgctcactgataacccttcacttcctgatctatttttctgccacaaaaaataagataagctccaggatgcatctagctaaacttatcactgcatgattttaattgttaccccatccagattaattttagcagtattttgttcgtcttgttctaattattagcttgagtctatcgaaacaatcatgtttactaccttaacctgcaggaagagacaggtaaaaacaacgagtgatttcttaagaaaaaggataattgaataccacagatacacgcagataaagagtgatttagcctacttgtttgtggacagttacgaaatttttcgttaaagagaacttttcatcaagcagacctcttggttgttttttctgggggccttttacagtacattttattactgggtgtagtagtgtagtagaaactaaatcagacccttcatttgtttgggtattttagggcttttaaaaatgcttattagggtatttttgactttcaactctaatttcaattatagaagggtattgctcgtaatcttggcgctgcaattattctaatcgacggatcctggcaaggtcgccgcgccgcccgctgcttcatcccccggttatataacttctcaccggggtgtggcgtcttaaccttctcactggtgtcttgaacaggaataatgctcgatcaatttatttttaggaatcctccatcaatttagacggcacatgtgtatatgcatgtactaatttgaagaaagagcagcgatgcattccaaccatgtttgcattcatgcaattagggatcggcgaaccgtccttctctccggattagaagcaacaaaatcaacagaacaaaaacaaaaatccgcatgaacacttgcacgttcatcactaggacaggcccacctacagtctgagaaaaccaagagatggcgtaaaaaatagagtagattagaaaaaaaaacttaaccggtaattaacacatgcgaaattacttctttaccatgcaaaattttccaaatctacccttggggaaataatactatccataatactcagtgtagtagtggcggatatgatccgttggatgcaacgaatggatgatccatgtttacccgagggtacagtaaaaaaatcctttttctgggcggactatgttgcaagatggccagttgcagtgagtgcctgaaaatgcatgatttttctttggttgcataggcttgaacaaataaacatgatgtttctctcattctgtgaatgaaaatatttaacctgtattatttgaattgatctctagtgcatgatagggacggatagactcaggtcagaatgaaatgacatacagtgcatataagagaaaggtctagtaggcttaactctgcccatgtgtccagctagctcattgcgacaagaaatcttaggctgtgttagagaaaggggagatagataagattgggaagatacgcaaaacgaggtgagctattagtgcatgattaatcgagtattaattatttcaaatttcaaaaatagactgatatgattttttaaaacaactttcttatagaattttttttgcaaaaaacacaccgtttaatagtttgggaagcgtgcatgcggaaaacgatgtgcaatctatctccaatctcctagaacgaacgctgccttattatctcttaccggtgacagtgtatctccatgcaaaacagaacaaatggagaaccttttcccagacaaaatgagatgcaccatccacaataatgtcatttttaaaagcatataatacataggctcactgtcccctaaaagacaaccctgattcatgcactgaacacagagcctgaatgtataatcataggtgcatttcatgttctattcagaaaatattttcttttgagaggaaagatgatattgtttagaaaaggactatcattggtgtccccttctaataggctcacacattgaatcttggttaactttttctaatcaaatacccattcccattgatgagaaactgttcaattattgtcctttgggtccatgcatgtgtcatcatctccacggtgctttcacctaccatggggatgtgacattggtcacgctctgacaagtaatgacttcgctgagtgttccagaactgcataactctgcttgattatgcggctaatatggcacgataatttcggtttaggatatggaattttgtattcggaataatcgaagtcgtggaggacgacactgacgcatccatccattggcagatagtaggaattaagatgcagccacatgataatgtggatgatggatgaatggtagcctagcctactgttgctagccagttttgggccatggcaggtgtaaagaggtcaggggtacaggacattcagattgatagtagacagataatccatatctacatcagcattatatgagcgcaataattggggaattctatctgtttttccgtggatcatgaatctctttcaattttttttaacaaaccggcacaatacaatgccaattttattgtatagcgtaggagtacaagtatttatctgaaaagaaaaaagatagtacaagtgtttttagagaaactagggtaatatttccacgagtcttttgctcctgctcacgcctaagttttcattcctcctttattttagtgacaagtgaagattgttgagagctctatatgatggaagactcgttggtttctttctttccaaatctcccaaaacgttagcaatataagtgaatctctttcgattggataatgaattcactactcatcgtagcagacataaaacgagagatgtgttgtgatgtaataatctcaccatgtttcggggagagtagccgatcctctcaactccctcttctcccgcgccgacaccatcaccgatgagagagaaaccagccttgttttgatcgagcgggagcagaaagcgtggacggcccaaataagatttggggcccaaattatctttacgttgggcgcagattttgggccaaatacggagggcccaagtactgtacggccctggacggacgaccgagattgctgctagctagagttttgctatccaatttccggtcattggaatgaacaatttaaattggctgtttaggtttataattttcgcggttaattcgttttatcacccctggaacatcgtgcgtatcacctagttgttcggcggacgtggttaccaacagaagccctaggaattagtgatcacttcgtcgcgcgcgatgaataattaacggatgaaccaattaaaacagctcgacgagacgacgactgcgagctctagctgtgcatgcatcagcaaacaagatagttatactgaccaaaacaagatttctatctaggattctggcaacgcagttggcgtttagatatagggacttaactttaatctctatatttagacactaatttagagtattagatatatactacttacaaaactaattacataaattaaagctaatttgcgagataattttttaagcctaattaatccataattagagaatgtttactgtagcatcacataggctaatcatgaattaattagactcaatagattcgtctcgcgaattagtccaaaattacggatgggttttattaatagtttacgtttaatatttataattaattaatgtccaaacattcgatgtgacctatctaaacagggtctcagacatgcagtttggcgcgcgctctctctctcttcgtcggtcgctttcgcatctctctgtctgatatggctattcgatgtacataccttcctataaattcactcatagatttagccgcagcatcgatcactgacaaccatcgtctttctctggttgagctagctagctaagctagccaggggagagctagagagatcgccggagatgagccagaagtcgtcgtggccggagctggtgggcgtactggcgacgctggcggcgacgcagatcggcaaggacaggccggacgtcgccgtcgaggtgctcccgccgggcgcgcccctcacgccggatttcaacgacaagcgcgtccgtgtcttcatggacgacaacggcatcgtcttcaaaattcccgtcatcggttagcttaaatgctccaatagctagcctatgggctatggcactagctgatctcccatggctgatgcatgcatatttctcctcgtcttatcacatctgttacatatgcagcgaaataatggaataaatggcgccgtgtacgttcatgtgtttttgctccttcatatgctccatctattccaaaataacttaatctaagatacaaaatgacacattctaaaccaacgaatttgaatttatcgttggtctaggatggatcacatcacatcctagattaagttatttttggaatgaaggaaggaaactttagctaaggatgtattcttttctttcctttctagtaacttttattccctcgttttttacatttacgctttccaaactgataaacgtcgtgttttttaaaactgctttaaaaaatatattaatctattttttattttttatttaatacttaattaataatacgctaatttttcgttccattttgcatgccaagaggaatgttgcgaccccaaaaaaaggcagcctgtatccagtgaatttttcgctgtaaatggtccaccttattcttttagctctacttttagtttcagaagcactagcccctctctccaaatagactagaatctaagaatatgcagttataaaacctagaatatggactagaacctggccgaacccaaacatttttgacaatttgacacgtacgtacggcccatacttattgggccggaatgtgtcgaccttctgacatggggacgtagtggctgggccagtaatagttgggctggatgcgcatagtgccgtagttatgcgcggatctgttgaaaatagacaggacgctgtttttgaggtattgaaactgttgcaaatagcgatttaattaatgttcttcactagttgagaataaagcattctgtcactgacagtgaatcggtaataggataattgctacagacaatgagacaagtaattttcagtggtggtgccttttactctgcgtgagtgagtccatatgcaactatgcatgcataactaaagattcctaatccgcttggattcttttagggttcatctagatgtacgctgcacttaggtcctgctttaaagattagcccaggtttaattttgagagctaatgtttagttttgaattggtaggctaaacattatgttcggatccataggctaaatcagcgctaaaagttggagagagagtagagagagaggggggagatagggctgtttttttatggtcctatagaaaattagcccaattagcatttcttggaggagctaatattttgaggggtgctaatttactttagccccagattagcccacctatttagattcttggggctaatttagggctaataattagcccatatatggaaccaaatagggcctcaggaactttttgatagccacaacttctctcttagaagagttgattctaagagagaagttgtagctattaaaaagttcttaaggccctgtttagttctatggactaattactaggaatattttcagtacttctattttatagttttgaaaaaaaactaaaagtttgaaactataaaacccaatgttttgagattctcaccaacaacttctcataatctcagactcctctaatcaggaccatgtggctagaccaacagtagatttaaccagaccgtggataaccaacagcccgtggagaacctagttagactctaattgacaatagtattgtaattcatagtctaaaataactaaaaagtacaaatgctacctgatgtcctatgcatcggggtagttctatggaggaaacttttttattgtttagactttttatttttctaaattttattaatagaccattccaaaaagtatttatgaaaactaaacctttcggcaacgccagccgagtagctggtgtggccaaccatggtggcgtggccgaacaacatggtcacgccaactgcgcgtggtgcgcgtggcgtgacaaagtttcagatttagaatttttttttgaaatggtctattattaaaaaataaaaattttctctatggaggaatgaccctgccatgtagcgccatgctaccgacgcaaaaaatgtttttttttaagtgcgcacatgataatgtgtatcgccacacaaatattcaccttgacattcaatatatatataaatggagatataaaaacatttaaacaaagaaatactgatgcgtgttgtttgtgtgcactattcagggtatgaatttgttttgttttctctatgtatatatacatgtacgtagaattttgagttggttttttgcgaggtctcgtacatgttatcgtgtccacagtatattttagtgtcgataccacagtagcaatgaacgcgctatgcagtagtacacatgagattctgttgctatggtttgagggctacttatgaatcccaaagtagtttttgtgtaatacaaagtgcatccggtcgtaatgcttccgcaataaaagattaaaataaaacaaaaaggatctctatatattattcatgtaaaagctatatttgcaaagaatatgtcttcttggtactcaacaatatgtgtgatttaattatcttccaaattatgtaaatcaagcagagttacacatgcatgaaaactaagtttcgaatttgtcataatagtacagaactatgttaaatgaaagctctctatatatctgcatgttcatataaagctatatatgcaaggaattttactttttcattagtagtatatgcatacataaaagatgtgatagataaaacattaaacaataaaatattgaataaccacaacaacccaatcaaacaaggaataaatacgtgtcgaccaatgattgaaccacacaataaaaaactatatctagccgtccctctcataaatgcaaacataacatatctttaggacagatcaatcatcgtccacacattgaaatgtggacctagtgacatcaatcaatccgtggataggtgttgccgacgggatgcgccagtaatgacggaaaggcattcggaaaatatttttttctttagaaagaaccccattccccacggtaaaaaaagctgacaacatgatatagcatgatattgtatcctctccgggatacggcagcggcggccggccaaaccctaagctagaacagcagccgtatatggcatatcatgagaaaagcaggaaaagagagatatggggtaaaggatttatgaaccatggtctcttcccccctctatatataatgctgcatccaccaggctatggtcacacaccaccaatcaatcaaagcacacagatctgagctagctagcgcccacctttcttctcccactccggcggcacatctccgccgccggccggtcagccggcagctagtggctctctcgctcctatgtggctatgtctgtctacctaatggttttctgttttcttggttttgggtggtggcagttgacagaagagagtgagcacacagcggccagactgcatcgatctatcaatcttcccttcgacaggatagctagatagaaagaaagagaggccgtcggcggccatggaagagagagagagagagagatgaaatgatgatgatgatacagctgccgctgcgtgctcacttctctttctgtcagctctccctgcagcatgcacgctgccacagccacactctctccattatctaactgctcctttaatttcctcttctctctctctctctctggactcgcatcgatctccgatgagataagagcatgctgctgctgctgcaacgcggtggtgataaagctaggcagcgcgggacctcgtccttatcttgtactgcaggtttgggggtgagccctatacgtgccatgagctctctgaccgaggacaaggaggaggagggaggagacggctttggagactcttattttggcatgagctactatacatgggctttgccatagtagtagtatactccttttgctcttctctgcttttgcaggtttttgtcttggtttcccagagatctgggggaggacgacgacactactacagccagccagcctcgggggaataagctagggagcatcgcgcgtgacgatttgattaattaacctgtataaattcgagtgctaatttgtcacgcgcgattaattaacctcgagtcgatgggttaatgatgctgctggtgagaaaattactagcggatcccaagatctgcacgccatatggtacttacccgctgtgtgttcttgctgctagctagctgctagctgctagctgcttcttttttacaacctctcttaagaaagcttcaagcttgtgtgtttttgtgctatcatctcatgtgtgctgctgcaaagggggagaaaggacggccatggcagcggctagctagctgtgattattggagaaggttgatgtacactgcagatctggcaacctgcgcacctgccccagaagagaggagagcgtcagtatagcggctggcccagatctggaaactgcgctgtaaacgtatgtatattggttcgtacttgttggcttcgagttggagatcgatcgatctgatcttatatgttgctctcatcgattgatttctgttgatagaagtttcttgaggttttctatttgcctatttgttgtgtactgattgttcgagtctgaaagtggttgcttgattctaactatgccaacattcatgtgcatgagtttttttttcctttttcaaatttatttttgaggaataatgagttttgctgttaattagtacttatttctttggatgttcttcgcacataagcagctgcttgttatgttaacaacttaagatgaataagattctttactgcgaaaaacaacctgttcttggttttaatgttctttattatagacaacactatatatgcacacaaatccctttactcgacctatagaggaccgcaatatatatgcacaaatcagctgggtgggagattcttattttatgagatgagatatgatcttctcagttacatggtgatgattattttctgcggatttgtatggtttttaatttgtgtggagatttaatttctagctaaccaatgtttaattaggaacccataagcaaccttagttaatttacacatgatgttattttcgaagccaattaagatcaaccatctatcttttttgctgcacactaattcaacttttctgtaggttctctcccccaatcaaagagtttttccaaaggttctttccccattcaaaagtaaattaagtaggaaagcaggtggtggtgtttatatatatcatgggcaaataaactaggggatttaataccgggagtataacatatatatttgtaaaacttagcttttctgaccatccctttatttcatattgacctttaaccatcctaattttctaatgcaataggcattttttttgcatgttcttcagaaaaaagatgtataagttctgctcatggatttaatttcatgtggtcccttggtcctgatttatatcccaactttacatcaggggttgagtagaattttcatttgtgttctatatactcaaattggacactttatacgagctcccatgttaaccaggaaatctggtcgttgatcgtctacacatattttcttatttccatctatacatatgtattttttcagtgctataacttctttgctcgaatttgaccaaatagtttgaagtcattaaatatagcatagctattaatgtgaaggtttgcatctaccagcgcaataagtaattttctatttaactcagtttctcattaatgttagttgctgaatagacttttacataaatcaattgagtgtttaattatctataacttctaacaaattaaaaacaatgaatgaaaagtttgtaagatttttttagtatgtgcggtagtgctgtaaaatactacttaagcaacatattgagtctaattaattgggctaattgagtacttcgaaagagctctcacatgcattaataaaaaatagatgtggccctttaatagttggatttatcatatattgtgaacgttgataatattaagaataaagcggtctattgaaaacatcatagattctctttagtttctactaccatgaatgctttaggattagtaattctttagaatcaatatattgaatatagagttacctatcttggaccttaatttgttaatttagtttcgaaatttaaattcaataatcagagtgttgtaattgacgtagctagtctcttctaattctaatctaactaatttattatatatataattagaatttaaataattataatataaaaaaaataatagctcatgcaatgccacgggatgctgactagtcattatatatgagccacttttgtggcctacccctccgtcccaaaaagatccaatcctaactacgaatctggacacatgcgtgtccagatttgtagctaaagtttatttttttttagacagaagtatgtgctaaatgttctgtggcattgtacctgtcgtcccgctgtatgtaatcgcgtgtatgtgcccctgtgtgaaccttgatttagaagtacactagcagtgttccttttgtacctagtctttctgcagtagtgattgctccatacaaatcaaattcacatgattggatgatgagtacaatatttgtacaaatattaaagagcaaattttgcaaaacaacaaaaatcttgacagaaactatgacataactacatcgtattaaagccacagtaccataaattaaactatagattaaaccctgaatatattatgactattttttcagccacacggtaccgtaaaactatatcttttagcatcagattttgtagcaaaactgcatattttggaggttagatccctggcactattgtcctgatatctatatattgttctgataaaactagcacttaatgtgtataattctttgatactatggcgtttatcagctgcgcctgtagtttgtatatgcgcatacaccatttacagaaataatgtagttttggttaatttgattttattcataaataatatacatacaggaaccaacagcaacactatatataatatatttctaaatgtagctagctaaatgcctcttatttagccaaatttcttggctgtgtgctctatgacatagatcggggatcatataaaccatcatttccattatttgaaatatatacttattaaatgccttgaaacataccaatttcaaagggttccgatatcgtagcatgtagctagtgattcgtacgtatacagcagtaaaattgtcttacgatcgaagttgaaatgttggtgctgaatgctcttacacctgagaccgatctctctgctgtgtttggcaaatctgtattttcttgttattactctcagcgtataaaacgttcttaacaaattgagaagtatatatgcacgatgatctctatgtatgcatctgtataagctttattaattgttctttctccgtttcgtattataagacgctttaacttttttctagtcaaaatatatattttaattttaaccaaatttatattaaactataataatatttctaacataaaataaacataataaaactaatttatatacatatatacacagacacacacactgctatatttatcgataaacaagatcaaactttaaaagaattgatttaaatcaaaacgattaaaatcaaagaaagtatcggtcaataaactggtttttgctgctacgttaacctgctaacactttgccgcagtacagataccgatcgccatgtggatgtggtcagcatgctaataacactttgcagcagtacagatatcgatcgccatgtgtggatcgatgtgtctcgctcgatctcagctatccatatgccccaacaacagacaatctggcacgtgttggaaattaagtctggagatggacatgtggagacaactgaaaactctgaatgcatgaaacatgagtcaggatcacctttaattttttggtccctaggagtatgtaatgtgaatgaatgattgaatgattgactgatttccaccatttgtatgccgacttttgtaatcagaagataatatacagtatgagtaatttgtagactaataatatatactactaaaccattgttcttttgttgcaatagtgtgtaatataaattcgcagcatgttctagctagcaaagttactaatacaaaaaaatttgtttccccttatcagtgaatatccgcgtgtctatatcaacgcatgcatcagtcgtcccatcacaagactccaggcgcatatagacgatgtatcatctatatgccataattgctgtgatcttaaccctacaaattattgtgcagtgggtaccgtaccatttcatattggcaatcaattgaccttttgatcgggcatgagtagtgacaagaagctgccgctgaaactctgtattaattcatcctggatcgatcctatgaatgtagcaggattatttgtgctgattctgcatcatgcattagcgtatcatatagatgtcacagtagcattactgttatgatcgatctttcttatataacggaaattaaatggtttaattacatctttgatctcgccgatagacatacgaccaaagtaatgaagcttgcaagtcttctgaaccccataaaattatcagacttcagagatacattcagagcatgtactaaacgaaagagaaaatttctttaatgcccttaaaattttagccgatcccttctatgtctctgaattttcttcactcgcttgtatacctctgaattttgatttggatctcttccatacccttgccgtcaattgatcgctagttgaccatttaataggtatagaaaagttagttttgcccttcaatacgtgaggaatatgtagaaatttgtaaactatattgttggaagcatagaaatttattgtgtgattataatattcataagcttgttgtacatagaaattttaataaatattaaaaagtatgtgtagcattttctttaaatcataaacatagttttgaaaagcattcctatataatatataggacaggaaaaaaatattgaactaccataaaaaaatgctacatataatcttttaataagtaaataaatattagtttttatgtcattatgtaaaaataaactttgtcatgaataataccttgtacaataaaatcatgaatataatagtcttatataacaaaattatacacttccaacaatatagctagtctacaatatccagatttccttcatgtgtaagggcaaaatggtcattttcataggaattaaacattcaaataacggtcaactaattgaatgggtatgaaagggatcaaaaccaaaattcaggggcatacaagaaaatggacaaaactcatagggatagaagggattggttaaacattcaggggtatagaaggaaatttctctaaacgaaatggggattctctacaggaggacaatgataaggaactaggtcccgatcttctgatatatatattgataactctcaattaaatggcggaaacttgacacacatgatccagcttccgatcaatataattcgaaccctacaatcaaagcaccacatctcctttggttatcaaccgtgccctgcccagttgacctcatcgagaagactaatccctacatgcgaatcgaagaacacgagtaagaacaaggtagattattgcaactcgattgcatatgaattattaagcactcgaatttagggttccacaaaccgaacaagcgacaaaactgcaatgccagaaataatctaagcaaaaccaagagatggcgtaaaaaatagagtagattagaaaaaaaaacttaaccggtaattaacacatgcgaaattacttctttaccatgcaaaattttccaaatctacccttggggaaataatactatccataatactcagtgtagtagtggcggatatgatccgttggatgcaacgaatggatgatccatgtttacccgagggtacagtaaaaaaatcctttttctgggcggactatgttgcaagatggccagttgcagtgagtgcctgaaaatgcatgatttttctttggttgcataggcttgaacaaataaacatgatgtttctctcattctgtgaatgaaaatatttaacctgtattatttgaattgatctctagtgcatgatagggacggatagactcaggtcagaatgaaatgacatacagtgcatataagagaaaggtctagtaggcttaactctgcccatgtgtccagctagctcattgcgacaagaaatcttaggctgtgttagagaaaggggagatagataagattgggaagatacgcaaaacgaggtgagctattagtgcatgattaatcgagtattaattatttcaaatttcaaaaat

SEQ ID NO: 70053 - DNA, 719 bp, Oryza sativa
ctcctttttgtatttgcatttccaattttatccatcacatctagcaacacctgggacactggatatcctaaatgtgtaagctgaatattgcatagaaaatgacattgcatttactagaaagtataaactagaaaggcagtacgaaagtatggatctatgtataaacaaacacatcattaccaaagtaaagcatagcactgcaggtcatgaacacattttaccagaaaaaagtgtagcaatgcagatgaacaaatcgaagaattattggagaaacccaagcatataacagaatacagaatcttcagatcaccctaaaagaaaaaaggtttaaatagttcccagtgttaccataaattcatattttagtatttgcattaagcattaactgcatgtagggagtaagcctgaaatggcactacatcctgtcatcgtacaaatcaacatggcatcttgctttcaacttatctgtcgtctggtattatgaatcacaggccgaactacccaaagcaagattcacagaaagcccaaacaaaatccgagcaaaactcatatgcaaaggaccagctggtatgttggatggactacacatccaaggaatttacagcataaagcaataagaggttgcaaacagtcaaataatgctcaaatcatctcctaatacgatccaatgaaagtcagtgtagaattttgatggatgatcaaagtggtctatttcgact

SEQ ID NO: 70054 - DNA, 740 bp, Oryza sativa
aacctcgagtcgatgggttaatgatgctgctggtgagaaaattactagcggatcccaagatctgcacgccatatggtacttacccgctgtgtgttcttgctgctagctagctgctagctgctagctgcttcttttttacaacctctcttaagaaagcttcaagcttgtgtgtttttgtgctatcatctcatgtgtgctgctgcaaagggggagaaaggacggccatggcagcggctagctagctgtgattattggagaaggttgatgtacactgcagatctggcaacctgcgcacctgccccagaagagaggagagcgtcagtatagcggctggcccagatctggaaactgcgctgtaaacgtatgtatattggttcgtacttgttggcttcgagttggagatcgatcgatctgatcttatatgttgctctcatcgattgatttctgttgatagaagtttcttgaggttttctatttgcctatttgttgtgtactgattgttcgagtctgaaagtggttgcttgattctaactatgccaacattcatgtgcatgagtttttttttcctttttcaaatttatttttgaggaataatgagttttgctgttaattagtacttatttctttggatgttcttcgcacataagcagctgcttgttatgttaacaacttaagatgaataagattctttactgcgaaaaacaacctgttcttggttttaatgttctttattatagaca

SEQ ID NO: 70055 - DNA, 5796 bp, Oryza sativa
  unsure (1)..(5796): unsure at all n locations
ggcgaggatgacgacgacgatgctagaggaagcctaattggagtagattaaacggatgggttagggttacagccaaaacttcaccaacacaattgtatggaagctcaccggcgacgcgaaggcgatgacgacggtggcaacaggaggcggcggcgtggcaacaggaggcagcggcgctaggactccaactaaaagaaaaaaaaagaaaaacaggggtagggtggcttatatatgggtggaggtaaaagaggtggggctagagtggagtcatcagaggggagggggagttgaactcggctcggcaggggagagggcgcgcgcgcagggaggtggagagagggggcggcggctgaataggatagggagaggggaggaaaaataggaataggaggtcaggcagagggctttcctaaaaaggaaaacaaatgcgatgccattttagaaaaagaacggaaacggtcccgcgaacaaaaacggacacggttcgccatgcaaaacgaaaccgcggacaaagaggggagtgaatcgggcacgattcacgaccaaaggctgaagagaacagaattaattactacaaatcttgacaacttaattagcaacattaactccgatgctctgtaaattccgctttaagtcctgttaatgattttaggagcaaagagaattcgaaaaaaattctccctgacaattccaattattaaatacattgttaatttaggttttctcctggttaaccaaaataatttctttagacgaattattgttgaattggaaccacgggaaaggggaaaactccggttgtgacaacaagtctctaatccatcattaaaccagattataatggcattcgccaagtctaggacaacaacagaaaacaactggatgtttctaacagagcattgctaactgtaattctaaaatttctaagcacatcatatggagttctcactagctggtttttgttacctagggttatcaaaggtaattacataatatttagtaaataaagccaaaacaagaaaatataggaaaggctaagtaagtaaaacagttatagtgcagtaagtttaataaagcgaatgcgataattcaaattaaaatacatttcgcatattgtggtgcaatatgcttaaggagaacgtgacttgccttgctcagagaaaaatggtcttcggaggcttcatagacgaactcaaattgcaccacaggaacatatgaaacaacaacaactacacccaacaaaagaaggctaaatctctagaaagaaacaaagatagtaaaagaacaacatacatgggttgtttaagttataacaaaaattaagcaacttaaacaaccaatttggagctcatatggctgagaaacgaccatccaaaattacacgctatttaagtggagattttcatgttatttaattagtattatatcattaaattatgtgcaatgcaacaacgctctaggagagaaaggatcgttccactggcaaacgaccatatgaaattatatgtcatttaagtggagattttcatgttatttaaattgtattatatcattatattatatgcaatgaaacaacgctccaagagaggaacgatggagttcctactggcagctgagacccatgggtcagacgactagcttaccgtggatcgggtttaccgtggctccgtccccatcagctgccgctcaggccgagctcgtgcttgtgcgagaagagagaggggagagagaacgtgggacccactagatggacggccggcttgacgggctagagttggccagcgggtactcaggtttggctagccagatggcttagccattcagttggagagaccgttggagtatgttttttttttgtcaaaattgctaaaatttacttggccagccatttgtctattctattcgagttgctctaagggtgtgtttagttcatgccaaaattggaagtttggttgaaattggaacgatgtgatagaaaagttggaagttcatgtatgtaggaaagtttagatgtgatgaaaaagttggaagtttgaagaaaaagttaggaactactccctccattccaaattgatctacatattaggtacactaagaccaataaaaactaataactctcttataaaatatttactctagcaaaaactcaacgcatacaccattctcactatttcctagccaatagcaaatcaagatattgtatatgggttataaatacttgtgatgcatgcatcaatgtccatttactctaatgcacaaataactaatagtcttaatgaatgaacacaaatatttagatcatttaggaataccctaaaaaaaactatatgtagatcaatttggaatggagggagtaatcaagacctaaaacagttagtggcgacgccgagcgaggtggtggcatggtcctgcagcgcccagggcgacgccagtaggcggctggaggtggtgcagcggcggtggcacttgagcagcagcgcacggcgtggagaggcacgggctggaggcagaaggagaagaagggaaggagggggctccatgataggccgggaggacctaggctaacggccggggagctcgttggccggcaatcaatggcggcagttcgccggagattaaattcagcgaatagaggtcgaaatgaaaggggaaaacatggggggaataaagaataggaggtggggaaccgatttttgcaatcaatgtggaggagaaacggccgaggaggcggatcaactcggtggcggctctagggttacgcggccgggaagaggagcggtcggcagctggaggaagacgacgacacgtcgcctccctgggctggctgggccgcgcccgagcgaggtggggagggaggcccgagcgagaggaggaggatctggccgtggcagctgcggcccaagggagagagggaaggagaggatgggaaaaggaggcccnnnagagggaaaaggtggagaggaagagtctccggcggcgggccgagggagaaagagagagctttgggccggaaaacggaaatagcccaaaagagaaggaggatttatttttagttttttcattttaaattggtttttgttgctttaaaaatatttaggtcgctctgaaaattcaagtaaaaattgagaagatatttagagcatggagaatttaataaaaatacacaaagtaacatttgaatttttcttgtccgtattgtaatgttcaagatttgttttagacttttaataatttcaattatttcttttataaaatgatttttaatttgagattaatttttcaggatgtgacaagcttcaactagctgccatcgatcaagcctcctatctgtgttgggaagcttcctttctcgttagaattataacacaactattgaaagagcaaaattgttcttaatttaatttcatcaatttggttgtatgcaactgaattgactaatatatcacgttcaaatagtttgaaactcttttagcgtgtattttgaggtggagtccaatatatatggactttttaggaaataccacgactactatagaatcaaatttttttggacaataccccctaagtaccaccatatgtaaaaatgggtacctggagggcagttcaatgatcgtttacgaaaatcaattttgcgcatgagagcgttttaacatgcccacggacaaaaataaacctagttttgcatgccgtcctttcaagatgaccgcatgcgaaaatacccttctctacccctccactcctttttctctcccacttaagtcacgtctagtcacgtccccatgtctccctcttctcttcccattccttctctcccctctctcccattccctctccgctcctctattgtctcctgcactccctctccaagtcccgacgagggtggatgagggcagcgggtgagggctagagtggtgggctcaggcgagacaaattccaccggtggaggcgacgggatgtgcagatccggcatccctctccctcccgcatgaatattgtcatcacttcgcccacacgtgtgagaatacggtgatggctttgagcgacaatggatcctagcatgatgaccatggcagcggatccagccatggtggctgcagcggattctagggtttggacttttggatctagggtttgtggatttttggtttttgccaaaattatttttgtagtcaggtggcttatgcgcccgcatgtgaaatagaatttttgcatgtggttgattttcgtatacaggtggtgtaggtgggccacccacccgcttgcgaaaattgattttgaccgcatggaaaagttatttatgtagtagtgtactcatatcattttaaaatataagatgttttggttttatcttttatgtttatataaaaaaatattaacatatgtaatgcaaaattaatttcattaaatccaccactgtatgtatttttataatatattagtttggtgttaaaaatgtcgtgacgtattttataaactgtcatacttgaaagaggtttggacaaacccaacacttcttacatttctgaagtacatgttgtttagagtataccctttacgatagttgagacttgagacaataaagactactattaagtattaacctatcaaaataaattgtgttactcttctttcctttttcccacactcatgtgtcaaaaatttattttctagagacttatttttatatttaacatcgatgtttctgtctcctataaatgacggagccaggttatgctttggtggtgcaccagaaccaccctaaatccaagatttctcctactcgtctctttaattagtttcagcaaattttctggttggcaaggctaagaggccctaagcacatgcctttagtgggtggtattaactactccctatagttatctacgtcatcgacatcagccgttggatgaaatctcaatggtttggatgtagctaaatcccaatggtgtggatcaaaatagcccacacgagatagcccatgaggctagttccaacccaatgactaatatgatgtccataccattaaataagttgacacctagaataaaagatgacgtggcaagtgaataaatgaggaaagagaagaaaatcagatcttgcatgagacatggtttctatacaacatccaaaacatcatttgagataagtagcattaaatttaagtatggaacactagtgtttgcattgaaacagagtagtgtctaagggcatgtacaacggcctttattagtggtctctctctattgccatgcaaataaatttgatgacatggaagaaatagaaagaagtatggttgttatgcatgacaacggctcagagtcgactcttagcatttattagagtaaattttgttgcatggtggtgaaatgaaggaaagaaaagtaagaaaaagtatttaaatatattaatgattagagatcattctaactgttgtaggatgctagtctctaaataatgtagagctcatgtctgactctatctttgtacctgccctaatactagttagttttttttttgatgatgtggaatttataaaaattatgtcttggttgggactggcatgagcccattcgtgcgtagcactcccctgatcccttctcctccctagtccccaccctaacctccgacctaagcgcgctgcatcgtcgcccacggcaggcagccccgagcgccgcggcacgaggtcgctctccctaattccgcagctcctagcgctgcatcgactattcgcctcccctgcctccagctccgcagcgcccgtcactccctctcccgctctgcgagaaaaggaaaccg

SEQ ID NO: 70056 - DNA, 1853 bp, Oryza sativa
ccgtacgtctgacgaacaccgttgcagttatccgacaagagaacccaggccgatcagagagttgggtcaggaatagagcacatgtcttctttcaacgagtggctgaagaaccgaattgccaggttgcagaacttgcctagtgaaacacttccgtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgagccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcaccctctagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgcgccctcctctccaccgccgccctcgccgccgccaaatccgccgccctctccgccctctccgccaccctctacgccctcctctccaccgcctcgacctcgacctctccgccaccatctctgccgccgccctctacgccgccctccccaccgccgcctcgacctctctgccgccctctccaccgccgccgcctcactcactctctcgaccgccgccgtccatctccatcgacctctccgccgccatctccgccgccctctctaccgccatctccgccctctacgccgccctccccaccgcctcgacctcgacctctccgccaccatctctgccgccgccctctacgccgccctccccaccgccgcctcgacctctctgccgccctctccaccgccgccgcctcactcactctctcgaccgccgccgtccatctccatcgacctctccgccgccatctccgccgccctctctaccgccatctccgccctctacgccgccctccccaccgccgcctcgacctctccaccgctgccgcctca

SEQ ID NO: 70057 - DNA, 9236 bp, Oryza sativa
cctctgcctcccgcacgtccggacctctgctgttcggctccggtgtcatcgacttcgccggctccggcgtcgtccacatggtcggcggtgtcgccgggctctggggcgcgctcatcgagggcccccgcatcgggaggttcgaccacgccggccgatcggtggcgctcaagggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgtggtcgacgtctgcaacggcctcctcggcgggttcgccgccatcaccgccgggtgcagcgtcgtcgacccgtgggccgcgatcatctgcgggttcgtctcggcgtgggtgctcatcggcctcaacgcgctcgccgcgcgcctcaagttcgacgacccgctcgaggccgcccagctccacggcgggtgcggcgcgtgggggatcctcttcaccgcgctcttcgcgaggcagaagtacgtcgaggagatctacggcgccggccggccgtacggcctgttcatgggcggcggcggcaagctgctcgccgcgcacgtcatccagatcctggtcatcttcgggtgggtcagctgcaccatgggacctctcttctacgggctcaagaagctcggcctgctccgcatctccgccgaggacgagacgtccggcatggacctgacacggcacggcgggttcgcgtacgtctaccacgacgaggacgagcacgacaagtctggggttggtgggttcatgctccggtccgcgcagacccgcgtcgagccggcggcggcggctgcctccaacagcaacaaccaagtgtaaccaatccagaacgaacgacgtcacagcgaaggaagaaatcacgggtttctctccctctccgatctcgatcgtcacgtcataaatttgatccccatatttgattgccagtttctgtttgggccaaatgcttttgccgctctctctggtgttgcaagactgtaaaaacactgtaggatggacgagtgtctttcacttttgctgggcttctcttgtgtacaggcatgcgtacgtgtcttagaatgtgtggtgtgaaggtgggaagaatcagaggttagggtttaattttcttttgcacaatggttactgctattattgttttattttgtggtcgaattttatcgtcataagggtgtggtggaatggtggtcaagataggtggctgtgcagggctcaaagactttgcgtgggtccttttgtcctgcagtgctctacctctctatcaaaactttggcttatttcctggaatctagtggtttgagagtgtttgttttatactcagttctgcattatgtttacgatatatatttttttttaccaaaagcatttcatttaaactctaccgagagtacttgtttatgctgaatcagtacatctacactgagtgatatttagagccttatactaattgaagattaaatagtcaaagtccatgtgcacatttctactcgccagttagtctgaaagaaaagattcctgtgtgcaattgtgcatatcagcatatgccacctggcgataaagtaaacatactatagttgtgaactgtgcgatgacaacgaccaaattaagcagcctgatctttacaacgaccgctgtatagagaacagactatatcaagttttggtccgctgttcttcttttgggattgtgaagcatgaaaatactacagttttgcatttctttttcccgtaaatgtggaatgcatctcgatatgatatggctattttagcaattgatctgtctcctttttttttcccaaaatacaattgatctctcatctgtcgcacacagccacgatatggtatagagttaattttggcatttttggcaatatagcacattactattatccccttaaatattgtgatatctgtttttcaatatatctgctcgttgcactgattagtccgcaaaatgaggtctgcaaattgctcggtacagcttttgactatatatattaggataaacggatgctttctcgtcttgtagttctgaattgcaatatgttttcctctttttttaatcgacgacaatatattatccattcaatcatggtctgtagtaccttcctgcagtacactccctacctgtaaatttcaaacatgtatgcaccacagtacatactcctacatctctctttcaccaatgctgccaaataagacgctaggagattgaaagagattggatagcacaacatgcgcttgcctcacctctctcaccagtcaccactcacgacaatacaggttgatacgcacggctagcactgatccgcaaacaccccgcataattaattagcaaagtagccaatatcatcaggtgagtacgttactaatctgactgcttgaatctgtgacaaagaagaaacgactggttgggggggagagaacatagatcgagacctatagctatcatatcccaccgtaagattcccacactgcgcggctgccgatcaaaaggctgtggaaaaaactaggaataattgaactttcgcagcactgaacgtcaaaaaaactttcgcagcagaagatataaaatgagtgtaccgtatcgttttcacgacagaaagccgatactagtcctctatattttactcctgttatgtatgcccacgatcgaagttccggttaatctctccaagctaatcagtatacggtcttatcaattgcaaattgagatttttttttacgtgaagaaaactaccttagatactccctttacctaagcgcgcacgggtacggaaaaggacacgcgcgcacttccctcgtagaaggagcaggaggatgagcgcggccgcaaagctgggcgcgcaccctttgtgatgtcaccgcctcacgagacgggcccgaggaaatcggaactcgaaaggcacgccacactcgagcgcaccggcgcgccaccgctcgcatcgcgcggacggggggaagcccggaggcggacccgcgcgcgcactcagctcggcggtgaccgagccgcgcccccgctcgcgtctcagtcctcgcctttttttttttcctttcctgacgtctcagaatcaggagacccgagcgggcgcgcgcgcgccgcaccacacgtccacacggctcggatcagcagctagcagcagcagcagcgcgcgctcccctgcgaaacgggggtagtctcgcggtctcggtggatcacgaggatcccgtcgtcaaaccgtcgtctgccgcccgatcgactgcccgcagccaaaggcaacgacacggccgacggcacgcgacgtgagcaaagtacatatactagagtatactagtcggggtgctgcgtgagcgtgatgcgcacatcgatgtgattggtgtgcagccgcgcggagtcgatcgcatacttgcatgcatgcatgtacacgatcattgtttagcgagaagataatgccgcgtatgattttcggagagataataatgtctcgtgatacaggcgtacagcgctctgaggttgtccctacctctcgtcgcgtcagctagcgggggagcaggatcctcccatccatgtaggtacagttgggctgggaagttgtttaatccatcaccaagatctgcccgtacaaaaaacgtttgaaactcgggttaagataatggatgatcgagcatcgaaaagttcccctttttgagcgggcgggagcgacagcttttacgccccgaaagattagtacacgtaatttaatggctacggtggtttctccgttttttaacaaattggtccttttcaaaaacttatttcaaaactaatccttacaaaaaaaaactttaaccaaaaatagaactcagagccatggaccttagcgctaagctcgaatccgaggtggtaggaatttgctaagttgtttggtactgaggttctaatgatttaaattactgcggaggcatttagtttaacaacccaccgatagtatagtggtagtgggcttctactctaaccttatggagcagggttcgatccctcatctctcccattttttttcttttcttctttttcttctctctctctctctctttattttttctttttttttcttcttccgatcccccatctctcccttttttttttctttttcttcttttttcttctctctctcgctctttattttttttctttttttcttttttgtttgtctcgtgatactatcttcaaaagatatgtttaagttgcaatttttttgaattaggaaaaaatattaaagtggtatattatatggcaattgagaacttaaactgaaatttcaaatcaaattcaaaataaaacaaatttacaaacgaaactgtcattttgtaaagaataagagtgagtagtcgagagaaaaaaaacttattttgtaaaacatattaattttaaaagaatgctatggggaagagaaaaggaaaaaacccaaaatacaaaaaaatattaagtattaattttaaaagaatgctatgaggaagagaatgctatgagaaagataaaaggaaaaaacccaaaataattttaaaagaatgctatgaggaagagaaaaggaaaaaacccaaaatacaaaaaagtattaatttaaaagaatgctatgaggaagagaaaaggaaaaaacccaaaataaaaaaaatagaaaaggaaaaacatattaattttgaaagaatgctatgagaaagagaaaaggaaaaaacccaaaatacaacaaagagaaaaggaaaaaacatattaatttaaaagaatgctatgagaaagagaaaaggaaaaaaaacccaaaatacaacaaagagaaaaggaaaaaaccccccaaaaaatattaattttaaaagaatgctatgagaaagagaaaaggaaaaaacccaaaaaaaaaggtgaggtgggataccaggattcgaacctgaaacccaatgcctaaaagcttgagacatcaaccactaggctatcactattttgctacacttagatgcttgcgcctctatttgaatcgtcaggacctcagcgccaagtagcaaattcatgccacctaagattagatgttagtgccaacaatattgacgttgagacgttgtagctcaacgacagggtctatggcgctgagtccacggcctatttttggttaaagtttttttgcagggactagttttgaaataagtttttgaaaaggaccaatttattaaaaatacgggtggtttctttcccgcatccaaccaggatatagaatttgtacgctactcgctgtaggtactacgtactctctcgttctgtgtcacgaaaaggttcagtctaaacaactccaacatcgtgactagaataatagactgaaatcagcggaagaacaggggttggtgaaaccgcgaaacactgatcggtgaacagtggctggaatctgatgttggacactcaaccgatgccctcatggtcaaattctggagtgggacgcacatgccgacgagaccaccggctggaattggaatctgggcgatacgcttgcattgcagcaagggcgcagcatttgttatttcttttttttgcagcttgtacggttgcatcctcacacctgatgtgaccaacgtgtttctgtcccggcatgcttccatcgacggttggtgttgggatcgttgtgtgcccgaagacgcggaggggcaccggttaaactgaaccgacctctctcggtcgtgtacaagtacaacaagtcgcaatgctgctacgtacagtgccacgaacacgaggcaagtgtatggtggcgaagcggccaggtcgagggaaattgcgtaggcgagctgggctgccgccaaaggggaaaacggcaaaagcagtcctgtcttcttgcttgtgagagggtgagggtagctgcatgtgagaagatgatcgcttattcaatactcccccgtttcataatgtaagtcattctattattttccacatttatattgatgttaataaatatagacatatatatctatttagatttattaatattaatataaatgtgagaaatactagaatgacttaaattgtgaaacggagaaaatactagctagggaaaagaaagagactgcatttacaagacttgtgtgagcacgaaacggtgaccattgtcaaaggcgacaacggcctgcctgacttcttatcgttttgttgaaaagaaaaaggaaggggacgtatacggcttgaaagtagagattgcatagtcccaagcatagtgaagtacaggaattggccaggctcgagtacgtgcaagctataacactctctttcttatcgccctttcctgctgtagtattacgctcttatctagttcccaactttttctttaaacttttaacttttttattacatcaaaactttcctacacacataaactttcaacttttttcttcaaactttcaattttagtcaaactttcaattttggcgtggatctaaacacacctacgtataccaaactattctactcctataataactactattcactgcatagtactaaggaatcaagaatttgttcatgataatttcagggtttagggtttagggtaatactcccttcatttcaaaatacaagaatcatccacctttaatccaaatatcaaaaaaataattattatcatcttatagtttggatcatcttaataaatacaatttatgcatccaatataattaaaaatcttaagtatggaagattttaaacataatattttagcgggaaaaaagtgttacttaatagcatgcattcatgcatgccttatattgtaaaacatctaaaaaaagttatgttttatattatagaattgatagagtagcttctttgtactataaaggcaatagcaatgcggcgcatgtatttgtcgaacctcacatgccacatgggctaaggaacggtgatagacacgaggttcacaatgctgtaacctcaagtggggtctaaacaataaagtttttccttttcttttctccacctttcccctctctctccccctttcctcgagaccgacactctcctctccgcctttcaccgctctggccaccaccaccggaccacccttccctctcccatccggcctccttcctcggcggcggttaaggaggtcctcactggcgtagctgcgtagggcagattgagttgtcgcccttcacgaccgccccttcctcgtctactccggtctcctccccaggctatctcgaatccacgcagcggtggcggttgaggagccccaggcaacacgggcaatgagctcaccgacggccgcacggggcggatcgagccgatgacgcccctccccgccccgctccggccaccaccgccccttcatctccccctccggcttcctcacttagctacccccaatccacgcagcagtggcagtggatgagtcccccggtgatgcggccggcggggcagatcgaggacgaccgcccctccctccccacccctagccaccatcgctcgatcaaccagggccggatctagcggcgttggcgcccttactgctctcccctctccagcgcggatcgaagcaggccggatctagcggcgttggcgcccttactgctctcccctctccagcgcggatcgaagcaggtgggaggcatgggctagcgagggcaccttcgtcgaggtcgggctcttcgatgcttcaccacctatgcacccctctatagcgagcttcactgacacatatcgagctcttttctttagtcggacaccgttatcccttctctctctcgctctcgccacgcgtggatgaccactttttctaaccgaactgctgcaaggctctcatgatcaactttggtcacgtgaagccggtgaaggaacggtctccactcccctctcttctccacacaagcgacttatgtacgtagaccaacattgccacacgtcatgtgtgtgcactgtgaatgacctaattactactgcctccgtcccaaaataagtgtagttttgcactattcacgtttaatgtttgactgttcgtcttatttgaaaaaaatttatgattagtatctgtattgctattagatgataaaacatgaatagtactctatgtgtgactaaatatcttcaaatttttcaaataagacggatggtcaaacgttgggcacggatatccacggctgcacttattttgggacggaggtagtaatacaattcgattgtttgtgtttgtcgcgaacgtgcagtggtgtcggagccttggagcgcccactgggaaattaatgggaaccttaacgatgcttcgaaaaccagcaacacatctgtcgtccaaagatgccacactcaccacattttacgccagctttgacctgacatgataaagtgtcgaactgtcgatccacgcatacgtcagaacctacgacggcgctgttccggattgcacgaaattccaacttgtcatgtaaacagtaaactaacctacctatagagtcgtagccattgtaccctactactcctactgtactgacaggcgttgaagtaaacggctgcatgcagctcgctgccaaaaactgcagctctctatacgtagaatccagtagagagtgctgttggatcacacctcgccatcccggttcaacgcccagcggagcaagtctacgccccgatacggaacgtgacgaactgcatgcatcgggaaaaaggccacacgagttattgcaggccggcggcggcggggtcttcgtcttcgcggacggatcgtggattggatccacgccgcgctgaccagaatcaatcactcgttgccaagcgcacgagacgtatcgtacggtcgatggcagcaggtagtagtagtagcagcagcatgtccttggtctagatggcagaagtatctatctctcgctggatcggtgccgtgcggggccgtgcgtggggttagtaatttgcccgcgtgcgcagcaacttttgaacgtcgagctgatgacgaacaggagagctcagcgctgacttgagaaccggttcgtcgtgtggggtctcaggctgtgatcaatggatcctgtcatgtgcagtgaacttcggatgcagaggacagctactgtgggccagttgattgggagatggatgaccggggggggggggggggggggg

SEQ ID NO: 70058 - DNA, 52251 bp, Oryza sativa
aacgggcagactatcttcttagcttggtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtgctccaacatcttgtccaatttatgggcctctttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgcactccgtgggatgtccaacaattatagcttggcatgaaccccgactcaaacaagtggaaataaatagtcctggatgcagaatactccttctaattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataataacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttaaagcttgctcgggcagctggaggaggaagaagacatatatataggggtgggactttagtctcggttggtagcaccaaccggggctaaagatcaccgggatcttaccaaccgggactaaagttacgatctaccaaccgggactaaagatcccgggggggcctgacaggccctgacagcattcgaaccgggattaaagatgagtaacacaaactgggactaaagatcaaatatgcccgttacccttttgaaccgggactaaagatcatctttagccccgggttttattgcatccgggactattgtggaaatcggccgaccgacgaaagatggaagaagcaactttcatcggggtgatgaggcgtcagaccagctgccggattgcttcagggaacttggcggcgatgaggattatggcgcaggctacggattggacgtcgtcttcggcagtggtggtgtagctggcgtctgagcgcagagaagtggaagaacccaccgaagaatttagattcggcgccagctctcgccgtttagccaaagtaaatggcaacggcggagagcatgcgacgagctaggtggaggattggtgaaagatgcagcttccgcttcacggctttggttgccatggccggatccataggatggcttaatatagccgccagctgaactccacctctccaccaaatctggcaatggcgcctccttggacatgggaagggacgcgaatctccaccactattaattcggcacgagagctcatcaggatcagcaggcgcacgcagcgaaagctgatgcagagccggctggaatcgacgccgatgcccacgccgactgcggcgctcgtctttctccgcctccaatgcgcgatggaggcagagattcggtcaagctgagtactccgatgcgcctaccaaccatgcttgcccgagccgtcgacgtcgatcgtgtggtctgccgctacagatctggagccgcctcctcgaccgccggtagctgtagtgcttggaggagaaaggaggagactcggcaatatccaatggacaaagcaatgcacgcatgctcgacagaagaagacgatggactaacacccatacatgccatcatacgtccggtgggcttctacggtactttaacaagccagcccaaaacgcgctacagtagtttttgcgcaccataatttcagcccatcagaatcatcgcatcgaacgcacccctaataattcaggtcaggtgatggctgctgtccgattcctgaatcatattattatcactttgtcggatgaagaaatgactaaaataagatcgatcggtggctaggtctttcagtcctccggattgcttatggtatggttggtggtgagattatgattcgatgatcccgtacccccgaagggcttgtatttatatacctctaagtagaactcagagagggcttcacatatataagatcataaagttggcatcccctccgaataggattctaacacctttgaattctattcaaggggacagtttctttctacattggtcaaattcctcactattaagacaaccttgccgtatactttgtatactgtgtaaccccaaggatagatggtatatatcttatccataaacctaataccccttatttttttttgcttgtcatccaaaaagtcatcagaaaatttaaaataatttaacaagagagatcaatatatgacatatctttccacaaacatgtaagttaaaatttaatttatacgagtagaaacaaaaatagaagttctgactttgaagagaacacataattcacaacagtcaaatttgttattttttttttctaattatataggtcgaattttaacttgtatgtttatgaagtggcatattacatattaaattatattatcaatttatttcaaattctaaattttcatcatcttattgcgtagctcgatcgattgctgcaatcggtttatcagctgtagccaaaatttaaaatttaattttaattatattttgatgtttttcatcgtaatttatattttgatggtattcaattttgttgtcatgcatgttcctaggattgttgtcatgcatacttgtattaaacagaggggcgatcgagaattttactcggtcacaggctctccgacatgtgattcctgaaccaatcattttgttttctaaagtctgaactacttggttattgtacctgaattactgtatgcttcaataatttagggaaaatagatcctcttacttactgggcctggtcggtaggcctgcctggctgcagccagccagccaacagccggtctagtcgctgtaggggcccaacagtcgctacaggatatggaaacgataaggagcgatgcagccgctgcagccgaacggctgggctgtgcagcgcagcctagacagctgcgaaaacgggctgccaaataggcccactgtcatttgattttaagtggttcatacgtgggctccacagcttataagcccacagatgagcaacctatgtcatttgattttgagtggttcatatgtgggctccacagctcataagcccacagatcagcaacctatgtcaaagatcagtaaatcacgtactccttccgtccaaaaaaaaaagggtaaactctagctatgaatcgggacatgcatcgtagctagagtttacctttttttttttttttgaatgaagagagtaggcctgaggccaaaacaggagtataatactagtgtgttttcaaggattttttttcccttctggttatgctgcataggtgacatcatgataagaatccctggagacctcaccattgttactatagttggttttgaccactttgctgttgaatgctttagttgattcgatgttggggcagtacgctttgctttagccctcgaggtatttgaggccagtacccctccctctcgaatcacctacagcagtaaaaaggaaaaatgaaaaggtaaatatgggttggcaacatgaaactatcttctgaaattgtccttagtcggtgcaatgctacactttgtttgattcttaaactgtcttctgacataaaaggaatttgacagccaaacgactgcattatataattgacatagcttaaaatctagagggctctgaactcatgaacaaaacagataattattttagtgctgaaacttagctatccaaggctaatcttgtgtgttcaaagtcagcgccaaaaaaagcagttacatgtaaattattttttaaatttgttttcatgtgtgctgttacatgtaaattgttgtttaatcactaactttagagaaaaaagaagcagtgcgtatatatagtaacgagtttatacataataatgctgaacaggaatcgaacagcgaataaatcagtctattcatataactcaaaacaaagtctgaaaagtataagattaatgtacaagattcaatgatgttaatcaaacaggcatatcacatatttacatcccaggtgaccatcaagcatgttatgtaaaggcaagccatcaagactgcacattgttatgtcacgaaagcaactaatcacaaacaagcaggaactaaataatcttctttttttaggtgaagtgatgcgtacatccttacaaaattaaatatggtttgaatctgaaaattacatccttgctttctggattcatcctactcagattcactgcatctgcatctccttttcactgcatccacatcaggggaaagaatcaagaactcacctgtgtagaggttgatgggattgaagcagaagctggtctagcaccacccacagaaattgacagaacaggtggagttggtgcgacgagcaacgatgagtgcgctgctatgaccgacgatgaccacgaagatcccttggagggcgcattggaagcggcagtgatggcggaggtctgcgagatcactaggaacggcggcggaggcggaggcggcggtgaaggcggcggcggaggcggcggaggaggaggcggtggaggaggcggcatcgaatccatggcggcagcggctagggttcaagccgcaacagcgacgaacttcttcgttcccctcctctttgactcctcgttcctcctctttctgatgctcgatgtgggctgtggtggcgccgccgtacgtggtggactcgccgcatcagcccacttactcctaagtggtttggcctaagtgggtaagtgggtaagtggtgcgggcctgtccagcggctgcatcagcccacgcacgccactgccagccttagttatgcgtgttctgctgtgtgctctcgatgctagttgagataataatttttgtttgctgcctacggccacatatagtggagaaggtttgtgtgaattgaattaagtcctataaaatccgtgcaatccaaaagatccttggtaaaatttacaagttcatcagtctctgaaaatctttaaaaaataattactcccatgacccattagaggataaccatgggaagcgattcgcccttacgtgaattgggtcctatatatgaataagaaagcttgaacaaggaaagtgattgatcgacgtcccgtttgatttattcatcacataagtggacaattaattctttgattttgcctttgatttttttagtgacgtcatgcatgtgccttgatggagagcacgtttgctatgcatttatgcggcacacacctcgtcgtgtactacatacgtgacaataattgttatctacgcattttgttttatcatgtatgacgtcactaaatcatttattatatttattttagtggagtaatatagtactaactgttgggattttttttcttaccatgctacccaaaataagaatgtgatatattatcatagtataatgaatctggataggatatatcctatccccttttacgttgaattattttgggacggatgatgttatgaagtcatacgaattacatacatttctgttgctcaatcttacaaatgatagttatttgttttgcttttaaagtaaccaatgatgcactcgtgttaccaaaatattggttttggtatcaccaatatggctgcgtttgagaggagggtttccaaacaaaatatatattattgcatgattaattaagtattaactaattttttttaaaaaaatagattaatatgattttttaaaacaactttcatatagaaattttttaataaaaaaatacactgtttaacagattgaaaaacgtgcgcgtaaaaaacgagagaggtgagttgggaaaacttagaggagaacacagccatatatcatcatgatagtatgataccaaactaaaccagccctgaaccaatcgatgaatatggtgatataattatatttcgattcaggtagatatactacaatcttttgttttggacggttggacacaaggaagaaaataggatgtcatgcgatgcgatgcgagcgtgccgtggggcgtacggtcgcgcggggggtctttgggttggcagttggtgacttggtggatggatgcatgcagcgtcgacgcgggcggtggcgtgcgcgggagggccgtgcgaatgccaaaccaagttgcggttgatctgggagtaccacacacgaacaaggaaagtgacttgcaaggcggcagatagaataatcagagaacgagagtattaaggtcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctgaagttatatttaggagttggagttgtaccaaacaggccctaattttctcgtcacgtacgtcgggatgtactgtttggtttgcggcggatactaactttaccaactttttttccctaaccgaaataattagtcaacattaaaatttggagtaaggtttcagtttggtttgctatcaaaaggcattgccatgggctattttttatttgactaaaccaaaatatttgacaatgccaatttttctgagaaattttcttacaagtccctaagttttttttgcttaatctcttatatattaaattaaatagttgataaccttgttaataaaagcaactttagtacgtacagtagtgcttgaaaagaagagtaataataagctctacttttgagtaccgatggaagtctatacgaatagtcactactacagaatactcttttggtaccagttggaaaatccccttagatgttggttttcccaaccgacaccagggaggcggcactattgactccccggtttcaaaccggtacctttgaggcgttcgctagcaaaaaaaaaaaaggctcgatgcaccggctcgaattgaccacatccatcccccgcattgcccccaaatctcaaatctacaacatcaacaaatcaaccaacatcatcacaacaaatcaaccaacatcataaagaaattacatactataaactcccgaatcaaccaacatcaatcacagacatcacataacaaacattgaaagaacaatgaacaccaccgctgctcaccgtcgccgtctaccagatctgtgactgctgcctccgtcgccccgaggattcgctgtcaggccgccatcgggccaccacaacctcccctcccatagtcgggccgtcgcctccacgccgtccgccaccgcccctcccctcccgccggatctggtggaggggagggcgccgccacccctcctgcccctgtcgggccaatgccgccgccgccacccttcttcctgtcggatctagcagagggagggtgcctccgggcacccgccgctcctccctccacgcatcgctgacgccgctcctccagctgccgcctccgccaccaagagaggagaaagagaagagaaggtgatcgaaagagaggggagagagagcggatagaacgagagagatcgagaggagacgagagagttcgagcgagtgagcggacactgcggaccttatctcctcgacgttgtgttcgtggtgggacctgccggctcggctcaatttgtaagtgccgacacctaggtttttaaaattaaaggttccgtttttttttaaccgacacaaaatggaataggtgacggtttttatttagaaccaacacttataattacttaaaggtgttgattttttgcgattttaacctgcggaggtgggaaaaggcctataggtgccggttttagcacttccggcacctattgtgccaacacctatttgatgttttgtagatgagtctgtttgttgatcttatctattttttctgaaatatgtactagatggtgagacaggaacggcggagtctggagcggccgcgacgatgcatgagcggtgatgatgggagagagcgcgatgacactggaggggcggcacgggcttgagctagcatcggcggcctcacaacgggcagatccagccctccaacaacgacgaaggggtaaggagtgccggcactggaggaactggatctagcgctactgggacgggacaacgacaacgatggtggcaagccgcgtagtggcagcagccttgggagcggtggggactatttcggctatgacgacgacaatgacgcactgcgacaacgacggcggtggctagggtttcgaattttagaaattttctttttttgctttttttaggtggacggcttaaccgattttcatagacaccttgaggcaggcgggcagcgcagccatttgcaaaaattttgtttttaccatttgtaaaaatcgtttcggactttctgtagtagtggttgctaattacactactagaaaaaacatttttcccaacataggggtctttttttcgcagacggacatgactcttagagccaaatgaccgcctacaaaaatataaatcggggtgaagtttgttgtccgcctgcgaaaataggcggaccacttaagcggcgcctgcgaaaatctattttcgcaggcgaaccttatgtggtccgcctgcaaaaatcgtacctaacaaaaaaaaatccacccttatcttctcctcccacccctcccaccactcaactctctctctctccctctccctcactgactcagtctcctctcctctcctctcctctccctcactgactctcctctcctctcctctcctctccggcggcgcggcggggacggaggcgcggtggcacggcgggaatggaggtgcggcagggcggcggcgtggtggggacggcggcgcggccgcggcatctcccctccctcccttcctcgcagatctggccggaggagggaggggggaggccggcgggggcgacggcggcgacgacagcgtggggcggcggcggcgacgacgcgcgcggggcggcggcgagccgcgtgcggcgatttttttttttcgtttttttgcattttcgcaggcgggccgttgccccgactgcgaacgttgtggtgcaggcggacctccctcccgcctgcgaaaattagttttggtcgcccggaaaaattagttttctagtagtgttattcgtgccttcattgtcctttaggacacatttttagtcgatcggttcatgtgatgtggccttttatccacttgccacagaagcttcctttttgtcttttgcaacgtttcatcgaaagcattttttgttccctttttcctctataccaacgttgagaaaaatggccaactttgccatagatatggcccagaagactgcggcatcgaaataccgaagtaacaagggtaaatttcatcgaagctgccgcttataataaaatagagtccatatggtgtccctaacctataaatagagaagagatcagatcggtttcacgccgtaacctccatggttctatcttgacagtcttacatatagagattcaggaattctccgctcactcgcattcgatcattgtctcggtagaattgatgttctagctcttgtccctccctagaatttctggtgctaaagattgatctcagcgaagaagattgcagatactttcgtttgatgttgacgttttctttccatcgtttcttccccattcgggcgatggccggcctgtcaactgcaccggaaatgggagctgccgtcgtcgccggcgtctgcgtcgtttcggcggccgtcgcagccgccgccgccgcctcaccctcaccggaggctccaccaggtccgtaccagacgtgcgccattatggccttgtgcaccgtgttccatggcggcatggctctcctgatccatggattccggcgagcaggagctccgctgcggcgcccttgacaccgccgccgccgctcgccgccggatatgcgggctagtcaccgcagttcttgactaggcctaagaaggacttggcttctctgcatctacgtcaagaatccatttgataaattaagcttgcattttctttccttgtgaattcttggttggatgcagggaagccaaggcccgcttaggcagacgctgctcctttagtgtttgggaccaaatcaacaagtggtgttctttcgaattgtccgtctaactgacgttgcttctactttgatcttgatggcagtaagaccgatgatttcgaaatgattccactagctggattgcttccaaacacagacggagcaccgtttgcccaagtgttaattagtgttttttatcctactgattttgcgttttattctttgtatttatatatactttctccatttcaaaatatatgacgctattgacatacattagtgtccttttttaagtataagtgtccaataccttttctttaatagtactacctccgtcccaaaataagtgcagccatgagtttccgcgtccaactttgatcgttcgtcttatttgaaatttttttataattagcatttttgttattataagatgataaaatatgaatagtactttactcgtgacttatgtttttaatttttttcaaaaaactttcaaataagatgaatggtcaaagttgggcgtggaaaatcatggctgtacttattttgggacggagaaagtacatgagatcttttgtgtatggtcaactaattatgatgacattttgctatttttagtgtctattgtctgattttgaagtgttacgaaagcacggggtcttcatgcgttcgtgcgtactatacttgtcttgattagtatggtcataggtcaggttaggtcccaaataattggcttccgagacggttgatggcttgatggttgtgtgtaaagctactatgtactttctctgtttcacagtgtaagactttctagcattgctcatattcacttaaatattaatgaatctatacatatatatatatatatatatatatatatatgtgtgtgtgtgtgtgtttagattcattaacatctatatatatgggcaatgttagaaagttttacattgtgaaacggagggagtactaattatctgcacgtttaatttgctactgaggtcaatcacagtgcaggccttacatctgagaaagtacttttcgtgtggatgagggatcgatcatggctattgatatgtttcaattctttttcatgtgtcatgatccctacaagaattgaaaattttcgtgcctctataaggaggtgcatgcctggattgtcctattaattgatcaatggttgacaacaaggaaaggaaacggttgaatgtttggaacattccacccatcgtcgttttcacctttctataagccacagtactcatgatagttacgcatgacttaataattcagcactacaactcagatggacgattattcttacgataaacaaagacaggttgggaatcttgtgatccagacgacatctcattaaacgttaaatattgttttcttccttgacttgtgcccatctgaacctatatatccatctgcagtttactccttccgtcaagaaaaaaaaggcaaaccctgagtttccgtgtccaacgtttgaccgtccgtcttatttaaaaaaattataaaaaaaattaaaaaaacaagtcacgcataaagcattaatcatgatttatcatctaataacaatgaaaatagtaattataaaaaatttcatataacatgaacagtcaaacgttggacaagaaaattcaggtttgtcttttttttgggacggagggagtaggtcacaatgacagtaaagcgcttgaaacttatacccaccagaatccaaagcttgacgtccattttttatggtttgtcaaagttcagagataagagttcttttggaacatatgtataggagttccatcgtttcagagataagagtttttttaatatatatctataaagagaggccgcacctctcccgctttcattaacgaaaacaatagaaatacaaggtttgataggtccaggtaacaattaaacaaaacaaacagcaaaacgatcacagccgacatatcacaagacattgctcccatgcatagacaagaaagaaaagcactgaaagccagcaatcatcatagcatcagcctaggtcatcatcaggtctccatcccaaacgtctgttagctcctctctagccaaaccttgagtgaaagacttcatttgctatctgtttgagaagctgagccccccaaagcaccttttctctgtctgcctccttgatctgcaaattgctccaagaccccaaagtgaaacaaatggtggatatcaattcagtaggatcagttggtaaaatatgatcaaaacaagctctattcctggctttccaaaggatccataacacagcagccacacccaccaggactatttttttttgtattatttccaaagaaattcccttgcccaaacatactaccaatatccttattaggtctcacccccagggcacactcgatcacgcaccaaataaaatgagctacaaggcatcgtgacttcgcgattttagctataggacgccgcacgaagtgactttagggggaacactctcaaaacttgaatatttggtggttgacagagcacccattaaaataatcattttcgattgaagaggaaagagaaatcatgtgaatgttagatctcccatctctcttctctctctatcccctccttccacactgccgggaactcgagccactctgaggtcgacgccgggggcgaactccttgggttggattcgcttggggtggttctcgacgagggtggagacgacgatgggaatgggcacgaagtccattctgctcacgtccatgagcagcctcacgtcggtgaccaggcaagcgttggtggcaaggaggttgtgctcgccgtggcccggcacgcccatcggttgccatgcaaactgcgcctgcaccagcagtgtcgtcaccctgaaccagtaggagccaaacatcagctggcgatcagcggcgatgagatcccgttgtggctgaggagtagggggagcggcgccgccatggagggagggggaggagtggagatggagggcatcgctggctgaggcgagtgcgcggggggggggggggggagaagagataagggtgagggacagatgagaggagataaggataggtgggagaatcgaggcgcgcgggtacactgctctctccgctctgatgggcggtaaaaaaagcacttttataacttactttttttattaaaaaccgacatatataaaatttataggtgttggtgtttaacttttatcttttgtaaaagtcatatggattagaaaatgctctataaatactgattttaaataaatcagcacatataggggtgtccctaatctgcacgtataggggtgtgtccctaatcagcaacatacggaacaagtaagtttatccgtggaaaatttttaatttttagtcaatttagtgattattgattccctgtaatctctagaaaaaacttatctttttatttattttctaagtatagtcaatgcatgtgtaaaaaaaaaggaagtaacttatgatccttccttgggttcgttttttcaatgttggtgcatattcgattgattacagtctcacaggtgcgaatgtatatatatactagaaaaaaaaatgctcatgcgttgcaatgggtaaagatgcttttttcggtgatacaacaactgttagaagccgaacaagaaattgaaatattgggatcactatacactataattgaaaaagttaataaaaaatcattttttggttttggaccgcgaaacgttattacttccttccttttcagccctagcctagttcaatacctccctacgctcggcatgtatttcttcggcccaacacacaaacacgtccaagccacaagcacaagtggagttgtaggcccaactcacatagcctactacgatcttgaacctccagaagacatcccatgcatgcatgatgccggagccgatcctcgtcatcaaatccggccgaatctttctcgatcttctaaaattagttgagggcttttgatccactcgatctcctcttgagagaattcgtaaaaatcgggataaaaaggcgaagctcgctagtcggccatcttcaatggagattaaaaggagaaatcataggaaaaataatgagttaggagtggggaatcgatttttacaatcaataatacgatgaaacgtgcggggagacaaatcgatatcgcggcggtgctagggtttgggcccgggccctgagagcggtaaaaaggggcgatcgtatcggattgagtggaaacatgcgatgatgaaaaaaccggatggataaaaaaaaagaagcccaatcggagatttaaaaaaccgtcgaaaaaaatagatgggacaataaaatatattcaattaaaaccgaaaaccgattcaaatacggatgtacaaaaaattcagcaaaaacattttcaatttttataatagtaaagatagatatatttcttgctaaaaggacacatcagtatatactacactagctacatttttcccaagcactaaactctgagcacgcatgtttcaagactagtaaagttgagtgtatatactgattttacacaaactcgtgtgcttcaatttgtttggtatatacactgatttttgggtagatgccaatttttggtatgtgcactgactttttttgcgcatacatactctgaacttagatacactgaatttgtgtgcttcaatttgtttggtatatacactgatttttttgcagtacacgggaacttttcggtacttattcatggtcatgcaaactaattaatacggtgtattttggtacatcgacagaatatacacggcacacgagacgtatatacctaaatttagatacatgtactggtcagctcgtactgtacagacttcagcaatattccacatacatacctagttagagtaaaaaaaataacttaattaaaaagcctagctagtttcaaattcagttctagcaaaaaaaagggtaaacttcataaaaaatctattttttcagacgcatttatatgggtatataccctattagaaatggtatttacccaaaatatgtgttttagtggtatttaatgcgtgtttaaatagatatatacccaattagaattagaattattgtacgccagacatacccaatatatatggatgttctcaatggatatatacccaaataaatggtacatctggaatgcatgcatctatatacctagctcagtgttacatttggaatgcatgcatgtcgcatgtaccactttttgggtagctgaaaaaaattgatacacacatcgaattggatatatacccaaatttttgctaccttagttgagttggtatatgtagcttacaaaatggaaaatcgttgatacagacacacggagctaaatgtctcaaaaacagcgggcaaaaaagtctttgaacggttaccttattaatatgtacctaaataccagtacagatacctaaaatttatattataaattttcaaaatatttgatttatataattggaaagcataatgtgctaatttagatatgtgtacacatgcataccatactataaatgtaccagattatttataaatttgattacaaaatatttcaaataattagtttttgtatttccaattactaaatacattattttcatattttcaaatatttagattccaagttccgatttatattaccatataccaaccatcttatgtgagcagcttcttgagctttgtgtggattatgagcaggcagtaatgtagtagataggctctgctgaaggccggcccagtggatgcttcccataaaatggctcagtctagggtttgaggctcggctgaaggccggacagtggatgcttgtcgtaaaatggctcagtatagggttttgaagctagtggatgcttgttataaaatggctcggtcttgtgttttgctcctcaattcgtcttgggagctgctccgctagtgtcctctgtagccgccgccgcaccgtcaccaacatcagcctcgccttcgtatggccatgtcgagcatcaggaggctttcgtgctgccacgtgagtaagcttccctagatctcactcttctacctccctctctcaatttctctataagatgggtgtgggattttgtttctcccatctttgcgcactaacaccttattcccttaattccttatacgagagacctaacataattacactaccttggtcggcttctaaatgggattccttcttctccatactgatggtggtgcaaaatagctaaaggtatacataatagaaaatcaacatagtttgtgtatatgaccttgacataatgggtgtatatgacctttaaaatccacatagttaacatactaatatatttttttctcttttacgattttgagcattaggtgtttagatttggcataagactttacatatggatccaacacagacataagtgtttgttttattagaattgtagcattttttaaagttgaaagatttacatattatttatttttagtataagcataaaatacatatatttagaaaatggttatcataattacagagtttaaaggagcaaattgtttacgtcatttacctgtttattatttttagtttcttgaaacataggatatatggtcacgatacttgccccgaataatttgcttgaattttacaaaaggtattttttttgtctttttaattatttttagtttttgaaacatatgatatatggtcacgatatttgccccaaataatttgcaaagaactttacaaaaggtttttttgtctttttaatttttctcccaccccttttacatgtttgtgttagtccgatcaggcattgttgggttgtagtgctgtgtggtccgctacgcacatggagcggctcttcttctctttctcttgtcctcttttttttaattcaccgtcgtaacttgcacgcttgctagttttatacatagggttccttacctgacgcttgtgctgcttgtatcttgccacgtgtcgctttagtaaggatggtaagggcagccaatcagctaacacgaaaccaaccaacatatatatagatagatagaatgcaaaggggaaatatattttgagaagccctctagaatttggatattgtgctttttgtttcttttcttatggatattctctagatttatgtcaaagaggatagataattgggaagtctcaaatggatatatgtcttttcttttcttttggctattttttcttatgcataattttcttagatttatctcaaaatttaacaccgtcatgtggcccaataagatgttcgagacgagccatctttagaaagataagatatctttttctctttggatatgttttgggtagattattttgttgattattcagttcatttgttttggttagattatttggttgattattcagttcattgttaaaaaaaaccccttacgattagattaaatgtaaaggtggtgtttagtttgacaccttatcaaatctatggaaatttggttctttactttactattttatagtgacccattatagtgacctgttatggtcttagtttaatttgcatttcgtaatttaatatgaacaaaatcaatctatctacttctattattgtagtttaccttcagctgagaggcatagcctctcttatttccttaaaaaaaattgcttttatttttcccttttttttgctttttttttatggacgaaggaaacatctcttattttttaagtagtagagaagagaagagatatagcaggaggaaaatacagcccctagggataaaaaagaaaaatgtccaacatagctatacactatacaagatgcggtagaaactcgcgcagacgcttagcactggctagcatccacagcctagcctgttacttgattttggcaagcaggtatttcgatgtggactacatgtggtcgaagatccgttgattcctttccttccaaatttcccacacgacaaggaggatgagggtgcgcagttccttcttggggacttctgtcgtgtttgctagactttcccaccaatcctggactgactgagcggcctcccatagtgcccaagttcaagatgttggtttcccacccagctggctacgaaggtccaaatcctttttaagtagtgacattcggcaatgaggtgcagtgccatttcaacctctcttatgcaaagaggacaacatccattattctgccagcccctggtcgcgagtctgtcagaggtccacactctgttttggatgataagctaggcctgaagtttgcacttcccaggcgcccaaaccttccagatcagcaagttgaaggttgtgctgggggcccaaaacattgggcttcataagctaaagatgccgagtagtgcccatgactggtgagcttccaattaatctgatggggctactcgtcgctcaaatgcacgttgtggaccatagtccacaaagccaaaagctggtcaattagctcgagcgacattagcgggttcgcttctaggtctagatctcagacccatgcgtcgttcttctttccttggtgcaaggattttcttttcttcatagagattgcgtagacaagtggcatggcgtcttttggcctgcgcccatcaacccatggcgagttccagaagcgggttgtgtttccatcactgattgagaagtttgttgctgccgcgaagagggtcttgtcgattacaaagcatctcgaggcccacccaatgcttgctcggctctttccattcatgccataaccaacgcagtcgtaaggcccttgtgaatttcgccaagtttggtacgccaaggcctccctgtttggttggcatgcacgtccttgtccagatgaccttgcatccccctgcgatgtcccccgatgtgttacttctacctctcttttcactatccagtggcaacactttactcgagaacaccacttttagcaatactaatgtgtttttaatcctactcagtggcaatgctaatatgttatattctctcatttcagtttcctccagaagacaagggacctgagggtgctatggggggtgacaagggacctgagagtcaaagctgatcttggaattatacattttggtggaggggtcttcaattgatgcaagggatgaactgagtgtgttttttattagaaacttggttgcttaaaaacttaggcagttctgtgaaatattttttggggggcgcatcattttgccctggcccttggggagtactaattccatgaacttaattattaatatggcatgtttatcttaatgcttgaattaaattcaaagtggctggctggagaaatgtgaaagtttctttgtctagattactgcaagactgcaatactattgttgaatgattctattgaatgacctgccttacattactttctcttccattgactgaccttaatttgagctatacttctgcactacttccttttgaaatgtgccccttaatactcctaaatctgccttctggagctcagttttaatccttaggcaaaccctaagagagtccgtcgcctggcagttggctaaaggccaggtttccatttggagccagccatgatatgaaatttcttcctcaatccatgatcatcttaaccttgactctattccagctcacatatgtgatttaaaagttataagtcattaaagaggttaaaaaaagacatgcgccatactaaagggagatttatatatgggatgaagtggtcttcggttaggatataaagcgctaccgtgcattacctagtcacggcccgagagaggacactcttctggattaactcaacatgtatttgcaatacaaagagtgcctacaaggaaattttgaaaagaaagaatcaatctttactggaggtggcattcgaacggcctacacagaaacttctttcaactctagagaccattcactctctttaacattcacctccaacctttctgacctgagtttctccatcacaaacatctaacccctgccgataacaaaataatctttgacttcctagatgagcttagctatatagccgctcctcctcatgagggccttcaacctcaccagagacccggggaataaaaacaatgataactttgcagcgaacctagcctatgccttcaatgacacaaacaactccttgtttctttttgaattgcctttgccggacaaactctataccaggtcaaacaaaagggagattcccgtgctcgccctgcttgatcgagttttcatcaactactagaataatcttatccaaaaccccatcctgaaaggcctcatttggcagcccgggatctggccgggatcccggcccataccttgggaaaaagccccgctaggaaaatttcccagggccatatttcctgaccatttggaagcccacgaggtggatttttcagacccaaaccgtgtgggatacttggggaaacctcccatacctcacgaggttaggaaaaaaatcctcgttgtggagcctcatcacctctgtgcctcttcctctcgcgggaactccctccatattaatatgtaggaataagttcatttgaggtcccttaacttgaccacaatagcagatacaacaggtccctcaactatcaaaaccggttcagacgagatccctctgtggtttagatggcggttttggctgacgaggcgcctctgtgggccctattgactaggtcttcgagccacgtggcacttacgtagcaattttatccggaaatataataaaaccgcggggctcacatgtcagtcacacacaaaataataaaaatggtggtgccatttggccccacatgtcatccctcttctctctatcctttctctcacctaggcggcgcaggtgacgggcgagatggggcagagcggtcggcctgtgaagcggggcggacggtagccggtgtaggccggcggcggttggagcaagccggcacaagcgacggagaaggcggcggaagtggcacggtcgcctcctccgccattgtacctaccgctgccttcgtaaccacatgttaacgaccaaattttgtaagccatgaactaagttcaacatcggaatcgaagcggattcggcagggaatcatattatgaaaacagagtgcgcatcggctacgagagcatcggctgaaggctgcatcagctacgagggcatcggttgaagactgcatcggctgagatggatcggacagaagatagccgatgtagccgatttcgttgagatggttgtataatcgtctccaggattgatcaacgtgctacgcaaggattgtcgcgatggagataagctcacagataggcaattgtatctattagttaagatattttaaatagtttctttagagatgtgtttcggcaagagtctgctgtatagacttgttcgtatcttagagtttgttagagataggagttgtgtccggcaaggaccagtcatgtatctcgggtataaatataacccgatcccgtgtaatttacaacaacagttcaataacactttcggcgcatcgccacccttttctactttcattgtttcgacgagttcttgctttcgggttgaactgcatcgatttcaatcttcaacaagaggtaaaacttgtcatggcggcttgcgttctcgggattagtgcttccatctttatgatactgtaatcttggttatgtaaatcgtcaagttatcatatatgcttcataatctttattaatatcattacctaatcttaaatcggctaacagctaccacaagaaggtagctgatagagttagatatagttgttaatatagattgtatagcatatctatcatcttttagaggttttcatcaactcgtctagatcttgtatttattcttatgcttaatgctgcatcggttgggttcgatctattaagtaatattcataactacaatatctagcttgtctcatgatcatcggtagagatagtatcggggtttcagccgatcttacctgatttagctacctttattccctatatgtttacttgatatgctgaatctgccctttatattaagatcctattgcattaaaatatattgagcttgatgtttgatatattctatctgttttaacatcttaatatagagttgtatcggagtattagccgatacatgttagatatatttgatcggctatgctatgaacgtatatataatctttatcttaaagtacttttaggcataagtgatttatactatctcgacttgctgttcgatctatcccaatcacttagcttaaatatatttcgagaaaatgattatacatcattgatatctatagccgatcgagtagacttaactttatattgctttattattcatggccgatctaatgtcagttacattggctcaatggtcaacaatatgtcatcggtccttatccgatcggctatcgtttatagatttaacctcgttttctttgttcttccttcttgttgattgcaggatcaaatcaactggcacgcctttgaacccaagagcaagatttaggacttgcactggagttaagcagatctcccaggccagtgtgtgtttttcgcatcaacaccacggtccccgcagccgctgggaagggatccgccggtgagcgcgacgctgcctggcacggtgatgtgcacggccttgatgcggctaaggtcgtcgtcaccgacggcagtgacttgccggtgttgtacaactggatggactacgcaccgacgttgtgatttcgcccgccgctggccacgactttgcatgtcgccgctgctatctcgccatcgctgccaagcaaccgtcgctttctaccgtctcaagccgctgtcgtcgtgtcctccttggcgacttccaccggaatcgccactcgccgctacggaccaccgctgctatcccactcgaatgcgacggtggccgccgtcttctcgcttccccaacggctgctgccaccgatgtcattgaggtaggaggctgaagaggacggcgccgctcctggccctgccaactgctgcaacatcgcgcaaggacgatatgggacacccctggccgcgccggccaccacagcatcacgcaaggaggatattggacaccacccctggccccgtcatccgccggcgctggagtagcggagggccgagcgccgtccctagccccgccatccaccactgacatgagggagggaggaggaggcgctgactcgctgttgagatagagaggagtgtgggaccctggtcccactgtttttttcgaatggtatgtgggccacacattttccaatggcataccgtcgattagaccaatggtatctaggcggttagacctaaacatctacactagtcattccaaacttggttcgcacgtatcagataagttggtgcacagaaatgagtattttataagttggtgcactaaatacacccacatgacaagtccatatacttcaaatgcagcttacttttatataaaaaaaatgctttttagagtttcagaaccaaaacttttgtgtgcttaatgcgagcctcagatttctgaactgaaccatcatgtttcggacatttgcccgatgtgtctttgtacgtactgcttccatgcttcaccctttcttccaaaacagtgaaacagaattcttaaacagggaggcaaaagcaaagttttatccaattggcaaattttgctacaggcgcaacttcgtggttttagctctagaacactgcacaaagtcacttttgggaaggcactctataatcttggttatttgccaatagacaccacacccatttattaagtgttttagtgctgactaggagagagcgggcccactttttgttgcaatgtgaccaaattgtcccttcccatctttctcacttaatccaatcccctcagccggctccttcctcccctcacccaccgaccggcgccactcccccctggcgcccttacgggcggcaggcatggaggggagcaactgcgcgctaatcgagcgtgcctccgctagcgaagtgagcgaccgcgccaccacctcgactccgttgctcgtgggccagcaccactctccctccccctacccttggccagtacagaggagccactgcagcggaggcgaaggagggagggccggggtggtcgttggcagcaagcggagatggtgttgtggccggagtgtgagagggagtgagatgtggaggaagaatatgacaagtgggtccaggggcatttttgatatttcacattgtttatctctcctattcaaccaaaaattaatattataatgtcggcggtgtccatcagcaaataaccatattttcatagtgcattcccccaaggattgacttttgacgtgttctagagctaaaaccacaaagtcataatgtcccacggcaaaatttaccttgtttctttggtggttccaattaattgtggacaaggagcattgatcccctttttctaaaaacaaaagaagatgagggatgtggtacattttctgtggtttcccattgctgcaataaaacagtaaatcattataccagatgacagaggaatttgttgcatccaactcattacaagggtaatatttctacttgtgctgttgtgcagtgctaaaaaacattgaccgatagaatagtcaaattagccacagactaaacaaaaatacaaagtaaacagcagtaagtaatgatgtccatccctccatgctgtaatttagtttggctaaacctagaggcaaaaccggataaattaaacaaaatcatggcaactgaaagctttatcaggtatctttatctcacttaaaagatactaacaacgaaacattcacattcagaccattagactatatgcaaaactgttaagaagatccttacacaaagtaatcgtttggactaggcagcttgtatgtaaacatcaacttgtcatctactcctttaaattaagttaaaacagttgatgataaaaaacataacactgaacaaaggaattgtccatcaataaggagacagacacaggaacatatttctggtgatctaggtcaagttggaatttcataatgctgcgtagaatttcttattcataaactgaaacagaagggaaaaaaaatggcaaactccgtcaggttttcatctgatgaactagtgaacccccccccccccctctctctctctctctctctctctctctctctgtgtgtttaaagagcagtagtataaaattataatacccggtgcctctatatgcttttgcagctaccgctactctttgtctgctcggtcgcaatcactcatccatatcgatataaacacagtatagaagtgctttcaacatgttttttttttgcttagatctaatcgattatggggattccttatgcttccatttactgatagaagatagatagacgaggctgtaaaaatgttgatcctcctcgcgaaaaaaaaatgtttatccaacatagttcagagtacgtgaaatgcaaattctgaatataccccaaaaaaaagaaaagaaaaatccagggccgacataagacttcgatttgtgcaagactcaagaaggagaaatcctacacatattctgatatcaatttgcacaaatcttgctcaaagaaatgaatatgtgtacagaacagattccagaccttgtccttggaggaagaagcacaatcacatcagcatgaatgtcacactcccacttactccctccgtccaaagactcaatttctagctttttcgtgttcaacgtttgactatccgtcttatatgaattttttttttacgattattattttcattgttgttagatgataaaaaataataatattttatacgtgacttatctttttaatcttttttataatttttttaaataagacggacagtcaaatattgtacacggaaacctaggaattaagttattttggaacgaagggggatcaagacaagaggaacatgacagagagaggatcagggtgggtcaaaagataaaagggtaggaatgaatgagacaattggcatttttttgactttccatgcatcggatcgaattccagctacatgcagacgttgcttctccaaagtccattgcggaattgcaccgcccgattctccaaagtccaaactcaaacatctcactcctttcatctcttgtctcttccatcggcgatgtcgtctgattaagtttggagaagtattgttcagcctcatctcggttacagtgtgcctgtactgcatactagtgtcatttgtgcttgtaaaggaagtaatagtagtttgtacgatgatggctttacgtactggatatggattttttgtgtcccttgtttttttcttttcatgtaaaccatatatcactgcacaagtacatggttaaattcgatttctataaattgtaaccaaaataataaattaaactctaactaacatatgttatactctatatgaaggccaaatatggatgtgcatgtttgttgtgtgattatctcatattagtatatcttaatgtttttagaaaagatataagtatttaggtgacataaaagaaacgataaaagaaacgataagacatctccattgagtgataaaagaacactatcctctttttaacacaaacaaataaaatacatttcgacccatgtgttcaatggaatacaactaaatataattactagttaaattttctttgtgatttctctgagtatcagagggcttaaaaaaacgtgtaagggtgcgcgtgtcttgcatgcataccctcaggccattcacaatggcgttcagcctcaccaccaaaaaaacgaatattccttgcatatcatcaatctgcgcagcctcattagtaccgcggagccaactttggctatgggttcctcgtggtgatgacgttgtttaagtacgtttagtcaatccggatctgttaattggatatggtgagagcattagcagtgcgccgttcacaaatgccgaacctcaccagccccatagaaaaagaacaatataagctacacgtcttaaatgtacttaaacaacgtcatcaacgaatataatattgtgcgcatatatcatcacgcgaggcttccatctctctctactctccccagtttcctctaggactcccttcgtcccattttaagtgtaaccataattttcagcgctcaactttgatcgtctgtcttatttgaaaaaattttaaaaaaaacttaaaaacataagccatgagtaaagtatgattcatgttttatcatctcataacaacaaaaatactaattataaaaaaagacggacgataaaagttaggcacgaaaactcatggttgcatttaaaatgggacaaagggggtaccttctctctctccagtcttgtacgcggcagacaacttcgcggatgcttcggcgggttcggcctcacactcgactgcaagcaagactgccgactttcggacaaggtgtgaaaaaccgccggtaaccgcgcggttaccgcccgtaccgcgggggtacggttacccgtaccgcgcggtacggtttaataaaattcgtccaaattcaaaaatttaaaaaaaaagaaaaaaatcaaaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgctttcggacaatagttacgtttcaaaaaaatacttcggacaacagcttgcgaaaacgaaagctatcgagcacctacatagtacttaatttgccctggggctggggctaaggccagccaaaccttcatagcatcatcgtcctcctcctctacaaacaaacattctccgcaccagcgcaggtgatcgatcgatcgatcccaattccacctgatcgaatacctgatactagtgcagctacagctagagtacacacaacttcctcgatcgatcggacccttgtgttttcgtttcgcggattctgccgatgatgaccgggctgggcatggtggcggctgccgtcgcggccaccaccgtcttcaacgccgccgccaccgccgcaccaccgccggtgggggccgtgctgcttctttgtgccgcgttccacgcaggcatggcgctcattatcaacggcgttcgacgcggacggtgacgacgacgccgcccccctcgacggcgaccgagcgggtgcgctagtcaccatccgccgcgcggcgccgcccgtgactaggcctaagcgggagcctggctcctctgcattcacggtcagaatccatggggaaatttctcgtatctgaatattcctttggactctcacggtgaaagcagtggaagcaggcctctcacttaggcagatgctgttcttccagtgtttggaatcaaaccatcaagtggagttcttttggatcatctgtctaactgttgttgttgtctcagtttgaacataatggtagtgagacggatgatcttgaaatgattccactcgctggattgatcccaaacactagcagaacatggtctgcccaagtgtgagctgatggttcctttttttttctttgcgtgccttgttttttccccttgtttactttgtttggtgggttcagtgtctgtttgtttttattttctttctttacagagagaatgagaataactgtaaaatttgtctatcagggaaattaaataaatatgacatggtcaacgacaaaataattccatgtgtcggctcgcaactgatcagataagttgccatctgaaatgatctgtcagacaacgttggattgatccgaaacactagcacaacatgcgcaagtgtgcgctgatagtatttttctttttttccctctcctacttttggttttctttttgtcatggtgtgtgctttgtttggtgagttcactagtgtctattcggttttagtttatttcttcctttttttagagaggaaaagatttacatgaagtactttacaaggaaataaatgtgagctttattattttgtacgaaaaggacatagattttagatggtcaacgacaaaacagaaattccagttgtgttggcacaaactgacgtgccaactgccaagagcttccatctgaaataatctgaaggaagaacggactctttcctcgactttgtctgaaactctatggctgtgttagttcctttctaagttggaagtttgggttaaaattggtacgatgtgactgaaaagttatgtgtgtataacaggttgatgtgatggaaaaagttggaagtttagatccaaaatttgaaaggaagtaaacacagcttatgatagacagaaaagtgaatcttctggcaacgtaagacgaatggtcaaacgtatataaaaaattaacgacaacgacgtcgtgtattaaaaaattgaggttaattttctgattcttgaatctcgtctgcgtccaccacaaccgcttaattaccgtgtacaaattgaggttaattttcaaaattatctgtttgcagatattctaaacagttaaactagtactggggagaagaatttagcagagccaatcagcggttacgcagaaagatcgagaattttatatttttattcggtcacaggctccgacgtgtgattcctgagccgaccattttgttttcggaagtctgaactgtttggttattttacctgaacaactgtgtacttaataatatagggaaatagatctctaacgtattaccgttctcagattttaagtgacacagtatttagttccctttaaacttttaaaaatttcatcacatcaaatatttggacacatacatgaagtactaaatatgaacgaaaaaaaccaatagcacagtttgcatgtaaattgcgagacgaatcttttaagcctaattacaccataatttgacaatgttatgttacagtaaacatttactaatgatggattaattaggcttaataaatttatctcgcagtttataggcgaaatctgtaatttattttgttattagtctacgtttaatattttaaatacgtgtccgtatacttttttaaaaaattaggccacgaactaaacacggcctgagtcatatatcagccccacaacccatgggttcacatgacaacgacctaggttagaggtcagtaaggccaatatgcatgggagtataatagataatactagtgtgtttgcaaggatttttttttctttttggtcatgcttgttctgctctgtgctctcgatgctagttgagataataagggggtgtttagatccattggtaaattttttttcatcatcacaatgaatatttgaatacatagacggagtattaaatattgataaaaaaaaactaattacacagtttgcgtgtaaattgcgggacagatcttttaagcctaattgctccatgatctgacaatgttgtgctgcagtaaacatttgctaatgacggattaattaggcttaataaattcgtaccgttgttttcatgcggattatgttttttttattagtctatatttaatactttaaatgtgtatgcgtatatctgatgtgacccgataaattttttttgccggtggaaattaacacagcctaaattttgtttgatgcctacggccacatatagtggagaaggttttgtgtgaattgaattaattcctgtaaaattcgtgcaatccaaaagatccttggtaaaatttactagttcagtctatgaaaatctttaaaaaaaataatttctcccatccaacgaataaccatttgaagcgatgcgcccttaggtgaattgggcccatgagtaagaaagcatgaacaagtaaagtgaaggatgaccgtacgtttgacttagtcgaatcagtggataacggtgtttctttgtctcgacaaccacacacctcgtcatgtattacgtcacaacatctagtttctattttgttttatgatatatgacgtcatgaatttatcatttgttttgatgaacttatcttttttttctgacgtacggagtatatacatttccatggaatataattatttttcttgcttccaaagtaaccaaaggccgtcgtgttgtaaaaatatcggtacccaaattaagaaaagaactagaaaatgggcgcacctttggcgcaccaactaagagtaccctgtaaatatttatactttttttaggatgtataaatgttttagagttatttacaattagtttgatttcttagatacacacacacacacacacacacacacacacacacacacacacacacacacacacacatatatatatatatatatatatatatatatatatatatatatatatatgagatggagtaaaaataaaccgaagcgacaataatcaatgatatttctatttggaaaataaatctggagtatttttatttgggaaaaattctagaaatgtttatttctcaacaaacatattacacttggataaatgaaaactggcaaaaaaaaaatataagctcaaaataatatctcaaaagagacacggctttgccgcataatgggtcattggcgcgcctgcttagtttgcatatatgttcataaatatatggtgcaattaatgatgttttaattcctaatttttggtgttaccaatagtagaggtagtacttatgtgaagatttaaaacatgtccaaaatatatattattttaaatatcataggtctataaatatttttttctaagttaattgtctgagtttgtagaaaatgcaccagtatatataataataaataaataaaataaagacatatttcatgatgaatctaattaaactaatttggtgttacagattttttttttataaagccagccggtgttagagaagtttaactgaaagataaacttaaattacaatatgaacatatagagtcagtgaatttccgttgtattttagagaaaagaaacatgaaatgctaatattttttttgttttctatgcatattgtttaggccccatttatctttatgtttgtgtatttaatcttgtgttaaacatctattgctggacttcgtgactttctgattttaactgtagcataaaagtgaacacacttttaaaatatgcatgcggttgtcataaatgtatctaattaatcgatcagtgatagtcgcaattaacttaatgttatcggtagatatttctcttattgatgtgatatactccttaggtgattataagttatagcatattctaatatagcattaggttaggttggtgccattttagggagtacgaccgatcacctagtcggctagtcagttggtctaatctatactccttaaaaaaatacagaatttgtcatctagtgaatatgtctatcacacctactttcattgtaaattttataagttgccccttaaatttcttaatattaaaaagattaagtctaaatagatagtcacataaaaaattgatattatgtggtgtttgaatctgctgaagatgaagataaagatggagattaagtgtttcatgcaaaacgggtggtaataacgtgtgattaattgagttttaattattataaacttgaaaaatggattaatatgatattttagagcaactttcatatataaagttttcgcacgaaacacaccgtttaacagtttaaaaagtgtgctacgagtatctaaaattttatcctgagattccataagaaatgaacagggcctaagatgaatattccctatagcaaaaatatggttaacatattaatacattttttatctatagcaaaacacaaacatttagttaagtgttcgaagacccattatttttaacaattacttagaaattgcttttttttaaggatcttttctttcagtccatgtaacattggggttaccaatatttgttgagaatcttgggagaaacatctagttagaaataaatcacaccaatatgtagttctgctatatccagcccacatcaatctgctatatccgtttcaggatggaggacgatttatctagaaaatagagatcctatcttttgcctccaactctctctaaatagcaaattttacagttaggttctttgcaccatctctaccgttgattttaaatcagatggttgtgcgtgggtgatgaggaacataccctaaatttggagggacacatggcaacatggcagatttttagaggggtccaactaaatttataggttgccacgtggcttaatgggaagccagatcctacaccctgcaatcggttttagagattggatgccatgcgatgcgagcgtgccgtggggagtggggcgcgcgcggggggtggatggatatggatgcagcgtcgacgcgggtggtatgcgggcggtggcgtgcgcgggagggtggttgatctggtcgacgccaatgctgcagtttttctgcttggcacgtgggtgggggctcctgggccggcgacgcgtgcaaatcaacacacaaaacaccctgcagcgcttaaatgagcaggaaattattccctatgtaacataaaaaaccaatctagtattaaatatgacacatcttaatattataaatatagatatacatctgaacagatttatcgtattataatatgtcacattcaatactatatttgttttactacgagagaagggagaagagaaaaaggacgaaatagaaggaccctgcagccttgcgcgcccggccatctcctgcttagcgctaatggtagtgttaatgttgctagttagtgttaatgataatttttatatctaatctattatatactaaaagtcgattaatcttcctataaacgctcctaaacttatcatatggcgctcctacaaaagcaaaagcagatgccgtttatagggaaaaaaaattcccatcggtatgtgtttggaaaaaactaaaggtacgtttaggtactgttcacttaaaaaaacgacgtactttacatacgataaaaactataaatcaggaaaaagaaactgttcacttgaaaaaataacaaaaaagggctggcaattttcatttaaccgggaaaaaaacgcttctacaaacgctcctaaatcaccacgtggcattttataatctcatcgtcgattttcatttaaattggtgacccattattttaaactattagattagatatatttgcttatataagcatagatgccgtttatacgggaaaaaaaattcccatcggtacgtattcggaaaaaactaaaggtacgttacttaaaaaaacgacatatatatactttacgtccgataaaaactataaaacagaaaaaagaaactgttcacttgaaaaaataacaaaaaaaagctggcaattttcatttaaaatgatggacccattttttagattattagattatagtcaccgtcacatgatactcctacaaacgttcctacgccgtcacatagcactctaataaattagagaaaacattagaaattcttaaaaaaattcaattaaagcggtgaacccattattctaagtcattagattaaatctattaaaagattgcatcccacctaaccttccaccaaataaaaaaacggttttactatatttctgtcaccggaattctggctccatagcagtcagttttgtggccactggatacgctataagtttcgtgtcaagttaaatccattgtgctcataccatcgctgcccgctgttttgctgcgttcacacttacatgtatgtgactgctggggtagttatttatatatttacaaatttacacagtagttacaccccacttacatatgtattaggatgtaattttgggatttacatatgtaattttaggacttacatatgtaattttggtatttacattgtcaatacactaaaattacatatgtaatttagagacttataatgtaaatacatgtcgagtattttttataaaaaatatgacgccataaatataactactcccataaaaaaatagaagaagaagcagataaggatgagcgagggaaagagagagagcaaatagataagatctccagaacgacgcgactctctccctctcccgtgcggcttgccttggtttgtaggctacctttttaaaaaagtgactataatatattataggtgttggtttttttaactaaccggtatctataataaataataggtacgtataatattggtgttcatttttctctaataccgacacatataattgttcaaggtgtcgattatatatttggtcaacatgcgggagtgagaaaagcactataggtgtcggtttatctatttcagcacctatatactgacctttaggtgtcggtttatctatttcagcacctatatactgacctttaggtgtcggtttatctatttcagcacctatataccgatctttatgtgcttttctgtagtagtgcttcataattctcgaataaaaaaaatagacaacaagtaagaaattggtgtcaatggtttctgctaagtatacttgaggagactcgaaaccgggttgatgggtgcatcatgaatgctaatcaccactgccaccgtgctatgaccacatcttgaataaaaacgttattatgtttctatgtacaagaaaatatccattagcttcctgttaaacatatgtaaattatataggattacatataatattaactatatattaatttaaaaatattacatgaaaatatatttagctctatctttctcatccaaattatcttaataattttttaaataattaatagtagccactgtattcatttacgaaccttcaccactcatattttcttaacattaactatatttttattaaacagataccacatgaaaccaaaatttacattcttccatgtcattctcgtccaaatagtgttacaattagtaaaaaaaataaatttaacaatatatattattccatcatatattatccaacaaatattcataactaataagaagagaaatatcactcatgtattagcacatgcatgtatgaaggattactgctcgagctttttttcgtgtggttctcagtttctcaccacttaagtattagaccttttaagaggtagatgtaatcaatacaaacaatgtgattggataaagtgccaaaatttatctgaattaaatgttgtagcttaaagctaatagttagattgaaaaaattatccaagcaataccgatgaagaaaatttgtgaaaagatattacttttgaagtgtggcaattatcattcgattgatattctggccttataaattcttcaaatacatataatcatacatgcccgcgcgaatgcgcgggctaccttcctagttttcttaagaaatacataaataatttagtttaaagttacagaaaatagttgaaagtttcaaatcatgagttgaaagtttttaaactttttactaagatttggaaaactttcagctcagatttgaaaacattcctatcaagatttaaaacttttaattcagatttaaaaattttcaactcaataatttttttagaaaaaaactttcaacttagattttaaaacttttaattctgatttaaaaactctcaactcaagatttaaaacatctaactcatattaaaaaacattcatctcaaaattttaaaaatttaaattaaatttaaaaatttcaaactcaaaatttaaaagtttgactaaaattttaaaagctgagcttatggtcaaattgtccagctgacattctgtcaatctttttttcatttttgtttttcaagatagaatggaacatatcgaccccaaagtagaaaccacaccgccttctcctcaccccacccaattcgttttccagcgcattacgatctcagcgtcgcattcgtcgtcttctacctccatcacttgctagttcctactagcaaataattaattaatttttaattattataaatttttaaagtgaattatttaatatttttaagtaattttaatatagaaagttttagcatgaaatatacggtttaacagtttaaaaaacatgctaatgaaacaaagataaaatctctattttagttagataagaacggagccatatgtagatgttggaatccaaaattctcaacccaccaaaaattaatacttcctccgttctaaaatataacaatttatagcccttacaatttatcccaaaatatatttccaaccagtcacaaatctttagcatttaattttcttcgctaaccttcatttgtcaatcaattataatatcctacattaaattcttactacttctttattaatatatatattcaactctaaagattcttatatttgtggaaaaaaaattatatttgagatggaggcagtaacttaagtcggtagtcaatggtcataatagtacgtacgtactccttttggcatcttgcgatccatcttctgcaatcgtccgtgcgtgcgtgagcgtcgtcttggcccgccgcgccgcgcggagacggcacccgtacgaccacgagacgcgggttactctgccgaaaagcagagcatttgtgtgagcgacgagagcgacagttcataaccgacaggcttgccgccaccgagagcatggttaatagtatagtcaactattagctttaaattatttataaccaatgtaataggtaattcttataatagttgtttactatactattaaatacctagtcccacctctcatacacacattacgtcttggagtccatgctgcagctgattacagctgctcttctctcttttcttttatctttttaaaatatatttatagctggcttacattatactattgtacctgctctaaccgacaggctcggccgccaccgagagcgacagcccatagccgacaggtcccatgatcgagtccatgacagacaaccgagagcgacaggtccgctgcatgacaaccgccagcgcccatcggacagcggctcgatcgatccggcgtgcgtagcggccacgcgccccttttcaccctagaaaatctatataagtgcggggctctctccgttcagcttaagcgcaaactcgatcgcacgcctactccctactacgcctctccctctttgttccttctcccttcttgtgacctgtgtgaaaaaaaaaaaaaaacaagaagagaatttctgagactgacctcaccggaaatgcgcgcctcagtcgtcggcgccgtctgcgtggtctccgcggcaatcgccgccgcgccggagcttccgcaagatccgtcgtcgtgccaggcgtgcgcaatcatggccttgtgcgcggcgttccacggcggcgtggctctgctcatccacctcctccggcgaggcccgaggggcacccgcacctccggcgctactgcggcggccgtggcatcaccgccggcggcgagcagctagtcacctcgttcgtgactaggcttaagtaggacttggctcccctgcatccgaatgaccaatccatgggggtaaattttgcttttttttttttttttttgcctccatgaattcttcttaggttgttggggtgcagaggagccaaggcccacttaggcagacgctactccatcggtgtttgggatcaaatctaacaagtggtgttctttcgaattgtctgtctaactgacgttgcttctagtacttgatcttgatggcagtaagacggatgatttcgagataattccactagctggattgattccaaacacagacggagcactgtttgcccaagtgtgctcactcttataatcttgttttgccctaattgtttgggttctttttttttcccttttccttgagtcactctgctttgtccattgtctggtcagatccatatgttcttttataccatattcttctgttttgttctcctgtgagaggaaaacactggcataaacataagtgagatggccaacgagaaaacagcatcccgtttccgttaacaacaaaaccgaccatgcatgctggcaagtgaagacatagcagattgcaaacaggggcacccagatccagcactattacaattattaccattttccacctttggacctgacattccaattgcatcaggtaaagaaaaaataacaatcggaaaaaggaaccatgactatagtgtcttttttgaggtagaattgcacccaattatatgtaaattttagcatggcaaaaaggttctatctgtcgtcgacacttacacatcagccccaaggtaaatgcagtaaaacccatcatagcaaattcagaaaccgcaatagtaactcaatggcactaccattcacatctgtgttataatcctaaaaatgccgatacaataaataacattgtacgatacatcagaacacccagaggtgtacattttgtacattccatgacaaacgggtgaacgactagttctatacacatttggagaagaattgcagaaatattaagacatactatcatctgctagatgtctaatacagtaagccgaatgagcagtaaactctttccaacagtgtcctagattcctaggttagaagtaccatgagtatgtactttgtgaaaatcttcagcagcaagatgtcttgtacagcatgcagcctgcaaaattgttgacaggaacgtctaatgttagaacattacagagataaaaagagagcaattcgatgagctgagcagtatttgaatatagcagaatgattttattcgatccaacctagaagcaaagtcatgatccaagcatgtctacatacaacataagctaacagtatgcctcacatccatcagattacaacctatctatctaccactacattggtttgaactttgaagtacctacctactacgagatgatgctgtgacaaactttaattttgcattcctaaaagatgtttgtcgaattctttctcgagaagtaagaagcaaaagtaaagtacgaaccatgaagcaagcacatgcttatttaaacgaactcacataagtagctaaggaaaacaaacagaactcaggactgcagaatttaccattctatctaatccaatcctgggtacacacaagcgcctcaattgtcttgatgttcaaagtgctccattgcttatgaattactggaccctcactgctgaaggcggccttgcaatgaagagcagatgatggcattgccaagacatcctgtgccataactgaaagagttggatactttgtagaatgaatcatccaccagttcagaatatcaaaatcatctttccttggaacaaggccatcctcgagataattgtcaagctctgacaaccgttggctccttgattgtgcactaagatgctgatcccaatcctccaatgaatcactgtcaaatccatccatttcaacatcacgagcttcattgtttgacgtgtgaacacctttatccacagggccgcaatattcatgaaacagctccctgattatttcacgtacagcagctacatactttgctgcttcagcaccgaaagctcgtttaagacggaactcaataaaagtaattttgaatctgggatcaagaactataggtattgacagccataggtatgaattttcccaatattcatggaatgcttcctgcatctccctcaccatgctagcaacttcagtgtgatcagtagatgcttcttcttgcaaagttgttctaactttccataattcattgaagtacacatttgctgttgggcaaacaggaccagagattacttcaatagcacgataaaaagccctcagaatcttgcagatagactcaacgaccttatagtcttctgcaggtaacaactcttcagatggaaatgccttcttgcaatgcagaacaacttcaagcctgaagtaaattttgtgccaccattttgcgtcttcctggggacacttcaaacccatgtttgtaacagcttcaaaaagttgctgttgagttaacgatgagtacgcatgtgccagcataaatctttctagtatattatcaacaaggtgaagcattgattgcccttttgaaacaatgttgttaagcacgtcatccacacaggcaatattgtatagctcacctctaataggaagactatttttttgtatgagcatgtccttaagctttgtggtaccttcatggtttctaatttcactgacggatatcaagctaaaaagcttattatcaagattccaatcacttatagcttctgctatgacattatatggcccactttcagagtctaatacacaagcctccttataaagtatcattctttccaaatcagtaggcaacgaccaaaacacaccaaacttgattattttcctttgaagcctccattctgcatcaataaagtgcgctgtcaaacagatgtacttcacagtgggctcagctccatgaggagcccaaatgcttgctgataaggaaatccgtcgggatgaaagtgcagcaattttctccttaaggtcagccttttctttctgatataaaagagttgaatactcttccacatcaatgcttgatgccatgttaaacaacgggttgaggctttttgcaaatcttttcatttcttcatgttccacgattgacaagggatatccatgcaaaactatcattctaattagctcttgataagatgtttcctgatcaaatttactggtgcttacatctggagcagcatgagtagatgaggtattttgttctttggtcatgttgtctcgtgctggcaaagctagaatgtgctggctctggggagttttgtcaactgagctattaaccttgagaagtttgctagcatactctgcaatctgaactttaccgtttgtcaaggcaggtgaaagctcatcctgaaccccagatttaaaacttggtgcactggagggagaaaacggactcttatgatttattccagtttctcctcgtgccggacaagtctgagtatgccggttcaaatggcttctacctttatctgcactaagtcgcttgtggcaatggagacattcagcaccctggattctcccctcaacatatacaggcgtaaactcctcccacacctttgatctgaacctgctgttgtcactgtgacttgccaattttatatcatcaagtgaatctggatgaatttgatccaccggattaatatcattcatcactattatgtataaagcatggatagtttagtcagaatacacataaagatgaaagatatgcaacttggccgaaaaaaaaaaaaacaaaaggatgcttccaccataattacagccacagacagataaaataatatacagcagagaagtttaaaaattcccatggcattgacagaagaagaaaaatactagaaattcccacagggggaacatctaatcctaaaataaaccaagtaacttgcagcttttcaaccaccttggtagcagccattctactcttgctaaactaaatgggcaatcgtatcactcatcttgccagaaaaagagttattctatgagcaatgcagaccagcagggtgacggagatgaaaaaaatttaaggttttgaggtaaattagtaaattatttgtaacttatagcttactctgatgctcttagtattgtgacggtatagtttagatttaaaatttttaacacactattttttgcaaacaatgctcctggccagggttgctggtaaccaccagttaccagcagtttccagtaaggacctgaaccctgattaacatatctatataattccttatgtgatcttcttaatcatggaaaatcatcagctaaagcctagcccattctgtcagctcctctgataggggatcaaaatattaataaaatattgtcattgttttaagaaataacaaaatatataccacctaagtgggaatgccctataattcctatcattgatttaaccaacaagctaatatacagcacctaaaaggcaatgccctcaactattgtcattgttaaaatgtccctaatcattatcatcattgcctaaagtaggttaaagtttgaatgctttatacaagggtaccataataagttgatgatcatccaaaactctctcaacgactataaaacagtacaaaatttacacactgtcaaatcaactaatacaccgatgcagatgccaattaaactgaagatgatccccaagggaaacaaagcaagcataccatatgggaaaccagtatcatgtaactgagccagatccaagtcctctttcgcccggcaaattttctgatgccgccacaaatgactcgttccattggaatgtccatcagaacctttgcaactcatcagaatatggcagtagcggcattccgcgctttgaaccactccgtttacatagataggcttgtactcatcccacaccttggaccttttcttagttctcgctctgaaggcaacgtgagcttcatctgacgccacccctgacggcaactcgtcactgtcatgatcatccatgggatccataactgcctacaaagatacaccacaatcatattatttttacagtatgtggttaaacaaaacacaggaaaagtacaacaaagctaagataagatcatacgtaaatgattatgaagcatgcagcaagcttaacacaacaggcaacctcaactacagtctacagagagaagtcccaacaagagatgatacgactacgattttgtgcaaattagcagtgcttgcgagcttcaaccacaatttacaggggcaaggccacacgggagttcaactgaacatctggaccccaaatttttttcggaaacaaactgctcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagttctgcaccgctcatcaacgaattggagcggaagagatgaatccaaatcctgacagatctacagtctacgccacacaggcacacaccgctcgcgaagcgctgtggaggagtaggaggatggaggagctacgagagaaagagcgaatacctccaattcgagccgaaccgagacggaggccggtggagcgaggccggccgcgtcgtcggggcccctccctccttccacctacctgctcgccggccgcgcgtggtcggtccggcaagtaaaggaaggccggtccaacgccgcgcacacaaagctcttcgccggcgggcggggtggcgcttgcgaggcggcgaggcggcggggagatggccggcggcgcgtccgccggaagcagaggagagagagggggatggagactggagagaagcggaggcgggttgagatcctctccagtgcttagcttcactgcaaattgagcggtcgcgctcatcaccgttggattgaaaatgaacggtgcagatcgcccaagatcactttgccgagctgctgtagcagtaattaggaaaacgcctgttagccaaagtctcttaacggttcatgaacttgacggatttcgatcaatctagagctgtgggtcaaaatgcgcgtctcgttcaaaatttgtcgaaattcattcgaaattatgtgttaaaattagttcgaaattagtggaaaaaaaaaacaaatctcactaggcaattgggattgtaaagccgggtctcaaccattcaaatttcaattccttttttctctaggaaattaaatttcattcccttttttttgcgaggaattcaacaattcggaggccgagttatacaaaaaggctaattacagtatattgagattgaaacaaactaggacagatattgagaagtatccattgtcatggattaataaggatctaaccgcattatgttttgttcatggtaatttgttatactccactatagcataaactgaagctccaaaaacctgcttgagcattccacttcagtcaacttgcatacatagctcatttctgcacaacagatcagcagcagttctaaaacgtatggagtgactgaacccagacaccattgattggagacaataaaccagtcccgagtaccgactgatgtaagatgaaatttaaaaatgctaagaacaattttgcggaaatcaactagaacatgcaaactgaaattatcgagagtaaccatgaaaacattatggagagaagtcataatgaagggctggcttttttattgcagtgaaccgttacttttcaagacatgataattgcaaactgttttgcaaactgttttctttgcttcacagggctagaataaactgtatcaccttcggaatgttcttatacccttacaactataccaaaagagagtgacaatattaacacaggctgcggagtgaatgcaattagacagaaatatgtgcgtacgattgctcgatgtctcgatgtatctgagaacgagactgtaaaagaactatatcaggtgcaagtaactcctatccacaactgttcaagttccttccactaagcccaagaatttgctagtctagttgatgtagtgatggacacctggtacagtaaacatagataatcagccaagtaaaagaagcaaagcaccgcaaggcagtctgatgatgcatatacgtagtgtaataacaagatgaagcaattggtgaacattgaacaatacatgaaaaagaaactttgttggcactacatgtgctgcaaagaataaaatagaggaaccagggaaatatattgcctactctttgctagcaatcagtccttctcggtcaataaatctacgcccaccaaaaggaacttctataacgatttttcatgaatctggggttaatgttataacacatgaattctagatacttccatccctccaggcaatttaatattgaagtactacagtaagcacaattaaaatcttcgatagttcaagactcaggataatgcttcaagatcaggacaacaagtagcttaatacagtttgtctacactttacaatgtcaggcaagttctcagtcaatcgccatcagcagtatgacaaatgcatctgttcaaaaactgtctttcatgaaaaactactagtttatgaattaataccacaaggcttaaggataactttgtaaagcatttggaaacccatgatacccacttaaaattccaattggcataaataaccgaaatgcatagcatccacattatttttaatgtgtagaaggatgagtgatcatcacctcaagttgaacaaatgcttattcacaaatgagaaacaaaattgcccatgctacacagtgcagttagaagccattctcaaacaagagtggtaccctatcaaataacaccaaaactgttttgcagaagtgataatgtaggcgtgtagcatggcatcaggcatacatggtgatgtcatgttccatgcattgtaattcctaccaccaaaactacagagtttgggaactcatgtgtcctacttccatcaagcagataaacacaacaatgaaatggcgagactatcctagaagggatgattacacacaaggtatgatctatagacaaaatcatcagtgccatgtatacagcagtactcaacagtcgtgcagaaacatcaatgcacaaaagatacagagtatcataatcaatccatgatttccatgtccagaaatgtttacctagtcagtgaacataggtcacagccagaactgcaaactaagctgccgtagctgggatgttgtagcggctgcgcagtccatcaatagctctgtctgccgacttcgccatctcagggatagtcaccttgcacactgaccatcaccggaaagttagagcacaacacatgaacacaatgcttaactgacttgagcaacatgtggatctgaactaaaaatcaagcgaacatagcaatgtatcttctccacgccgtaccacgagatgtagaagcctgcacctccgccacaaacttcttgtacgaggcctggggttcacaggaagcatcagaaattcagaatattaaccaaagtgcggtcaaattggatgcaaaccgtagagaacatagtgatctagggtaccttcactgcctcagcatgctcggagatcttgtcggccatcttcctgtgctccttctccgcctcatccgccagctgcaggcagctctgagtctgcatctgaagagagatcatacgcgaaatcacgacatcactcggtgcgatcggcgatcatcggaagggagcggagaagaagggtcaccttgaagcgcttggagatgcgggagtgggaggcctcgaggtcgcgggcggagtcgccgtggagcgcgtcgagccggcgcttgagggagtcgaggtgggacgcggcgaggatcctcaggtccgcgacggtggagacggaggcggaagcgggggaggcgtagggggagatgggggaggaggccggggcggcgagcggtgacctcggcttgggcttcaccaccggcgaggagggcgagaggaagctgaggtcgtcggccgcgtcgccggatgccggcgaagagccgccggagaggagggaggcggggctgggcttcgtcttgggcttgggcttgggcttggccctagccgtggccctcggcttgggcttggacgccgcggcggttgctctcgccttcctcatcgctggccgccgccgccgcctgcgcgcgccctgtgcgaaagggccaaaggggtagagagaagagaagaggagagggggtggttttgggatttgcttttttctttttttgaattttgaatgagaggcgtattgcggctctgcgggatggagacggctttctataaagggaaacgtacactttccgctttctcgcttaggatacgggaagtttaactgcacgagttcattggtttgtagggcttggagatcgtggggtccacatgccagctacttctgctctttgaatttgcgaaattttgatcattttcagctcaaagtcttgaagatccaactgaaagcttaggccatgtttagatcccaccccaaaacttttcaccatatcacatcgaacgtttaaacacatgtatgaagtattaaatataggctaaaaaataattaattgcatagattgcgactaatttgcgagacgaatcttttaaacctaattgctacatgatttgacaatatagtgatacagtaaacatttgttaatgacagattaattatgcttaatagattcgtctcgctgtctactgacggattctgtaattagtttttttattaatgcccaaacattccatgcgataccctatataatatccaatatgacacgccaaaactttacacccccatagatctaaacaaccccctcagagtctcaatcaagcgtttcaaggcaatgtcaggctgtcagcgacagaatagaggaagagaggaagagagaaaatggaaggggtgggcgtatcactgacaggtgggacccacatatcgtacgaacagcaatacccacaagcagcgtatgcccactcacacatgcaataagtagtgacagaatactcttcgaatattaagttatatgttacacagaacaacattatatggcacatatatatacaccaccagatggatctcttgataaaacagggagcaatggcagaattctcctacaagctggggtcaaatattcaacacaggctagcgactaagcctactacatttcgtctagcaaatcagagcatgacaaaactggagctgctgcgagccatggaaggacacaaatccgcagtacctcgcaccaaaatactcagcagcggtacacagctgttggagttgcatctaggcaaagatcacaggctactatacaatgtcattgtatcgcagagatcacgggtgcttccaatcaaaacctaaatagatacttcagatcatccacggtgagccgagtcgcgtggccacccgatttgtcttcgccaaaagcagagctaaccatggctctcttttcctcctgtaaagaagcggaaacatcattggacgagcatacccccaaattatcagggatgttggttgtgtcaagataattcatatctacatgagattatgcaatcaaaattgttgtcttaacccccatgatcgataaaaaaaaagtattaaatcaacctcggtaaagttgtttagttatcggtacacaactaacaccccctaaaataacaataacaagaatattacaacttgcactatcagctgccctgttcattttccaaccatcacattaaagttttgaaaagctgggcttgaatttcaagcacctacgacatattcaagtacaagcatcgaatgaacgctgacacgatttgagaatatcaatgctactagtataactcatccctcaaaaaaaaaaaaaaaaaaaaaagaggcgtatgttattgttatctaagtaggaaaaagacaagtttatgaaagcacagtgcaaatgaaagacaagctattacctgcagagctaaaatgcgatcttccaccgtatctttaatggttaaacgggagacagtaacaggacgagtctgaccaattctgtgtgctctatcaattgcctggtcctcagcataaggattccaccaaagatcaaggagaattacatggcaagcagcaaccatattgagaccaagattacctgctttcagtgacatgatcataaccctgacctgaggatacaaaaggattcctttcagaataactgctgaatgaatggctgaaagtaataagagaaacaaggtagtaaaaaagagagtggaaacagaaaatagggacctctgggtctgtgttaaaatctttcactgctttatctcttgaattgagggacattgttccatctagtctcctgtactgtatgagattgctattcaatgaaagctccagcaaatccagcatgccagtccactgggagaacacaatggctttcactggggccactcggctaggatttgattcgacggtatcactgtcggtaagggcataggtgttaatgatcgaattcagtatatcgattgccgcctgtatctttgaggatatgtaactagtttgactaatagaagatgactcgtcatctaatgatgaactccctgatgcatgagaactggatacaccagacatgcaaatccttaacgctcctgacgaaaatactgaatcggtacttaatgtgtttccacaattaggggagggacacatattctcatcagtagttatccgctcgtatatacattgatagcagaagacatggccacacatcgtcacgacggcatcctcaggtacatcctgccgtaaaagaagtccaaagattgcaaaagaagattgaattacaccagtaattagattgtccaaagatatagaaacaagaagggcaaggatatttgcaaaaacatatagcctgacagcttggcattgcggcattgtagctctggatgcataaccccaaggtgttttctcgttaaatatgaacagttgggctgattcaggttatcagatattctatcattgttatcatttaattagcatccactgcccctccacaatgcatattatgattttattccaaggacacgaaataacagaggatataggtaggacaaatttatgtttcagtctgactacacaatttttcatatgttgcatggaggttgtgcgcctatacatacacacacagccccagacaataacaacaataatactggtgattacgtgtattatcatttcaacataatggagagagaataggtcagattcaacataatggagagagattagattgcttacactgcatacagaacaaaactctccaacttccagctttgcaagcaaatttattatcatttctttaggaagttgctttgccatttctatagaaccatcgcctttatactctgactgatgccccttcacaagaagaggatgatcgcaggcctgcctaaggcgcaacagcattagaagaatgttggcatagttctgtttgagtgtaccagcagcagcgtatgcctgaaatggatcacaatatatcagcattcagaaactacacttgtgaaatctccagtaatcagaagggaacacaaattaacatccactttataacatttgatatgagacaatggttcaatggaagcatgaggaaactttgttggatcataacaacaatattctacacatacttgctccagcctccaggacaaaaggaaattcagtaatgttgaagatttaacatcacttctcctggtcacatcaatgtcattttggacatctacgtggtgttcaaaaatgcaaatttgaccactaacttttataatatttgta

SEQ ID NO: 70059 - DNA, 1961 bp, Oryza sativa
caagacagtgtatcgcaaaacggtgatgatacgcgtcatgacttgggctctaattggctgattagccgtgactgattatatgttaataaaaatgtttatgagttactgggatataacttagcacgtgttgcaagcctgcaattaatatttggcaaattttcctaccggacacttaaattttatataatttgctgatcgatatcgtaaacacgtggtacggcttaacaaaataaaaaaaactagtaatttgctagaagacacttttaacttaattggtgcataccgcagcatccaccacacaacgctagtggcggctttggagtgtgtgattaggaagaaggggtgagggggcggggcaaccacatgaaacatgtctgacagcctaattacaaatttctggtttattggcaggtcatacttcttttggctgaaaattttaaattcaattaaataattgatccaaaatttaataaaaaatagtcgaatttgttcgatctaaggaatgcttaggtgaaataataacatgattaatttaaggcggccttaatttaattaggaggcgataccgcccaggatgcaacagtacagttggacctttcctcttgctaaggcgataccgcccaggagtagttttcattagccacgctgctacggctgttggcccaacgtccggatggaagaatggcccaactttgacttcaacagattaaatttcttttgaacaatttaattttgaaaacatttcgagtatcttttcaaactgtagttgaaacttatagtctctcatgtgaacgttttgtataaaatccttatgcaagtttcctatataaacttcctctaaggaaaacttttttgtgtgccaactttctttatggattttttttatcggaaaataatttgtaatgaacgttttgggtcgatgacaaaaaagtttaacgtaaaaattcaaatagtattaaagaaggaagtaagacactagtcatcgcagatcgacatggcccttcaacaaggaagatggccggtgaacatggatatgtgtaaatgagcgagaaaagaaaacaagaacgaggcaaaaaccattgtcagaaagtgcacataactttatcatttacgctagtaacagtgtgctctatggaaggggaaagggtgtgcgacgctgacggagggggagggaaagctgcgtcggtggtacggtgagggagagcggcttcgacggtgggaggagagaaaggagctctggctaaggggagagcggtctcgatagaggggagatagttgttggtgactcggttgagaaggggagggagtgacagagatgggaatgggagggtgattttatatattttttttgtttcttcgggtgtttgtgagaagcattagagttctctgtaaaattcaaaaatatgaggattgaaatatgaaataattagggttgatatgtaaaactgaagataccactccagctactctccactaagataggaaaaggcaaattttgctacaagatattatgacttcgcggttttagctgtaggacaccgcgcgaaatgacttttatggaagacactttgaaaaattggatatttgctggtggatactgtgctcattaaaataataattttgagttgaggaggagataaaatttagagtaaagtccatcaccggtccctaaacttgtactactgtgtcatcccggtccctaaactcacaaatcgaccgttcaggtcctcaaacttgtttgactgtgtcatcccggtctctaaacttgcagatcactcgtttagatcctccaactagttcagttgtatcaccccagtccctaaacttggatttgaatatcatctaggtcaaataggacggtctaaagactttatatttaaaaataattcataacttttttatgtgaactctaatgaagacaaactttatatcaaacttgtagccctcagggctgcaggaat

SEQ ID NO: 70060 - DNA, 4548 bp, Oryza sativa
atgatctctatgtgctgaaggttttgctaatgattacgtacttcatatattttcttggcatattggttatacagtcatttatagtgagcatatttaacacaaatatcatgtcctccttatactcactaggtacatgattttttaggtccaacggtaccgtgcggtaccaaatcatggccattggatctggcccaatccaacagctggtagtgtttgctaccgcgaggtaccaaatatgtccttattgtggtacctcgcatagcagagacgtggaagggcaaaaatgtaacttcgcgtgcaatagatgggaggaatagacggacggaaccaattttctcgcattttacatcctcttctgtgctgccaccgtgtttctctcctcccctcccgccgccgtgttcctcctcctccccgctgccgtgttcctcctccagtgccgcgactttaatctcgggccttgcgctgaagcgaaatcgattgcggcgcgactttgtggtcctcctccagtcgccgcctggatggacgccgccgccaccgggaacaatgacttggacgccaccgctgccgggaacgatgactcgaacgccgcatccatccttgcttatcttttctctcctgatcctacccattccggatttaatggatagatgtgttttggtaccgagcggtaccagtaccgactggtacaacctgctggacagtaaagacactctttctaatatagatcccaacccattgtgtgggtcaccatctgaatttcaacttcaagtgtcctacttgctccatgaagtttcagtctgcaggagaactcggaaagcacgaaaagtttttccatgaagacgaagaaggtaaaagtaatccaatatattgataggaaatgctctttttccctatatcttgatgtctattttttttctacctgttataatcttcaaacggctcaatatttttttgttttggtgcagattggtggctcaaagtgtagtagatctagtcatctagattgttgttttatgtgttcatcctatggtacagataattaatctggtgtctttggcatgtcttttattccccatagttatgtttatatacggctcaatctggcttcgtgagctttgttaccgtctatcatgctttctagtacctcacggtacttgtaatcagggccatccattgagcctgatccaatgatttagcagcctcggtaccgcgaggtacaagaataccctgcggcggtacgtctcccttcctccgcaggcattggaacaggtggaagagcaaattcggattttcgcataatgcatccattttcgtagagtccatacggctggctctcacctgaatcgccccatctatcctcctgaggagaagtttgtttggtttcaaactccgattcaaacaagaggagtacgccatgctaatgtgacttggatgatccacatcttcgggtcagacgctgatgggccattgaactatccatgtggctgagagccctcacagcccagacacaacgacacaattattaggggtgcgctctaccactgagctaatagcccgtcgcgcagacctcgctacgccaaaagcgagaaaaactctatccctttccttttgacatcctcatgccgccacaccacaccggggggggggggcatggggacgtcaaaaaggggatcctatcactatcaactaatttgttccgacctaggataataagctcatgagcttgatcttacttcaccctaaacgaaagaaaacttccatatccaagacttttatgaaaaattgtatagggagtgtacgtgcctcacatgtatggcttaactgcccatacccggtttccacaggacatagcgcccatgcatgctgtttactggtacgaagcgcatagcgaatagggagcagcagctgaccttcgaaccacgtgccaccagttctgctagcccaatcgaggagcactgttgcacaaaggacaatgtggcagccattccaaggagccaaaaaaaattcaaaaaaaccagaaaaacggtagcactaggggttttattaattgatgattgccataggtgagaaaaaaaaaactcccatcctctagtagaggactaaagagtaccatgacgacgactacaaaatgctatacggttgaaccaacggaatactactttatatgtggcatcaaacacggtatcatagtatcaaacctggtaccagatttggtatcttggtaccatagtacgtcatcgacgccttcagcaacataaactataccacccaacgctgtagtgttttgtagtctttctggtatatcatgcatgatttattttttgaggctacaaagtttagagggcacatgatcaaatcttgagaaatccattctacttcctgtgcaataactagtagtatgatgctcaaactgttacactatccacagttggccattaaaacaacagactacactgttccggtaaattaaggagaagacaggttgcgttccccttggctgctgttttcacaacgccatgtacaacagccgatccacgtttggttacacgttattttcacacctgttcaacagccgaatttcatggatgccttcagagttcatagtgatcagtatgactgaaacgattataaggaccaccggagcagcgtcactggacatccacttcaacttctggtgttatttcctgcacacagcacagtactggtataaaacaatatactccggaaaggtatccagaacaccgtcacgtgtttcttttgatttaaaacttaatcccacttcatgttttcaaagaaaaatggctgacaactaaaatacacaataattaatgtctaaactccggatacacaagagtatttatacaccgatgtcgtggaacgagagtcgtttttggtatgtataacatactctccctctggaattattccaccttaaaacaatcacaggtttgatcaaacaacagatatttgataatgcactggcaaattttggataaaatgcaaataaaaaattatctagtattatcacgtacatagtagataatagggccattaagcatggagggataattatgtacgagttgagttaggggataattgatgataaaaatgctactagtactaaagcattttactgatccttgattccttggtaatttagtggactaattgacttattttgacagtcaacataggcaaatcttttatgtatgagtggttaattagcatacatatatacatacaaactggaaaaaaaatagcgaaatgcggtaagatctacctaaatgttaattaagctccatatcaaaacaaaaaatctgttgtacacatcattgcacgtgccagttaagctatcaatttcgaactcattggcaacatatgccatgggacataagaacagaataactaaacctatgcatgatttgcgttcttcagacaggaaagcaaaagctcagggacatatgccaggacgcatcatgttgatattattactaagtcttagtatatatataccttttatctatttgaagcaaatttggctttggtttatttctgcagcactcccttcttgatgaaaatcctaaggcaataagaagagaatttccagagcgcaatatgttcaaatgatcctactggtaatgaaacctattttggtctggttcttaggcgaaagctaattccttgcattatcaacttttgctgaaggtaaagaatacataccaacccactggccttgctttctggaaatggatctttcatcagattcttttgatctcatcacataaacctagatccacctagtttgcatattcaggcaatgcagagctgcatgtaccaaacttatgggacttcatggctttcttcgtattcaccaatttggttagtgttaatgtgagaattttacactagccacatcaaacagcacttgccagatcacctatcctcacatggtggttcagccgttttagcagaaaacgtcccatttatcctatcctgctcccataattcaagaatttctgatgctgacggcatctctccgcatgaaccatcaccatacaaattcattgaatcaagtacttcgtcaactgcagatactcctgtccccaaccagccgagatcatgttgttctttctgttcactctcaaaatgtgaacctataacaatgtcctcgctcaagccagcattagcatcagattgtggagtattcataatgtaatcagagaactcactgctaactttctcatcgggaaatacatttgtgtttagcgaattcatgcaagaaagctgatctagattgctatttgaagacttggttatattctctggcagagagagttgagactgtccagtatatgtaccatcagccacaaaagaagtgtcgttcacaaaagttgtcccacattgagattgcagtgcacttacaaaacaaagttcgggatccgatttgatgatatcactggtactgaggtactttaaaagatctttcaaagcattcacgctgaatcgatgcatattttgctcaagtagcttgctccactgaagttcact

SEQ ID NO: 70061 - DNA, 23077 bp, Oryza sativa
ggggggggggaggaggcgacggcggaactgatcatgatcaagcagctgcatgcgaattgctcctcgcctctgatagtgtgatcgcctatctgatttactagtatataaattagtagaaccaggttttcgattggaaaggtgctgtcaaaagtcaataaccacctaatctaatgcaacctggatattactccatgcttatataatgctcggctgattgattcctgcaattgctagtagctagatcagtagtatcttggtgagttggtatagttttttttttttcaacgctctcaagtctgaagatcccaggcactttctttattgcaattttccatttttaaaaactcgggtgtcgtttttgctcaacagttgacacggatatatcgattgggagatatttgtcagaatttcaagctgctgaaagcaatgacatgctttcgttgtgcgttttgaagcagtcttagcttccttgctacaagcacttctgacatgaaaaggattggtacctggtacatgcaactgcgagtgaacattgagcacaactagtactagccactagccagcgctcccctgacctttatccccaaggcccaaactacttgtcaagtcgccaacccgccgaagtacaatctaacaacagtggtagagcatggcataaatgactgagataagatgcagtccaatctacatggataggataagattgctgaaaatctctctaaaattccaattccctgttcttccgaacccctacgtacagacattctgcgccgcgccattgacaacttgatcaaatcacaaggaaagtgtgatggtccaacataaacggatcaattgcatgcagcatgctggaggcaccagctttggttcaatggaccgcattagatattcccagaagcatcacccatatattatctgttcaggttattagctgcagatgggaattgttatacagtagtgaactgaaaacagatgccccggaataatatggaacgatatgatttcttattctgtactgtccaattgtagccaaaagtaatggacaagggtcaaagatgtttggagcatgagcaaaaggtcatgcgggcatgcatgagcaaccaagataaggtcccaaggaacctcttacaggtttgaacaggaaggacttggtgagaaacttttggcagttttgggtccattttgaactacactactgggcaacaaacacaacatgggccactacgggataagccgaggcgagctgcctgcagttgccaacactacaggaatctgcacggcccattggtgaaaaggcctgtgtggagtggactctggcccgttagctgtggccgcaggctaacagccgactagttgaaacttgaaagtttgacgctgtacatgcttaactctgagtctctgagtattcaacaaatatactatcggcctatcggggtgaagaaactcacaagtcacacccagcatgtccgcatgttgcatgtatttactcgctagaaaataacagcagatgatagatcgatcaccaagtcttgcacagatagcgcacttacaatttttcctacagaaaaatagcagccaagtgcggcatagtacataggagcaccaagctagcaaaacaaaatcaggatgtacgtggcattacagcggcatcaggcgttgattgctggcgaaacaaatggagaacatccatgtccgaagatcagagctgagagagaccactgtggaatcgcatccatgaacagaaccacaccggatcagctaacgcgttgaagagactttcgtcgtcagggatgctcgccgtcgtcctcgaggagctcttcgactgactcgatgatgaggccgaagcaagcggcaaagccggcctcctctagcacgtcataatcatcatcatcatcgcaggccacctcttcgacgtcaatgacggctttgctgccgagccgggccgccgcctcatcctggaggaccttgactctggcgcagaagctggcaatgtcgtcggcaacgacgacgtcctcctccgtctcgacgcggaagccgtgctcatcgcagatcaggaacccggcctcctccgtcgacgcgaaggggaagacggggtcgtacgcgaatccctccggagtcatggaccagaacctggctggctcgtacagggatcccgggtacagcggcgtccacacggctggttcgagcaggccgagcgcctccaccgtcgacgacgtcgccatctccgccgtcgtcctcttcccggctctcaattcgttcgtctcgtgcgcgatagagagagtgtgtgcgtcacgatccgggcacgaggcgcagggctttgctttgacaggttgacgtacgtgctgcgggagcatggcttatatggagccatgttacgacttggagtcggagacggattgcggctgcacgagcggaggctgggggcgtcacgcctgtacgtacgggcaaaaccaaaacggagtcgagtggaagacgagatgggggaggtagaaaatgccaccgcctcgaccacaaaccatagcagatgatcaccgggttagaaaatcgacttggaataattgtggtattttgttatgttttgattggtagcaaaagagagataatatgactatccctgctaccatgtgatatacggaaaaataaaaaataataatggtgtaaaaacttgtctagttgttgtaaaccctggttgaatggaacatccacactagcaaactgattatacgtggcggtgaccataattcatgcatgtgggtcaatctgaactgaatggagaataatccataatgcaaccatcgttctcaaacagatccatacacagaaatttatgatgctagagtaacaaaaagaacaagatgaaaggaaggacgaagctgcttgagcagattaatgattgctggagacatacttcgctgtgccgccaccctcgaggtccagtcgatgttgctgccatagccttcaagatattcacaactatttgatcgtcgaatttgaacttcatttttcgtggacagatagatatatatcacaatactcaacattttcaaattttttcttcataattttcacagctatttgtgtattgaatttggaagaaaaaagatacacgaggggacattccctcaaggtattagaatccactcccccaaatcatatggtttgcaagatgttgcatttagcacccaacacaagtttatacaccgtaggttcaatttgcccaaaacaatatatctgtagctatattaatggattggctgattcgagaataattgcaggttaataagagaagcaatatctagcatcataaatgttgtcttggatcataaaaaagaacagaaatttatgatgctagagtaacaaaaagaacaagatgcataggcggtgaaagtgcatataatgttttctcatcaatgtgcccctaatgttgtcttggatgcatggttaatggcaaacgtttaaattgtcttggatgttttcattgacatactgaaatactactgaatatagaaaatagttcacattggtgtcaaagcaacgttggagattccggtttcataaaagagatcgaattgaatggatactcgtctggtaaaaatttttttatgagtattggaatatcgtactatcaaaatgttgtttattcgggatttaggctcccgtggagactatgcaaacactgagtcacaaagcttcaatattatcaactccacatccacatttccaccgtgacacaccaaggtgtttacccatcatttttggattttgaaataatatattgaagtgcgacttgtagtttgtaatttcgaacatggaaaatgttctaaactccaaactaaatacataatttgctgcgcggatctatatacagcaaataaataatttaagcaaatgcctacaaatagcatgtgaaaatggtacaagaattgtcaagatcaaatctatcagctcaacttcttgatgatgtgacatgcatgtgcttctttatggcagtgattacagagcacttgatgattttctatttatcaattccattttctgaattatttaatcaataaaaaaactgaaaaatcaagggaaaaaaggggcattgggcaacaaacaggccgaaccgttggcatgccgctgccaacagtacagttgtacacttgctctgatgttcaacggcccacgagtggtaggcactaaaaggcccatgtggagtggaatctggcccggtggttgcgcttgtggctgcagattaggaataagttcactttaggtccctctatttgtcgcccaatccgatttccgtccctcgaccgcaaaaccgggtacaacctgtcccccaactttcgaaaaccgggcacaagatccctcggcggttttgaaggtggttttggctgacgtgacgtctacgtggcttgtttgactagttctccgtcccacgtggcattgatgtggcgctgatgtggcaattatatcttcaaaaaataataaaaatcgtgggcccacaatttaaccatagaaaaaataatttaaaaatgatgggtctcacatgtcagctaaaaaaataaatatggtagggcccacatgggccccacatgtcattcccaaatgaccaaatcctatcctcttcttcctcctctctctggctctccccatctctctgctccctcctctcgccgggcggcgtccagcacgacgggcggcgcggcggcggtaggcggcgcgggcgacggacagcgcatggccggcggcgggcgatggcgcgcgtggcggcgcgcgaggcgcgtggggcaggggcggccatctctctcttgcgcaacagatggattaagttgtgaccacgatcgatcgcttcaaaccaagttgagttcacagcaacgagattcacatactgcaatgcagaaacgcaaacagaacaggcaattcagatggccaaatgcgacagaatggaagagttaaccacaatccagagctagaggattcaaacagcagcaccagaacggcttcactgggttatgttgcgatcgcctaataaccaaactgaaatcacagcagcaaggttcaaatcaccgcaatgcaaacacagacaagcaattcatgagacaattctccactgcttcatcacagatgctcaaatccaaccgaggaactccaagttagttcaaagttcaaaccaattcccttcctccaatccaccgaacttccagaaacacacgcgtacattgaaaccacactcgattaagaacaaggcacgcagaatccgaaccaatttcaaaagttcaagagctccggagtttactcaaattcgccatctcgaactcgaagccacgcacgcacatggagcagagcgaatcacttaccagtggaagggagggcgacggcgagcgaggaaggaggcgcgcggaagcctgcacgcccggagcggcgcctcgcacggaccgcacacggatggctgacgcacaggagcggcgccggcgggagaggagggagtgacgcccgcgcgctcgccggtaggccagggagctcgcctagccgtccgccgcccttctagctcgccggcgggagaggagggagctcggcacggctctagctccttcgttcctcttcccctttcccatacgcgcgtgcccgggagggagtgaggcgagtacgagccgccgccgccgctgctgccgctgtcgcggcggacagggagaagaagctgagggcggaggccgggtcgggggaggaggcgagggcacggagcgtggtgttgagcatgaaggaattgggggcgcaggggagggaggcgaggaggcggagcatggcgtcgggaggggagagcgcggcatagacggcttgtggagcggcggcggaaggatgacgagcgcggtgtagaggcgcttggcaatgccgtaccggcgcgcgcggagggcgtccgggtggtcggcggcggcgacatggatggcgacgtcgatggcgtcttccagggcgccgccgcgctgctcgccttcacgcggagcggcggcgccgaccacgcccgccgccgccgccggagctcgcctgctccgccgcccacccgcgccgtcctctgcctgagaaagagaaagagagagggaaagggaagaagagagagaagggagagggaagaagagaggagtgagactgacatgtggggcccacatggcccacactattttaaaattattttttttgcagccacgttttttattatttttctgagatataattgtcacgtaaacgccacgtcaatgccacgtgggacggagacctagtcaaacaagccacgtatgcgccacgtcagccaaaaccgctgagggaccacgtttgcccggttttcgtaagttgggggacggatcatacccggttttgcagtcaaggacgaaaatcggactggataaaaaataaagagacccaaagtgaacttattcctgcagattatgagcaattctccgttcaaaaaaaaaaaagagagagattatgagcaattctgcaattgagcacgtgggcgtactctcgactcgagcatcgattgtgtgaagaaagaaaccagttaaccagcacgtaattcctcagaaaagaaagcaactgatgatatctcaatcaccaagttttgcatactgcaaaggttaagtgagatagttattccattacatagatagatttgcaacacaacgtactacaaatccaagtgatctgcagcttacatcaatcaagagttaactaatctgagcagaacatcctagattagatactggcgcgaacacaatcttgtgatctgccgcaggagctacaaaattgtcttaaatcctaagagcatctttcccatctttaagggagtaccatgaggtactatgaagtacgagggaccataaggtaacaatctaatctaaccgttgatttagaaggggtatgatcggactaaataaagttaaggcgccgcaaatcaccgcccactcaaccaatagcgataccctgttcccgtctcctaccttctacctcatctccggccgccgtcgcatcatggccgccgcggccacgcgtcacacaagcttcagcctccgtcgcatcgaggccgccgcggctgtgcgtcgcacacgcgtctgccgccgtcgtatcgaggccgccgcggccgccgtcgcatcgaggccgccgagcagccgtcgcatcaaccccgccacggccgccgtggcttcaacgccgccgcatagacgtcgccgcctccacccgctgcatccgccgtcgcaggcgcatcaacatcgccgcctccaccccgtcccatccgccgtcgtagccaccccgaagactccggcatcttttccaccatctggtgtggactctgtcgtaataagaactaaatttgaaatgtgcttcatctggatttgttatttgttggtacattttatggttgaagaagttatgaaggtggtaaattatttggcaggttcactgtgccgtgtacagtggaaggtgttggtagcagaacaaatatgctgtatgatgttgttgtttgtctaagtttgagctgaatttacattgtatgccgtgtgcataagttgtttcaaccattgttgtttgtatcttgtacaactttcataaagtaagtacttgaatcttgttggtctaagtttgatctctgttcaagaagcagcagtgccagcaattttcagttttcagcatcaaaaagcagtaccaagcagcaaatttaaatttgtagcaataattccagcaagaggagcaataaattcaggcaaactgcaattgtgacacagtcaattcagcagcatatatgtgtatttcatctcagcaacaccaacttcagttccgcagatagcatccactagtaacaaataatcagtaagcatgcaccagtaataaatctcgcaagaagcatccatacaaaatgcacacaaacaggggcatcaattatgcaaaccataccactagaattgactgatagacatattacatcggaacacatattacatcggaacttcagtgaacagaaacacacaaacatcagcttgctcgaaaagattggctccaaccaaagcattccatccagttgtgaaggttgctcgcttatccttgaatttcatcagtttcatccgcatccaaccatcgccggcctcccgccgatgcagcgccgccgtcgcatcgaggccgttgccctccgaccctgacgaatcgccaccgccaccgatgcagcacagccgtcgcatccagacagccatgcccgccatcgccgacgaatcgccgccgccgccaatgcagcgcagccgtcgcatccagactgccgcgcccgccgccgttgacgattcgccggggctacccgatctaggccaccatcgggtcgccagtccaacctactcccgccgccatctatcgccgccatgcattctagggtttctttctctcgctgctctagcccgtcgaatacgcggcttctgttctctcgccaaacagagaagtaaacagagaaggaagggatgctgcgtgcgtgatgcggaatagacgcgaaagtacataactaccctcccacccacggtaccacttcaaggcagaggtgtggtaccatgaggtacagatgatttttgaccgtccgatgagacctgatcaacggtcacgatttggtactgcacagcctcaaggacagtaaaaatgctcaaatcctaatgacggcttcagtgtttcgccacgtcgtcttcgtcctctaacatcagtacatcaacccgactagctcgatctccataagactgcactgcacgtgaagcttatagagcacagcaactatgcggcgtccatgaaccgggcctagctcgagctcgtctcgtcgtcgtcctcaaggagctcttcggctaagccgatgatgtggctgaagccttcctctgtcaacgcgtcgtcctcatcgctgcccacctcctcttcggtctcgacgacgtcgtcaccgctgtggcgagacgcgagcgcgcgcgcggccgcctcctctccctggagggcgttcactctggcgcagaagctggcgacgtcctcctccgcctcgacggcagggccggccctgacgggggacgagcagtgcggccgctccgggcccccgtatcgtaggggccccaccccacccccaggccaccccctgccgtggttggcccaacaggccatgcagacgatgagacgctgaggcggaacagaagacgcgagggtttccgattgacgcgcgttagccgccgcccacgtcctcacgctcacgcaaaatcacatcgcgcattcatcccgcagccacagccgcagaccgcatcggcgccgcgttgtcgtccgtcgcccacgccgacgcatcagccatccacggcgggcttcctcttccgcgcgaggcgctgaggcacagccatcaggtgagcagcagcaacacgccaacaccattggtccattgccaatttgccatcgccttatgaaaaattgaaagattgtaactgattctatatgtaatctgttggctgttgccatgtaagtatgtactgatgttcagtagccgtgcattttgctgtcctgtgcaaggtaaattcagttggaccgattgttggatacttggacgaaccgaggaaggcataaaactgcacctagtgtgtatatattttcgatttactagtaaaatgcccgtgcttcgctacgggtaaaaagaacgtttaaatgtaataaatatttcaagaacggatataaaacactgtcccattttgatatactcatattgtcataacgcgctctctatcaactctcacatggcaagcgcatgatattatttacaaaattgagatggtgcttggactgtaatatatcgtgttttgcggatgacggaaagaaaataattacttacttaaaattattgatttttgaattatccgttattgttcgtatattgtctgcattatgcaccacacacaatatccgtggatccacatagttgcctcgtgttgcaatagataaaaactaaattaaatttgtgttgacgtaaaaattaaactatatatcataattatgaaagctaatggcatagccaaattatgaaaatcagtgttattattttttcaatgggagtattgttttccatttataaatcacattgtcaaatatcgaaaaaaataagaagcagattagacgtagagaaaaaaaacagaaattaaaactatggaagcagagtgacagggaagggataagaaagcagcagcagagcagtctcggacctctcggttcttccattctcaatttatctctatacacgatactctgttcttatcctcccatctcactctcttagacactggcagggacatgtaaaaaaaccgctccccatcactttccccacttctcctcctgctcagctgctctcgatgaatccgccgtcttcctttttctgctctttcctcttggttttctctcctctcatctgctgctctccctcctcgaccacccaccgacggcgccactccctctccgccgctccccctccttgtccctccaccgagcccaccggcgatggatccaactcccccgaactcgctggcgatggatcggccttctctgagcttgccgacgacagatccacctcccctgagctcggtccagccgtcgtcggcgttgggtggcgaatcagtcgacgccgatagcagatcgagctccccaacggtggattgagctgccacaacgatgcagttcggtgccgagcggattggggcggctttggcctttaggcggagggagtggtcgaagacggggggaggctgagcgagtcgtggatgccggatccggtgggtttttcttgtctcgtgatgtcctccatgatcactatttggtctgattggtgtttgttttgttggatttctcaggatctggtacagtggacgaatgtccggctcgacgtcccgttggtgcttcttctggtcgtccagtcggctctcaaggcctggctgcggcccgccgagtttgagagctcgcctgccccgtgcctgccagtgactgatgtccttgattcgccgtcagttccagccactgacgcctatggtaattttcatttttaagataatatatcatgttattcatgtgaaatcttgggatcatcttgcattggagcaattctgtttttgaaatgggggaattgcggaacaccagtgtatttccatgctgattaatttggaacatagcatagtgaacagggtgacaggtggttatcttgatcttaaactgtctccaactcttcattgaatgtttctcagatgaattgattcatttaattcattaaagccacaggcatatgctgaccactgcatttcttgtacaatgttgaacaggtacatggagttggctcactgagttgatgaagctttgtggttcatggcagctgatggactcactatggatcaccctattatgacaacagaattctggacatcacatgagtgccttcttcttccctatgagcaagcattacctgaaaacattagagtgaaactccctcacctcatacgtgctgttcatgttgctgtccagatagtaacatgggttaccgacccgatgcatggtaacacaatgaaggctccttgtggcctcaagactcgctcctttgctacttttcagtatttgcttgttcctattacttctcagtagtatgtaactgaataattgtcttatttttgctggacaacctaattgcatatgcactatgctgctatgcagagagaagctgtttatagggtgtttgatggttgattgcggcgtacaatgtctgacaggtacgcggaagtttccgatgcttaatttgaattgttgatattgcaaattaaatcagtaaatctcattctaagtcttttaactcctgttattcattttttattccccgcacaacatacacacacgcacaagttatatctcaccttccagtatatatgttttttaagattgcttttgtattctagtagtttttatactgcataagagtagttttttttttaaaaaaaaacagaacagttagttaatttgatttcattggtttgtagctctacgacttatggaatactgagatgaatataaacctaggtggtacctgtggattgtaatttaaactctacacacatgggtaatcttatatgtcttttcgatgaattaaaaagcttcacaattaagaaaacataatgtatttaaataataaaacaataacgcgaggatctctgcgtgcacaataagtttaggccattaagaatagaatgactgatctacatgatatataatagatttcaaggttctatcacaaagcagaattccatcaagtttatagtgacaaaacactaacttttgaaacattaacaaagttcaggagatcaaaactcaaccaaaaatagcaaaattagaagagacctttaggtgttctatctaaaagaatagcatgcaaagtatatttatctagcaagatattgattaggagattatgtactggtaaaaacaaataattagtttacattatgttaaataattagtttacttgcttgattctcaagtaatttatctctctgaccagaaggtctgcatgatgtgtctgttctagctagaaggccatattggtgtatgagaatctgtcaaatccctatggaatagcgggaactctccttcatgtccaagtctcgcagtcctatcttccgaagccggtaagcattctgcttccattcctacttttccaggcagctttcctagagcctattccttacgtaaaaaatgacctctcgtggtcctactctgtctattcgtttaagccagctgtgcttttcattttcttttatctttccgcgagggcctctgctttcctttctatccctttatttctgggggcattctaaggttttcatgatgatctactctgtggtgctcaattatattactgattgatgtcttacgtttttacagctgtttttgttcgttttattgagctgcaggagattagatcacttcattattttgacactaatatgatattccaacattgaatggtatcttattgtgctaatcattttcctatgttgattcctgtagaagtttattttcaatggcggacatgaactttgggagtggagaagcatatggtaggtgttttgcgctgccgccagttggaaatatgtaagttttacggtctctcaacctcaactccttcctgcttgtttgtgttgcatgatgtttcatggtctgcattgttcagtggatgtggtcatatggatagtcaacctctaaatgatactactactcgtactgaagtaagtacttctagcttgtgtggacactaagatctatactattatgtgggtgtggatgttcaaccactaaatgatacttatcatactgatttgtgcaaacattgataatacctctaaactgcacttagttagctgtgattttgagtgccaccacgcaatcatggaagcaatctcagaacaacttgatatggatgcatgatgcatatgtattgagtattttgcatgccactgtttgtctttatttcatattagaattgcatatagtgtagtagttgttcttgctcctactacatttgacctggcagagttgatgcaaagttggatcattctaaaaaaaattaatctggttctaaccttttcatttgtgtgtatgttaagagtgaaaaataattgctgctaatgcttgctatatgtaattgattttgtctgaatttactcaataatttaggtaaaaggtgggaaagtagtgagcaggaagtagaagaataatttacaaattccagtctatgagagcagacgaataattaaatatctagattcaattgtgattgttccaaaagttatgccaaaaaataaatacaattcttaatatgtgcatcattaagggctaaagaattacctgcgtccatcataaacgtagatttagtatcacgttgaaccagaaattgctcactttgaaaaaaataacaaatttgggggcatatattagtgccgagtgagagattgctcagtatccacaccaaattttgggtgcatatgagtcttatttgtgatatgtgatttcagttttttgtataggttgataagatgtttgtattctacttggacatgtaatttcaatagttggattctgtatgtaattcggtatgtaatttctatcattggactgtatgcaatttttgggccatctaattgttcccgactctatttggcctttgtaatttctgagtcatgtatttgtatcctactaaatttgtgcttcaacccaatcggatggaaaaaaagaaaaccacggtaaaaaaaaaccggacagccgaaaaaaaacagggtagaaaaccgcaaaaaaaaaccggatagaaaaaatcaacgaaaaaatggaccaggaaaaccgtgaaaaaaccagacggcccagaaaaaccggacagaaaaaacgacgaaaaaaaaccgggttagaaaaccacgaaaaaaccggatggcaaaaaaaccgcgtgtgcgttcaggaaaccgccgacggacgaaaaaacctcacgaaagccttacgaatttttttattaggtatagacttgtggtgcacactcaaacgcttgcaaattacgatcaactaattggtaagattttaaatttagatttataatttttagtgtagttcctttttttttcaattattaggccatgtcattgataaagtatgcatcgggtagcgagaaaaatacatttttaaggtaataaatagaatttttttatatcaatattatttatgaatgcaatttaattaaacttttacggcaataactcatatatctactactactactactattatgttaagggcctctatgtttagattcgcaccggggccctgaaaactcgggaccggcccgacgcggaatccgcgctcgtcgtagtggaggaggagcccgccgacggcgccgtcctttgtctcgaagcggaagacggggtcgtacacgaatccctccttcgtgatcatggaccggaacctagccggatcgtacaggaaccccgggtacagtggcgtccacactgccgccgccgtcgacgccatctccgtcgtcccggctggctcaaatccgctcgtcgcgtgtcgtcgtcatgggcgggtgaaaccggcaaggcgggagtgcttgcttttgacacaattttgacttttgacgtgcaaggagctttggttgacaggatgacgagcaacgggggcggcgctggctttatggcctgagagacagaatgcgagtcggagacacgatgaatgcacacgcggcttggaatcggagacggagtgctgggcgccaatctgcgaagatcgagtaaccatgacacaattttcaacacacagtcaagtccgtatttcagtcagatgcttggtttggtcaaggttaatcgaaatatctctttgatacaaaggggtggattaggaagagatgaatagagggggacttatctccttgctccttcattccctctactcttcctcttctccctcttcatccccctcccatctcttcttctctcaacggtgatttcacatgactcaaaattttggcttcgcgcgcgctagtaatggtagatactttcattattaataacctattcagatcggtgtcattttaaattatatcctttttagtaaaattgataaatatatgaatacatttagtttgctaccaaatattaatactaatgttcagtgaattttagtaataacacatttatgagtctgtcatagatgttagcaattttccaaaaatttagtactcctattgctaaattttagaaaggtttattttaatactaatatgaacataatactaacctatcaaaataaaagttttttttcgaggaatcaaaataaaagttgaaccaacgtagtacactactggcctgctgggcagatgcccggtagtatttggttaaaaaaagttgaaccaacgtcgtcatataaaatttaactcaaatcgaatagcttccacttcaaaccttaaacacgcattaatggtttcaaaatctgtagtactacagtaatatatctacagcaaataatcatttatgatcaatactcgacagctcatctgtacacaaagcaggagtaattactaattagggaccgagaagtcgaaggaggtggatacctgagggggctctccgcaaaaaaactcacctactcgacccaacccgtcccaaccaaatccgtccattttagatccgacggctcgcagtggagatcgtaacccaagagaatataataaaaaaaagaagcgcatagccatcgcacggcggaaggactagaggagaggatactttcgccgaaacgggcccacactaccgtctcttcccccccctcccttcccttcccttccctcccctttctctctccttcccgatctctctctctctctctctcctcgagctctcgccgcacgctcccaaaagcggcgccgcgccgagctcgagctcgagctcgcggcgggcgacgagctccggcgagcgcgcgcgcgcacgctgaccagcgggggtttccccgtccgagctcgcgcgggcgtcgtctcgtcgggcccccttttcacctttctatcggtcattgaggggtgttctctctccccccaggccaccgcttcgcctggccgctcgggcgctcgccgcggattttcctggcccgccgagtggcgggatcgcggccaaccggtaatgtgggctctgatccctacgttctgctgtgaattaggactgattgtgctggctatggtgctgatttgtgtcgtgtttggttcggtttgctcggggttgtgcagcggaatggcgcagagcaactgggaagcggataagatgtaggcgatttctctgtcttttggtgcctggtttctgcggattttttgttgttgtgttaggattaatttccggtgcttgtcgtgcaggcttgatgtgtatatctatgactatttgctgaagcggaatttgcaggcgacggccaagtcgttcatggcggaggggaaggtctccgccgatccagttggtattcatctccgctgcttctgtagccgcctccttttggggttcccctttggtttttgccttgctagcttttgatagcaaatggagtttgtgaccacaggaaaattctggattttaagtagaggggcaggtttccatttttattttatttttttgagatggcaggtttcgagcattagtaggaacgaaaatttgggtttcgatctggaatgggagtcttgtgccatgaaatttgaaatcttcacacaggggttgtttctgatcaaatcagaacagaaaatttggaacgtggaagtatttgggagactttttcttccttcaaaatttaagaagaggtgctcacggttagagcttcgagctaatgcagggtatagctttcgatgtttgggggaaaagtaacttggagaatggagacgcttggtgttcggttcacttgggtgtctagctttcgtggttttcattcagctagtcatgtgctacttccattttttaatatatgacgcatttaacttttgtgattcgtttggctattcatcttttctagaaatatctgtgcatataggcaaacatacaatgcatgatagttgtgtacatccactttggatgtagaggcctggttttttattttctttcttaaaaaaacatacaacgcacgcttaagtacttttgatggcagatctagtggtactcttttcactttaactaagtaactgaataaatattgtaggtaaaatttgaaggaaataatgaatcatgttatatattaaaaatggaggtagtaaataatagtttcaacaactatcttattgagtggatggcgggattgggcggcttgctttggacattcatgcatgcttgtagacaacattggattttgatggtggagtacagatgtattaaaagcagaaaccgcatagatctttttagttgtggctcttttcatatatctatcataatgtaattgacatatatagccagaaatgatctattaatggtatttagctaacttagctattgttcagccatttctttcagcactcgatgaactgaattatgtcaaattgtcagctgtgttcaaataagaatagatgcatacatttagaaaagttgtaaagggttttgagttttggtagtaaaactccagatgtatagtagaacaggatgcttaactttctagaaactactgttttgttctgtgacatgagaaataataattgatacagagtacattatattttgtggccctaaggagccctaacatggataggaatacatgtgcatagtgggaccagaactacagaacaaagtaatactaatacaatttgcatatttctcacacatgtagtaggtagttctagactactagtactatacagtcaacaactgatacagtgccaaactagggagctgaactaaacttagaaaataaagagaaaaactttgcttttgcccttttagttccaaatacacgtctcgctaagaccaggcctgttagaaaagggctagcttcatctttcacgcattactcaaaatgataattcattaatttgtcacctttgaaccctccatgatgtttgaccctagttgcttttcccagcttaaatggttcagttctgtcacataaaaaacagcatgcgatttacaaaaatctttaaatcctcatgaaacgtaccatcacctttaattccaaataaacttctcacttactaaaattggcatgtgagaaaagggttaggtagtatgtttttgttttgctaggttcttcagatgtgataactaccacatctgaaccttccaattcaactttggcatgtggatatcttcaaagatgccaaaaaccctaggtgatgataatatatttaatgcaaaacacctagaactaataattcaatatagatttgtgtcactccaagaacttatgcatgctgtttacctgtgacccatttactacattagtttcaattcataggagattcattcaagcatcataattgtaaattcttgtattgcagcaattgatgctcctggagggtttctctttgagtggtggtctgttttttgggatatatttattgcaagaactaacgagaagcattctgagatcgcagcagcatacctagaggtacctttggaattgtaaatttttaatcaccatgcatgtcttttttagcttgtccaatgtaaatttccttttggaaatataggcacagcaaacaaaagcaagagagcatcaacagcagatgcaaatgcaacagttgcagctaatacaacaaagacatgctcaactgcagcgaactaatgccactcatccttcacttaatggtccaataagtggcctaaactctgatggcattctgggaccatctacggctagtgttttagctgccaagatgtatgaagagcgcttaaagcactctcatcccatggactctgatgggtcacagcttcttgatgctagtaggttggctcttctcaagtcggcgtcaacaaatcactcagggtaatcctccatgtcatttttttctgatatgtgaaagcaaaattgaagaaattgaatttgatgtgctatcagcattctcactatttgtatattttatggaaataggcaatcagtacctgggactcctggaagtgtgtctacgacgcttcaacaaatccaagctcggaatcagcaaaatattgtgggtttattggttaatttatgctgtgtattttaagttcactactttgtccattagtccattaaatgtatacaatgatgacccaaatatcatctctaacaggatataaaaagtgaaggtaacatgagtgtagcacaaagatctatgcccatggacccatcatcattatatggtcagggaataatccagccaaagcctggattgggtggtggaggtcagcccattcctctctgtatataagttcgcttttgttgctaaagtagcactctgaaataaatgcagtgaacgtggaacttatatactacatcgatttatatgttgtttctgtggtgactatattgtgggcatattctgaaacattaaaagcaaatgctattgttctcaagggagaaaaatatcctattcttgctttgtccattctgattttgttgagaaatctctttgctgctaaatgattgagattcatttttctgttaacagttttaaaccaaggagtgagtggtctaccattgaagggctggccgctaactgtaagcttcatgaatataaattgcctcatctgttcatgcatttattttggatctactgattaatattggtgctatcatcttacagggaattgaccaactgcggccaaatttaggtggtcaaatgcagaagccatttctttcaacacagtcgcagtttcaacttatgtcgccacagcagcagcagcaattcttagcacaagcccaagcacagggaaatcttggcaactctaccaatttaggggatatggatccccgaagattgtcagcgctaaccaggagcgtgttgaatggtaaagatggacaacctgctggaactgatgggtgcattacttccccaatgcaatccagttcacccaaagtcagaccagaccaagaatatctcatgaaggttggtttttcttctggaagtgtgctgcttctttgttttgcaaaaaaatctagttatacctaaaaggtacccacatgcagcagacatcttctcagcaaacacaggaacaacttcagcagcagcataatcagcaacagcaacagcaaacacaacaggtaccaactactgatagtatacccaagcccaatctctgaattcatcttctgttgtagaaaatttaattgatgtgagcgtttacccctaaagttttaaccacaaatgtggtcgagaaaaaaaaaagttgaaaccataaatctgccaagcaaaactattctttgtacctactgccgcacttctgtaaataaattataagtgttcactgtagcatatgaatcagttaaatatattgatatagtgtacacgatggaatcaaaatgctggtctgaaaaggccaattgagacgattttgtgctgatgatgtactgcagtggcacagcttttctacttttttctgtagatataatgatttagttagttagatatggtgtacacaatagaatcgaaatgttgacatgacaaaatcaggagaagattttatgctggtcttgtgctacaagcttgctattcttttttcaaaaatcaaaatctgtttgggaataattttcctgaaatgattccaagggagacactgtagagggcattaaagtgaatgggatttaattgagagcactaaatccaactctatgtcattatagttattaatggcatatttgctaaggatgatgtctttttttggcatatcaattaagcggatggattttgcttctgttttttcctgcatatgtctgagaccaatttggcggcatggtgcataattttgcatgctctaatagactaatacaaccccttggtttcctcactcagtcgttccctttctctcacccattcaacgtgcgcgcgcacacacaaacatgattttccggctgaaaataattcccctcaaatgattaacttgcaatttccctctctttcaatgcaattcatgtttacttctatatgcttctcattctataattatttatggcctccagggcaatagaaaaagaaagcaacctacatcttcaggagcagcaaatagtaccggaacagcaaatacagttggtccttcgaccaattcaccaccatctactccgtctactcatacgcctggagatggacttggaatgactggcaatatgcgccatgttccgaaaaacttaatgatgtatggtgtggaaggaacaggactgccatcctcgtcaaacctggttttgcaccttctcttttccatttaactgtactgctttatctatgtaattattcttctatgccagatatataagcaaggctgtcgtttacttacaggatgatcttgaacaatttggtgacatgggctctttggatgataatgttgaatcattcttagccaatggagatggagatgcaagggatatttttgctgcacctgaaaaaagtcctgcagagcctaatccagtggcttcaaaaggtgatccttgacgttctgtgtgttctgtaaacattgaatgtttccatgtttacatgaaataacgttccatgttttttaggtttcaccttcagtgaggtaaattgttggcgaacaaacaatagcaaagtagtttgctgccatttttcatcagatggcaagatactggctagtgctggacatgaaaagaaggtatcggtaaatgcacttcttttcagcatccgacttttctgaatattgtggcttattttctgctgtcttttaggctgtactttggaacatggagactttccagacacagtatactgctgaagagcatgctgtcattatcactgatgtccgtttcagacctaactctaatcagctggcaacatcatctttcgatagaactattaaactgtggaatgctgcagatgtaagtcatgatttttcctgtgtgtgtgaaagtgggaaggagattacccaattatgcctggagttatgctgtccataacactaattctttctgcgccgtagtactgactggcacacactttcatttagagtactgatcattgcagtatatgtcataacaaatataccatgacactactgtcttggaattgacagtataaggcaagaccaatttgcaaacgaactagtctgtaagctatagtatatgtgtgattatggttttggtctattagctaattgtaaagttatttggcacataagagttcagtgtgtcgagactatggtatatattcaatgttggttctatatttacttgatttggtaccgtgttgattataaaagtccgcttgttttgcagcctggcttctccctgcatacatttgctggtcattgctctggaatcacatcactagattttcatccaaagaagacggaccttttgtgctcttgtgatagcaatggtgaaatccggtactggaatgtgt

SEQ ID NO: 70062 - DNA, 1049 bp, Oryza sativa
cgagtgatctgcaagtttagtgaccgggatgacacagttgaacaagtttgaggatctgaacggtcgatttacgagtttagagaccaggatgacacagtggtacaagtttaggggaccggtgatgaactttactctagaaattaagtgaaagttttaaaatgcccttggagccaccatatctcccatctctcttctctccgtccccttattccatactactatggtcgccgccgctcgtcgtcaaccacagaggtggcatggccgccgccttgtactccggcatcagccgcccagacatgaacctcaagccacacgcgttgcagagggtcttgggacccaggggacccgtcagcagctacgacgttttctccgacgcgcagtgcatgcaccgccacgtacacgccggcctccatgcccaccttcacccccgcggggccggggctcttcttgccgcggctgccgctggagccgttcagccttgtggccgacagctttttagaggacgggaagtcggacgacgggcgggacgatgacagcgacgactaaaatgtcggatgtgggccaagggtgtgccacgcagcggcggtcgcggccgtcgcgcatgacctcttgctatgcgcgccgcgcccaggcgctgccgtgagacagctgtcttgaccaggccagttgccgccaccgttgttggccgcggaagcaggcgccgctgccgccgccattgcggcatgtgcagacgactagtaatcgagctcggcagcttccttggtctgaacccatcaacacacacatccatcatcattgttcagctcaaaactgtttgatgggagatctgacgggtgggtttaaggacattttataactttcgcgtgatttttctcccctttccaaccgaaaattattattttaatggacgcggtatccaccaacaaagattcaacttttcatccaatttttcagagtgtcttcccccaaaattcattttgcacggtgtcgtacagctaaaaccgcgaagtcacgatatcctatagcaaattttggggctgcaggaattc

SEQ ID NO: 70063 - DNA, 648 bp, Oryza sativa
aattcctgcagccctggtgagctagaacgtgacttgtcatacttgccacattacgctgatctttcagattcccttttcgtcagataattgtatgatccaaactaatgaagacaagcttaattgagagaaattcccccaattcgtggacaaacagagtcacaatggcagaggaaacgaaaattaacgcgatcaaccatcaccacctgatcgacatctcaccggagttgggtggcgcgaccgccatcgatggcccaaaggagatgaaggagttgggcatcgtcgatggcgcagtggagatgaaggaattgggcgtcgctgccgccgtccatggcgcaggggagatgaaggagttgggcggcacggcctccatcgatggcgccgcggacaagaaggagctgggcggcgcggtcgccggcgccggcggcgcagcggagacaaagtggctgcgcaagctgacgtcgtcgagcgtcaacaccgccgtgctgagagacctcatcgcgcggacgcccatgctgtggtacctcggcgagcgctccggcaccatcctccggccgcgctcccggcgcgccggcgtcgacgctctgcacgcggtgcgcgccgtggccatcggcccgttccaccgtcgtgaccactggctcccttccccga

SEQ ID NO: 70064 - DNA, 1254 bp, Oryza sativa
aacagagaagataattctaaaaaaattatatttactcattataaatgacctagtatttgaataatttatttaccctatacacttccatgcagttaaacaaagtatggttttagccgattgagaatcataattagtctattatttgactggtttgactgatttatttcaggtaccaaatttagttattaaattgtaccaaaattacagtgagttgcatgagttaagtagagcctacatgaattttcccatgattttatcttgcacaaattattttaggtatttagtaagatttatctttatatatgtttcctcctcataaatgcatctagctatttataaaaattatatttggactctcttgacctaaggtgatattatttaacctcattttcatgtctttataattatttctcaagagtggttataggtttgattagtgaaattttatcttttatttatgctcatgagacctaatatgcaatgccaacaaaaaatccaaatgcacgagaaagactcaagtcaaaacatgtcttatgcaagtatgcatgcttacacttgtgtttgtatttttttcctaggttataaatgaaaaggttttaatttgccctcgaattttattcatgcaagagttagatcaacttcacctaggtttaaaaaggaaatttttggttcacaaaatttgaagaactttcctttcaactagtttggatggaaattccttaatcctagaatttgggtatgttacagggtaggtcttggacgagggaggcgatggtggccagggtcggggatggctggctagagctgggcgtcacgaagagggcaaaaaatgctgccgcgaccagccgagccgcgccttgccgaggtccaccgtcgcgtatagccgcgtcccaccctgcccaaccccggtcgtcttctccaccccttcccagcactgcacacataaacacaaacaccatgagaatgcagccaagaagcagaaaaacatcggcaaggtttgatcgatctagctccatggacgccatcactgaccttgtggatgccctcgggggcgttggcaacttcagcggcgcggatgcgggagcggtaggtaggaatgggcaggaggcgccgggagtggcgacgagaggaagaagaaggcgggggcgagcggcactggcgagcggcgacgagaggaagaagaaggaggcgtgcggcggcgcggcgctgtggacgtacaattagatgggccaaccctatctggaatccatgcgc

SEQ ID NO: 70065 - DNA, 6059 bp, Oryza sativa
aattcatttaaatggctcgaaacttctaaaattcatatctaattcatatgaactccgaattgagccattcaacttgcaaaattcatctaaaattgagctctacatgtttgtttagtttttatgtactttttcgttggtttttattagagtttttcctcgttttgcgtgccagtgtgtagaatccgtcgttttgaaagttcgcggtcgcaaggataagagttcggaagattgtttgaagaagcaatgcaagtcacacattccccttgagcattttgatcctaatttacaaatattttatcgtttgcaaataaaattgcatgtcttgctaattacatgggatccgggtattacgtgccatgtttacttgatatctgtactttgtcaacattgggtaataaatcgactagctcatgttacttatgtgacctagctagaactttatgcttagccatgcttaattaccactagctcagttgatgcgataattacagtattagacctttttagtatcagaatgagctgcgtgctcgagacatctggccatgcttcatggtcgtaattatccaactaaaatgcgactgaatggtgggctgtaggtgtatggttttgctagtcgcacccatggcaattaaggaccggttcgcgggatgccctggaagaacttatcgtacataccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgcggtgtggtgtgcttggttagagggagttatgcgaagggtcctgtcatggcctctttccggtatgtcatggtggcatgtcggcgcacggaaacgtgtcgtggggctgtgtcttgtgggaacagttgtacacctctgatcagagtaaaactattcgaatagccgtgcccgcggttatgggcggttgaccagattcaccgtgaaatagtctcacccctaataaatcgacctaatgcactgtagttcaggtgggttgggcctgttcaatgtggtgtagcgttgatcagtggagatctaatttactttaattacttaacagttttactgttttgctcaataaaatattttacaaccgcctttatgcaaatagccacaaaccgtccttgtgttccccttgcacgtctgcatcgttggtgtggcttgctgagtacagtggttgtactcagccttgctattatttcccccttttcagaagtgcagtgcttctgagctgaagacgaagttagaggaccaaggctcagaccctagttgagttttgcctgtggagtggagctgaagccccgctaggatcgtctttttccgctgctgtcgttctctttcggtgtgaggactaagtgcctcttctgtaagtattttacgctttatttacgtttagaactctatattacttgtcgtttttgtgtaccctgactggttctggatatggatttaaaatttgggttaaatttctgtgagtgacaccatttctccatggtcctcctctctggccgagcctttacctttgcttccgtctcttcgagctgctgctgccacctttcgcagtgatgtgagagatggccaagctgctgctgctgcctgctacggggtagctgtctttcacgtcagcccgttgcatgcttgcttgctgccctctctttagggtgtgttcggacccaagggttcccaacccttctcaattgtatttaacgtacatgctttttaaactgctaaacggtgtgttttttgaaaaagtttatgtatgaaagttgcttaaaaaatcaaattaatctatttttttaaaaaaattagcaaatacttaattaatcacgtactaatggaccactccgttttccgtgttcacttttccggatgggaacttttgtagcgaacacagccctcacgtttgtttttaccagcacagttggataacatggatgcacgtacgggatcaaagacagatactccctcgtaaaaaaaaaacacatgtgtccaagtacaaacacagtatccaagtacaaactcaggattagatattttttgacagaggaagtatatacctaccagcaaggaacacgatgacgggaacgagggatgatacactcgtctctactataactaggtccaactcccacatatacactatccgtctcaaaaaaaaaaaatcaacctagcaggggaggggatatacccctcctaggatgatccctcctaggtcacatctccgcctagattttctttttgagacgtagggagtacaacttttgtttttatcgtaaaatataatagattttattcaccaaccctcttatttcaaccaatcacatatacttccatctaggggtgaaaacggttacggaaattcccgatcgaccaagcgccgtttccgtataagaggtacctttttagctatttttaagttttgttttttcttatttctttctgtatcatattaatatcgacactgagtagtttaaatgataaatatgatcaattatctttcttcttttcttctcttatgaagtcatatcaccttaattttcctttagatgattaatgtatattatcttccttattttccttttctcattgagacacattactttagtattgcttttaaatgatcaaatatattatttaaactgttataaaccaaatcattttaattgtttatagctttttcaatagtgaaaattatataaaggatataaagttatgtcgtgtagctatcttgcaggttagttttacatttggatgattaatctatgttatattttttccctaatctcattgagctaatacattactttggttttgctttttattgatcaatcataattgtttatagcttttttttcaataactgatcaaagatgaaaatcatataaagttatatcgcatagctacatttaagttatttctactattatgataaaaaaattcccgcaaaaatttctagttagaaactcctatttcgtaaaaaaagtgtaactctagactactatgggttcatttggttccactagaaaggctaaatatttggaaccagtaaaaagacatgcttttaggagcaagctagccttacagggtgagaaaaatcccctggccagggagagccgatttagctcgccttccatggcaaaactccaattgcaaaaacaaaagagaggaaaagctctactcgcacgaaaaaattaggataagataagaacgacccaggcttctctgaaatcagaaatcagagatatttctcgacaactcggcccaatctcataggcctcttctcccacctctcgctgacgaagtctttccctgaaagcatcctctccacctactcataaaagtcacagccatctggagaaaaatcgattagggaagaggcgaactcatccgcaaactcgatctgaggcaaatctattcacacggccgctcctggatcttgtttctctttttagaaacaaaacgagaagcaaaataatcatcggcagagcaagaatttcgtacacgatccaaacagctacccactatttcttgcctcaggaagcaaactaaacacaggaggtacgacaaggcaagcaaactgacaatgagatggtttaacctcaccgagctaggttacttgcgccaagatccaaatataatgtaccctatctctccctttcaccaccccttgttcaatttttttccatctgaccactaactaggggtatgcattagatggtttgttttattttaaacaaaattggtcatctaaaagactaaaagtgtctaagaccgagtaattgttcggtcttttatcaaaacagaaatggttgacagtttcataagagcaagtttaatagtatagcccactattagctccaaatcatctatagccaatgcaatagccaattcatacaataattgtttactatactattaatacatggtcccacatgtcatatacacattgcgtcttggagtccgtgctgcagctggctacagatctgtagcccgctacttttctctctcatcgtttatcgtattaaaatatgtttatagctggctaatagcctgctattgtacctgctctaatgctctaagattataattaaattttggcaacacttctcttcttttaagatttctttactgctctcttgaaatgatcatatatatatatatatatatatatatatatgtatgtatgtgtatatatatatgtatgtatgtatgtgtatgtatgtatgtatgtatgtatgtgtatgtatatatatgtatatatatatatatgtatatatatgtatatatatatatagacacacacactgcatataggtaggagtaggatgcgacactgtaatctgacgtggataacaagatggattgggagcccctttcccatagattttgtgagcaagcatagctgcatgggcattgggcaagctagcagaattgacgtgtgtgtgctgcctgctggctaatgaccggtggtctcaactctgaagagaggcgtggcagaaaggggtatggtttcagttgggattctttccaagcctcctgcaagattctcaccaaaaggcagcgatagattcgaaaggcaggggatactctcgtgaccattgaggtctttgacgagagccttgatggcgtgaggatgtcacgacatttttcttttttttgttaaaaggaaatttggtcttgaaggattggaatgcaaacttgttctaattaatttgtgtttgggaagtacattaacagaaaagtgaagcacgaaggtacttaacatccaacccaagaatcactagggctgtgctatcgatcgaccacatcatagtttaggacaggctttccttgaacaaggtatctttacctctatatgtttagactttagaggagagtcgacagtactaaaataatcccttcaaattgtaattttcaaaaggctcagagaagcaataaaggaataaaaatccaatgacatcaagccgtcaaagggcttcatctttttcttatgcttatacttatcatccaagatttaaattttcaaccatcaaagtttatttttcagtcgttgcttttagatcgctaagaacacgtatataaaagttttattcataatttacttttcgtttgcaaatacgccgtttcgcgatggctccgaatgatttgccactggccccttcctgtgagtgttagagcgcaacattcataggtgtgcatgtgtgcatcatccgtgtaatagaaaaaaatgttcaaagagttttgaacggtaaacaatatcttaacaacttaaaaattgataatgttccattcgtcacatcattttttttccataagtctgatggagcgatggcctccgtttccacacgcgcgagtaacgcatcgcataagacggataaagcacaaattcaaagatagatcaattttttttcagtccgtcattctcgcatcattccgagcccacatcaaattagatccggtcgggatttcacataatcagtttgtgttacacctgtcctagaaaaatccctaatttgtagaaaccctaattttcaaaatctcctcaaattagatcccaaatacaagaactataaagaatggcaggcaaaaaaaaaaacctaaatcatggtcacaccggtttagatcttcggccgcaaatatggcatgatttcagaaatccgattctcgcccttgactaccgtgcacgcaccctagccgtgcaacactcatgagtagaatgccagcagcagcagtgaggatgggcacagccatctgtattcgggcacgccggttggaatcgggatcaccattccctgaacatagcccacatcggaatcgggcacaggccaggattggaagattaagaacaccccagcagtttcagatcctgcaattgtgcaggcacctgaccagaaagctcattgttcggcaaatcaagcgtgctcatcttatccataccataccccc

SEQ ID NO: 70066 - DNA, 2192 bp, Oryza sativa
ctaatagttgaacttaatgagtgagatttgtaggactgcaattggtgaactataggatagattagtccattatgtaataactggtctgacaaaaattattcaatcattcagttgtattaacattaggttgcatatatggattttttctgaactacctaaatattcctaccatacactgtttatagatggtgcaaagacttaggctgagttctttttagggtgcggtaaaagacttgaaaaatagattaatatgatttttcaaagcaactttgctatagaaactttttacaaacaacacaccatataacagtttggaaagcgtgagcgtagaaaagaacttagggtaaaagaatatatcattaggtagtgtttggttgcaaggaagggatggggtgggatgggatgaacccacttttaggggtgcttggtttaggggtaagtgggctggtatggtccctagagaggaatattcctctcagatcatgtaccaatcaatccagcaaaatcgaccggacgagttcgccctatctgggacgagcgcacggcatgagccggtgctttaccctgctcgcgccgtcatctgtccgcgttctgttgcccttcccgccaccctgctcgctccgtcgtccatccatgctcgctcgcccaactcgccgccctgctcgccctgcacggtgggcgatggatccaatgatgccgccctcgggagaacgggctcaagcggcggtagacggcttgggcgacggcggcggcggggggctcggcgatggatccggcaagggtgagtgcaacggcagtggcggcggtttgcggccacgtcatgctcctcctcccgcctggctatccccgagacggagctcctccgctcgttaggccattgtcacacatatccgaagtgagtgctcgtcgttgtccttcttgcaagcctgccctcgccgcaagcttgcttgcccgccggcccatctcgcgcgccgcccggtcattgatggtagctgcaaacgtatccatcccatatctccctcatcccttcaaccaaacaaaaaattgtaattgtactatcctacaaaccaaatatgtgagtggaatcatcccaactctaaaatcaagaatggttaatttcatcccatcccgcctagtccggaaaccaaacacatgtttattttgttcgtatagttagggcacccgcaatggttatctataggctctctacaagagatccatgtcagcatatttttctacttgaaagaaattaaatgaagagagagagcaaagctatctactaacctggagatagtctatagagaaaaacgaggtaatgcattagagagctatagatatccatgtagacatactattgagatggtttactattaatctaatctattgctgagatgtacatattttatagagagcaccttactttaccattgcgggtgcccttacatgggcaaaatcccgtataatttttgggatagaggttggaaattgtacacttatttcggcataacctaggtagttttcacgtagctaagaatagtatagactgtctgcagcagcgatggcacaacgatgaccgccgcagccgccacgagcgacacgaccacccatggcgacgggaaaaagtgaagcacaaagccgccacaccaccagctcaccttcctgctccggtggcacgccacggcatccaccatctccgcgtactcgtcggggaggcgcgcgccgacggtctcctccccgagctcgcggaagaaggccaccagctccgcgtccgtcttgcgcatgctcgacagcacgcctcgccgccggaggaacgccgcgtcctgcgggcaccggacgaggccctccatcctcgccacgtgagccgtcacgcacgcgccgtgcgcccagtggaagtgcttctcgaaggcgatcatgttgtgcagcacggtggcgctgtactcgtgcacgtcgaggcaggggatggtcatcaccgccacggggctcgccgtccggccccagaaccacatgtcgaggtcgccgcagctcgccgccgcgctccggaaccacaccgccgaccggcagagctccatggagctcgggaacagccgctccgactccttcttgatcttgagaagcttccgtggcgtcgacaggatgcagtacttgctcgtcggcacgcgcgaccagtgaaagaggtgtagcacgtgctggaa

SEQ ID NO: 70067 - DNA, 639 bp, Oryza sativa
aatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagcgcggcagagtagcagaaccctaggtggcggcggtggtatcccgttcgcggcggcggcggcggcggcggcgcatccttggttctctgggaagagctgcagaaggcaaaccatcggtttgccattctccccttcgcggcggcgcctcatccattcctctcgacaccgcctttttccccttgtccaaatcgtcgcgggacttcgatgtatgcgtgcgtgttcggccatggatgagtgaagcttacaatttcaggaaagtacaagaagatgtttgagatggatatgaagtacaagcacacaatttgttctagacgttgataaatttgtcatgctcttgtccgttcctgtagtattggaggcattttataatggagtcattggactgtaatcaatcttgatgtgtttt

SEQ ID NO: 70068 - DNA, 9319 bp, Oryza sativa
cggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaagcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttataacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtacgtctcatctgttttctcctttttttttttccttattgacaggttgtgcaggtcgatgacatcatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatgttatatgcagtgatctgcatatatgtgttgttggggatctgtgactggaatatatctgtgatgtttctatttttcagagggcatggctagcaaatcctgaggctagccaatatttagcatttattttttttctggaattaactcatcagtgacgggtcagaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtggtctcttcatgctgaagtgcatggaacactggaatggatgaaagtcaaccacaaaattgaagcaggtatgtagtttactacaaaagcatgtatgtaaacccatcaattcaaatttaaggctaaaaaactacatctgcatactatacaaggtgatatagacatcttcagacgcaagctagcggcaattttggttggctccgtattgaatgataacatcaaaatcccaacatacaagaaataggcaggtggcgagaagggtgtttggccgggagaataataacagcaggatttacaaataactgcatctaaatatttcagacgtattcttatttttataatttaaacaaattatggatattagtatattcactgtacttggctcaattttgattaatattttggtgttagagaaaatattagttaggtgacaattagtactcaactcctgcactgtattactgttcaatgttcagaatcacgatgagtgatatcaggatattatgttttcaggctacattgttgcaatgtacgcatatggattttcttcatttttttctactcactcttcgtcctgctctattgctgctactggacaaaggccccagttttttcaggtttttattttctttcttttgggttgttttctgatggcatgatgatccaaatcacccatttcgattatttcctacagccgtgctttcagtttcatgaacacttgcatctaaatacacggtaagctttataaacctcatggctaattgtcagtacatagcaagatcgtcataaaaaaggattattctaatgaaatggccaataacatatcccacagggtcttttagttgaggagctacacaatgcatacaccaactgatagcagaaagtatagagcatgcaattacagtctggtacaggacacaattccaaataatataattgtttcaatattcaccaatggccagacgagcatatcatgagacttcaggaccctcaagttttagcactatcaaggttttcttcagttttgccacgttggatggaaaagactgtcccatctcctataaatttcaaccacagaatgtcagtcatacaccgccattgattacttattcactatatgcgcattcgcatgtgttacgccgataaccagtttgcaatctaacagaaaattcaaaatgcgaataccaactcatattttcatgtgtactactcataaacctgaactacataattataattcatgtacaaccagtaaattttttaacataaccatatttttatgtgtacaaccagtaaacctgaactgcataattataatttacgtacaaccagaaaaatttctgaacagaaccatatttacatgtgtagtactcactggttgcagcttacaaactatacatgcaacagtcacagatcattaattagttcaatcaaaattaccagaaacatactatatatatgacctagcgaggagtgatagctactggagtactcaaaataaatgagtcttctacaggttatatcaacatatcttgtatatattcacaccctgaagactgaaaaggtactgatctccttaacagaaaataaacagcgtcccagagcatgcccacggcgtcgtcattaaacctccacagacagtagaacaaccaccgcgaatctacggaacgtcccacccgcgtcagccttgatggcgaccacaacctcccttgccagcgcgtgttcctgcttgtctgcgagggtgacgtgcataagcacagtcccctccacctgccgcgtgatgtggctgccgatgaagcggaggaggcatgcagcagatgagacgaggaggagctggtaggcgagcgtggggacgtcctgggcgtcagcgatgaggagggagacaaacttcgcaacgaaggcgggttgacggaagctgtaggccgcgggtaggtcgtaggctctccgacctttcattatatttaagggataaagtaaataattcaagtcatcaaacaaatataataaaatatccgacgtcttaatagaagaatattgaaaatattgtggggcctttaacctgcccgtcaacttcaaactgagatgcgcccgttaaacaactcgaaggccacgaccagatgtgttacacatttaggagacttgacaaaatagctaaagatctacaacatctcaaatattcttaactcatactcatatgaatctaattcccagaatgtgcactagattcacgatgtgcactagattcacactttcatcttaagcatggacatacatagcaaacacatttaagacgaaagggacttgaagacttacatcaacctaatagttacataggccgaccggccaaatatatatatgagagaacaacggaaacttgtctacccaaaccacaagcacaccgattaggggtttacccccattaagttcaagtcctagaagaagcagacgattacccgcgtcactcgaaagactaagtctaagacctacaaacaaatagttaatccaatagcaagagtcagcacattattagaaataacgtactggcaagcaccaagacaagtctaacaccctacttgtaaggcatataatcaaggaaggtataatatggttctttttagcataaagcaagttttatttgcataaaacactttcaaatcatatttactttcaaataaatttcagcaagctaatacttagcatatggacatcaaagtaggcattaatcatgtgtaaatatgcacctcattgccatccatggtagcaaggagatcattctcaaatctcaacataatttgaaggtaaatttcagcatttagaagaataaacacaagtcaatactcaatgcatatccacacgccgctcatgaccacgagcatgtctaatcgattagtttttactctgcagagtttgtatactttacccacatgatacgaaataataatcatgcaagagcatggtacgatttattacctgcaacaaagctgttccaaaattcatgatttagacaccagcacgatacatgtctctctatcataagccatacacattatatgacctagaactgttaagtggcgggcccacgccttaaacttaagtggcggccgcaacgggaacccaccacgtggcacaataccattgtattgaacagacttagtcacctaaactaccacgtcggggtaaatagaaagttcatctgagttatccgaactcatacacaccggtctaccagaatgtaaagctaaaccataaataatttagtaatcttgggctatcccatactagcatatgtggttgtattgtatacgaaatgaactgacattgagtgaagtccttaggacggtttgggcacactctccccctatcggtacacaactaatcaccatatatgcaccacttgagacccaaacctaaaatccatgttttccatcattttatttgtcaaatacttcatttaatcatctttgtccagaatcttaataaaatcattttccatgttaatatgagcccaagagataagtaaaactattctaagcttggctaagcaatataagtaaactagtgataatgtaactcatattccaagtagtaataggatataattcctaattaaggttaggaatgagggatatggatatatgtgaggttaaggtgataatgcaagtaatgggtgttggtctaacaagtttaacaaaattttaatttattagtgtacaattgacatgcaagatttgcaaacattttcaataacctccaaaacataggatcaacttgatcaaagagagagggaggtgggacttgccttgtaactggaaaatgtcagcacctaaatcacttcttcaccgcttaagaaattatctatataaagtacacgttatgccattaaacatcgaattatgcgaaaaatccaaaatgctctaaaatgcatgatttgtgcacagtggatatgtactggtctaagatgaatttaggtgaaagaatttctattttatctctttttatttgtgaattatgaattttagaagtttacatcggtatagggtagtatttacttaggcagtttataaaatatttttgcaaagtgatgtttattaattttgacttcacagaggtgtaaagaagtgttttctcaaactaacacatttggtttcacaatttttggagttaatctgaattctttatgtattttacaagttgtaccgtgttatagacgtatagtgtctatgtgtacatggctttggagatttaggtctagaacttgctccatcttgctagttatatttaaaatgagtattttagttaactaatataatcttaattcataattttagagtttatattattttactacacattttataaatagggatgttctatgttagttatttaacataccaacctagaaattgttatatgagttaagtttgcaaagtctttgggaattaaggtttgaactatgacctctctggtctaacaagttttattttggtttattcatagctagagtgcattttaaatatttctatagatatattttgcttaaccattactaggtgattaactcctaggttatctatttaaagattagagctataacttagtacagaaaattccatatttcattttactatgttgaagctcacaatttgctggttctatagaaacttggttcactccatttggacaaaagatgaattggttattacttgcataaatatttagaggcttttgttatacattaagtatatacttttattttacaatctggaaatacatattttggtggttctacagaacttaggtttactcaaaaaggatataagatgaattttatataaacttctaaagttcaggttatgtaaaactagttattttaattataatagtttagaggcatttgatgtaaagtgtgtatatgttttactttagtttgtttttagagaacatgttagtggatctgtagaaactaagtttgctctaaaatgagttgaaatgaattttgtaagcattttataactttatgcatgctttatgtataatttttcttagataaattttagaggtgaaatgtgtactgtgagtgcaagtttttatttcataaccttaaattcataacttggtgagttcacagaaatttgaatcatctcaaaaagagttatatttgattttatatggattttacaagcttgtgcatttttctgttaaacatatattagtttgagtatttcttttatcatttcccagattttaaaggatggggtccacgtggcagtgagagaccaatatgcagaaaggtccctggggttttagaaatcaacccgcgatcctgtgactgttctctgtgtgaggtagttttacaaagtagtacctaaagttttgtttcttctccacagaggtccctggttcgagctgaaacagggctagccatggctgagctcgatctcaagcttgccagcagcaaacggtggctcgtttgaggttgaggtaaaaatatgaaatgaagagcacgctctcgcgattccatttctctacttttctcggattgcggacatcggagtaacgccggcggcgagtccgagcggcggctgtgcacaggctgctactgcatgtgcgcctatagccatgtagtgatcaaatggatgcatgcatgtgtttatttcatgtactacgacgctcaccgaagcttgatcgcggcttggagtggcttgaacagcggtgacagtggagaagacggcccggcggcggcggaaatcggcatggcaacggtgacgatcaccatccggtctccgggctgccagaaaaagagtgaaacggctcaaagaccatctaaggatgctacacgagtgaggaattgcgccgaagctcacccgggatcaaggaatcgacgaccacggtcggcggccggagttgaagaagaagggctcgatctcctcgatggcgacgcctcagctcgattccttcgatgggcttgctactggcatcttggcaactctcgtggcgcgacggttcggcctaagatccaccggatttgacgggaacagcggcgcgatccacggcggcgctccgggcttgctcagaacagcgatggcgaggtccgcgttcccgaatatccactgcatgaaatcgactgaacttaagggggatggaaccagcactgagaggagacaagggaacgaacaagatatcgagacaaccgcggctcaaacggcgatggcgacggttgtcatccttgcggccggcggcaagaacttgagcggcggagaggcagaggctctccct

SEQ ID NO: 70069 - DNA, 937 bp, Oryza sativa
agctcggtacccattttgatattttctatttgttagtagtgaacggttctaaaatgggtattgtatccctttttcctcgatcgtcaacgagcaagaaaacggatgcgcgtgctaacgctttcgcgctagtgcgctcaatccggtgcttgtttggatgtaagagatctcgtttgctggccgggcccttccatgagtttagatctctatgtatgaatctcttattcaatcccatactttttctcatttcagaacgatcagcatactgtgtgacttctgcgtgacagttcttgcatttcgtttgttgctttgcatgaacatttagatattggaaagcccttaattaggaatttcatagatagagaaggacgggaaaaaagagagagactgactaactacccggatcaatgctgattgacgactgaataaatagccggaagcaacaactgcacgagagagaaagagcggatccaactaaggaaatgcagtacctgttctgccggagctaatcatgcaaagctagcgtagcgccagccgtcgaagtgaatgaattcgaaagaacgaagaagtaaggaaatgagacgactctttcttgaacaatttcataagcagatcttcccctccacaccaatcacgagtttttttttattcctctcgtatatcgtcgtcacgcccttaatgataggttttgaaaaagatttttcatgtcattcccatttaggttcgattcggatccctctgttgtttccctttcctcccgaacctttttctcgaaatgataaagaatctggtacactcgaattgtattatttaagtgcttattgcttgccaaaaatcctacttctacaattggtaggtcaccgggttattcaaataagtcgtgttttctgtgcttttcccatgttacaacttccgtaccaattcgatcgatccggaatgg

SEQ ID NO: 70070 - DNA, 649 bp, Oryza sativa
ccttgaatcagataggaaatcctcacttttccaagacaaaagagaggcaagcacgggatggagcaactagcgcgaaagaacaaggaatgagcgctttgttgctaaagcgcatacgttttctggcttgatttttatacgattttttgagcaactagccgatcacgaaataggctcatgctcactcgtggtccctactgcttatgggactgtgatcgaatccgatctggaaaacagtgctttctgataactaatcactggaagcacccgattctctctactctgtttcacctctctttcttttggcttcttcttgagaatattttcacgttggatgaagggatgggctttcttttgagttggctttgatcgattgcttggtgtcacgctatttactactacggttagctaaattcgtttatgacaccgattcatttctagttgatccattcgtaaggtcgttcagaagcaaaggcctactactatactatacaagtaagctggtcaagtcaaaagaaggttcctgactatctagtaaatgagtgcacgaagaaagggaatttcatgtgtgagcaccttgcctcttttagggaaggctatttaccaagtgagtctgcgctgcatgctacgaaacataagaatcattttgaat

SEQ ID NO: 70071 - DNA, 1169 bp, Oryza sativa
atattcgtgttacttcgtctgcacttgtttgtacacgaatgcgtgagttataccgagtactcagtaaattatggacaacttcaaatcttcgttttcgagagggatgatccactccgcaaatatcgatcgaaacttgaacccttgtataggtatgccattttagaaagcacaacaatggaaatgggtagtcagtattggtataagatctattcccatgttccgatcttttcattttatgtacccatttcttgggtaaaatctcccaactatattggaaaatggattggttatccataaatgaaaataaagaaagcttgattttggttccgcttcttgctctaagcagaaagacttgtcggaaatcgccggttgggttggtccgaccaagaaaggcatgggagtggagaggcggaagtgaaagactggctaccaataaagatccctcactgcacactttatatagttctgtatccaggatcggctgcatgctctagtgttgaatctggtatagaacccaggatgcttggttacaattccgaatacgctaaaccatgtttgttttatttttttttctcgactggccatgggtaatgagtttcgatgtattgggcgtttccgtttagaaatataagctttttcgtgcttgcttgcgagcattggaatggcctgaatggaatgaatattaagataaataaaagaaagaaaataaacaattgagaaagttattcattcttatattaatttcctatacttgaccgaacaacttccaattccgttatttcaactacaccaaatgatctttcgaattggtcaagactctcctgtttatggccccttctatatggttgttgtttcattgaatttgcttcaggctcgcgattcgactttgatcgttatggattggtaccaaaccaagatcaagtcctaggcaagcggacctaattttaacagccggtacggtaacaatgaaaatggctccttctttagtgagattatatgagcaaatgcctgaaccaaaatacgtcattgctatgggagcttgtactattacagggggaatgttcagtacggattcctatagtactgttcggggagtcgataagttaattcctgtggatgtctacttgccgggcttgccacctaaaccggaggcgggtatagatgcccta

SEQ ID NO: 70072 - DNA, 4450 bp, Oryza sativa
ccatgatgagtttgataatcttttgatgctattaagcgataatagttaccagttttatgtatgcttatccttgtgcattttgtctattataatcgttgatcttaactgctccggtccacaaacttgtaagatgggtgcagtttagtacaatgagttgtaaaatgctcaaatcagtgcaatgacttgtgtgtgtgtgaaccaagggtgagaatagtccacattttggttaatcaaatcatttgagtgctgactaggatgccataccagcaagcatgtaaatgcgtataaggcatgtgagtgaacagtaacatgccctcccggaacttgcttctttcctgctagaggctaccttctctttgaatattttttacatgacgcatggggcccactcatgcagtgtggcacaaatagtgcaaccagggcaccgagttgtgagatgaaagatttgtgcagtgagggagatcaatcaggataaagaaactggaatttcgttttttctgggtggaggcacgggatgtccgcaatgatgacagctcaaggatgagataacgattatccaaagacaaggcacacaacctcatatgtatggtgactcattctaccatcattatcaggaatgtcaggcaccgctatcaatcttctgcagatttccctagcaagataatttccaaaaggcataggagaactatccctatcttttctggatcacaagattcatgcatgcattcagcagcataacgctccgattcgctaacatggactattttggccttgttcgcacgcaccatgcaagtagttgaactggctcaaatgttttttagttgtgctgaattgcacctaccatgtaggttcatgcatccaaagtacaattttactctttcggtaattgctatattctctggattaagcactgtcagctgtcttgcaaatgtaacatgcaacctacaccgtctgtttttagccatttttctgtttatatactattatactcattcttgagtactgttctcaggaaagtgtggaggcgaccgctgaggtttctaaaacctttgatgagaagataaggaattattgtgacgtgacactgatgtcgctggcatatgctgggacagggaacgtgcttaaggtgattcccaatcaacagaagaattgtgcatggattataggattacaatattttttagtgcctatttgtttttgacgaatctttccgtttgatttgcaggttcaaaaactccttggaatctgttccgagcatcttgagaaaggtgaaacccaccaaggaccagcagttcttggaatctccctaatttccatggctgaagaattaggggcggaaatggctgtacgttcccttgaacgtcttttacagtatggcgagcagaatattagaagggcggttcctctagctctgggcttgctttgcatatccaatccaaaggtatggtacatgatttgttatttttgtagtaacgtcaaatgtttgttatctttgtgccgttgcacacaatcattcaatatatagaattgctgataaagaattattcgataccatgccatgacagttagttttgcactctgctacatcatcaatttcaattcactactcttgagaatgtgctttgtcacacgactactatttgatcctggttattcgaggaaaagtagcatatttctagttaaaattagtagattgtatcatttggctagataaatatctcatatagttttctgatgtctacatttctaccacttgcctgtcaattaggtaaatgttatggacacaatgagcagactgagccatgatgcagatgcggaagtttctatggttagtaacctcactaacaaaacctaccatattaagttctatgagcattgatatttattcaatcaaattggtacatgcaggctgcaataatctccctgggcttgataggggctggtacaaacaatgcccgaatagctgggatgcttcggaacctctcaagttattattacaaagaagcaggacatctgttttgtgtaagttcaaatctaaaataaacattttttatctttgttttgccaattattctgatctcatgctgttgtattcaagtttcatatcagtttttttcatttgactttcaggtgaggattgctcaaggtcttgttcaccttgggaagggtttgctgaccctttcgccatatcactctgaccggttccttctgtccccgtgagtaacttgcaaagttgttgaatctccttcaatcttattggaaccacattttctaagagagtccattcttcacttttcagcatagcacttgctggtcttgtgacggttctgcatgcctgccttgacatgaaatccatcattctggggaagtaccattacatgctttatatccttgccctagctatgcaggtatatatctcgttcaaagatcttggtagtggacatattagctaaaccagtcacatggattctcagttttttctctactgaaacagcctcggatgctattgactgtggatgaggatctcaagcccctctctgttccggtttgtgttggtcaagcagttgacgtcgtcggtcaggcgggtcgacccaagacaattactggattccagacgcattcaacgcctgtattacttgccgcaggggaacgagcagagctggcaactgaaaagtaaactaaaacatctggagaacaattttcaaatttgtcagttgatctttgcttatgcttatgttctttctatatgcagatatcttccactgacaccagttcttgagggttttgtgatcctaagaaataacccagagtatcatgaagattaagggatagatatggcacacgcaaaatgcaggaagggcctggagtattaggaagaggcttggatcaatatctaattgtcacacaaagcaatgaacaaatagcacgatgaagacaatgcatacttgatacggtgaggactgagttgtaacaaagagttcaggtataatggggccaatatgacaggagaactttgtaagaattaggaatagaatctgtgggtgtaatggcatggccgaaaatgtttttgactataccagaatgaaaatgacccaagagtttgttgccacgtccatgtatatgcagccctactactcggttgtctgatgtttcctttttttttttgaattgatcgttttttgtttgggtcatttgttacagtggctcgcactctagcagcagaaacgctgtactttatgtgatgttgtgcactgagtacagatatacagctggggatatcctgatggtaatatgccaccgactgcatgaatattagtttgtccgtatcaaaatatagtaatctagcgctgcatcgagaagctgagaaatttgtgtttgtgttgataggggtaggttgctagagcggcattaattgctgcatcacagaggatataaattcccctggtttctcgtgccgttttcttgggaaaaatttgggctccatctcgtggtggacatcatcgtcgtctccggggaataagttcactttaggtccttcattttgacatccaatttgaattgcatacctaaaccgttaaaccataaaactagatacaatgcattcctccaaaactactgagggagttaaattttacggttgggaggtctaaatattgtggtttagagatatgaatctattggtcactagtaaagggagtcaaataaacttattcttttattacagctttgggctttagttcgcattaatatggcaagtttgggcttgttaaataagttacttttggtgttggcccagtgaattttatgtcttgcagatggcccatttatatgcagaagtttgatttgcatgtacattttagtgtatcaatcctgtccattcgtttattttgatccaatggccgaaaaatcgtgtgagccctaagaaaaaacctcagtttactcgagtatcttcccctccttcccttcggcgcaaaagaacgagaaatctcccgtcccgtggtctcctgacgagccgcggctgaacaggggaggaggcgccgatctccatccggcgagcagagcagagcaggggatcctggtgagcatccacatcctcctcctgattcatctctctctcccaccgggagtacttttgtctggaatttgcttgcgttcgttaaccctagcttctcttctagatctggaagaagctcttcttttaatttcagagccttaacctgtataacagtttgtttgtttgttccccaaaaagtttgggggttcaactgaactgaacgccccatgtcccatgttggatccgcccctgcttttaggatttctcatggttaaatctcgtcggatcgaacgagtctaaggcttggagagtcgttgatagtcctaattattaatttgctagtaatggagtttgggggaacacaaatgcttggggtgagtattttgcgtctatttt

SEQ ID NO: 70073 - DNA, 3297 bp, Oryza sativa
ccactccccccgcctcccctcgtttactattggtcgccgattacccccctcttctcctcctcagcgccgccgtgccaagaagccgccgccgcgccgccgtgctgagaagccgtgcgcctgccgggactcgtcgtcgccgtgtgccgcctcctctgctcgtcgtctcctctccaggtacccctctctctctgatgcccatgaatggaatggtgcagtggatggatgaataaatgatgcaatggaatggatgaatgaatgatgaactttggatgaatgatgaactttggatgaatgatgcaatggaatggatgaatgaatgatttaagtgccattttgacatgtaaccattcatggagtgtgtaccgctttatatgttgttttgttcccttttgctagaactattgaattttggggataatgtttacatttagctgaaaaaggatggattgatagattggcaacagtgtttctagcttggtagggtagctagctagaaatagtttatctagctagctagttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctgtcattctttgataattaaggaactttattaggtttagggtttgaaatttagttcaaatggaagaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcattttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctattgttgctgcccctgtggagtatctttgcccctgttgctgctgcccaatgtgttccttgttaaatgcccagtgatgaattgctcaataagaacaaattatctacacttgttttttttttatgcataagaacagattttctgcacttgctcttttttctggattgataagaggagactatatacacttgttttctgtcattctttgatgatttatatacccttgctgctgctgcccaatgtgttccttattaaatggccattgatgaattgctcaataagaacagattatctacacttgttcatttttttgcccctacacttgttcatttatatacccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgattttctcttttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcg

SEQ ID NO: 70074 - DNA, 757 bp, Oryza sativa
gaattcctgcagccctttttttattttcaatccatggcaagcgaataagcaatataccccaaatcatgtacccatacccagtagacatgacaactaacaaaaagagctgaaagtattttatgaatgagatttttagcttatagtgatgacatgatattggtgtcagagtataggtgaggcatgcaggtgcagggggactttgggaggcatagaagcaagtcaacttgtaccaagcaaacaagcatgcatacgcagccctatatagaaacggagtggagtaggtacatcttacagctgcattagtacataatggactgactcatccctggtgcaatgtgcatacgtgtcagccatatgaggtgggtacatatgaaccttggttcacttggttcatattatgcagctcctatatacacctaggtgtatgtactccctctcccatctaccgtccatcacaactagcctctcgatgaagtttgttaccggatccaccaggcagaccccttttaatttttcacgagaaaaaattttgcgtagtaattggaaaacaggaacactcggagctcgcgtataaatacctctcgtcagcctagatcgataaaccaggtcatgagctgtgtgcgatatctacggactacttggagggaacaacggcgggatccatcagttggcgtctacagcgagtcggaggcgatggtgcgatacatcggcgcggcatcttctgccgtgccgtcatcgcaggatccctacaaaatgg

SEQ ID NO: 70075 - DNA, 3648 bp, Oryza sativa
ccggtgagctccaaggcaaagccttgttcccctcgcgccactgcctctctctctcttccccaattctggccaacgccgtccgttgcggcagcgccacctccacgccatcacagagccccgtgccgcgccaccgggttagcctccatctcctcttgctgacgccaacgctcgtcgcggcagccatgcgccgtcaccgacgaacgccgccgcgccgccgccatggcagagcacggccagggagccatggctactctgcctcctcctccttctctcacatctggttgcagccggacctggtcggcttatacaaatggcccatgggcaaaattgtcttttatgaaagtttctctcaccgtttcagccagaaataataaaataatgggaggagtgtccgccagcaaattaccacattttttcggtgtccaagagcaaatacatgatctttgggtgtctcacagcaaagaccacaatctttaaatgtcctgtagcaaatttttccaaaaattaacatccatcaaaactaaaaaaaaaacatccaacaaaatttaaaaaaaagataaaaaaattgcaagtcacaaaaaaaacatccaacaaaacttaaaataaaataaaaaattacaatccaacgaaacttaaaattaaaaaaatgtccaacaaaactaaaaaaagttaacaagtcacaaaaaaattaacatccaacaaaacttaaaaactaaattaacatccaacaaaacttaaaataaaatatgcgtccaacaaaacttaaaaagttaaaataaataaaaactaaattaacatccaacaaaacttaaaataaaatatgcgtccaacaaaacttaaaaagttaaaataaaaataatttgtctgagcccaggttcgaactggggacctttagtgtgtgagactaacgtgataaccaactacaccacccagacattgtgattgaagaaaaaaatattgatgtaatattgtaattacaaagaataatctaccaactgtaaagaacggagagaatactggagctcatataatttctgttgttctgtaagaaacaaatctgtaaaaaattttattggctcaaaatgcatacaaattttcagactttgattactcgtgagtcgtgacacgtccaacacgagaaaatcgttttcgctgatcagtcctgtccagggcccaaaagtgctgaaccagctgattcgcccatagaggcccacaacgcccactaccaaatcagaaaaatacactactctgcttcataaatggactaatatcttctgattattaggactgctcagaaataatcccagcatgcaattttctgcatcagcttttcacctttggtaatcttgtctatagaggcagataaagttccctctgatctttatgaactgttttgtatgccattcaatgaggttcaacttttcaaccgaagtactccacttcctacactaattcatatacgcacaaatataaattcaaacatctactacttggtaacatttgactaataattatggggaaatatcctgggaaaaccatcaaataagtgaaaacctatgaaaaacatacctaaaaaatctctaaattaataaaagtattagtagagatatgtataggcatgaaatactttcatgtcaaatctcaagtccaaactcaacttcctctgagagttactcccaaataaagttaagtttgaatttaagatttggtacaaatcatgcatatacttctctccaataatttttcatgaatttagaaaacttataaatatagttttcatgggttttcaccatatatgtccccaataataccctaacaaattataagtttacagttataaaagtggtacagttcgattcatattttaaactcatttcacacgatgttaatttcgtaattgttgataaatgtctcatggaaaaggaatatgggcccagcgaaaaaaagtaatattgcaaaaattgaagcatggctgatgtgatactgtaggagatgcacatttggagtgggccaagtcattggattagcaaaagggaaagagggaaaggtcattgtttctatgaatatgatagcaagcaactaagcaagtgctccaacagttgcttttcttctcacttgtacaatcctactacatcacaaccccctgatggttccttctctttttctacttttttcttgtttcgttttgtgttggatttcaccatcataagggtgggcaatgacaggattccgcgccgacacccgcgtcctattggctgccatggagacttaaattggcagctccaagaaccctagtggtgcagacaagacttttatcaggaggaaattcttggagcccacaggcatgcagctctgaatttatcatcttggggactccatgagtgtcatctcaattggggtccatgcagattttgcattcatgagaacaaatagcacatttgagttgattttgtgaagatttgacatgttacacttgtactaatgcataggggaaacaaaaaaactcaatttgctcagtactccatgtatatgaatatgatctggatatcaagtgaatgcaaatattgtgatcatgatctcggagtaatttaattcacacatttgagtagttgtgctaagatagctgtaatctgtataaaaggatcatccaggattcaaatgctagaacagtacggaaactatggaaatcaacataggagtagaacataagaagctactacctccctcctaaaataaaacaacttttagttataaatctaaaaaaatgtacagctatattctaagacggaggtaataataaatagtattagtaagacaacaaggacatcatataactcaatatgagaagcagcgaaaattggatccatttgtcctgctaaggcttgatgaatcactgggacccatttaggtgtcctacgttttctctggacatatgattcaaaaatatcgaggtgcattcagtgaagtttcggctgtactaattacatctttcatgtccttgctatgcttcatttcaccatataaaaagaacagtgtattcatcctcgcaaaaaaacaaaagaagtaaagaacgagagtaaaaggagtaacttacaatttggactagggggtaggagttcacaaatacaagagaaataatcggagcttcagacacggcaaaaatttggactagggggtgggagttcacaaatacatcaggcatagttactttatgtttttcagataacgtatcaaagattcaaaatttatgtgatactccatactcaactttgccaaaaggcacgtgcaagatatagttctctggcccacaacaaaatagtctcagtagcagagcaatgatttctgaactgcggaagctggtgaaaaaacagcttcttttgatgactagtggcagtgcattgtgcagcttctgttcattctgttcctattgcagcagccagtctctgcttgtctgaatgtgattcactgcagcaatgtctgcttacaaggacaaacagagaaacaaaagcagcagccaaaagggaaagaagaaattcagacaacagagccattgaaattcaatcactatcacaggtgcctttttgttactagcatggttgcattttttttttgaaggaaaaaagaaagaacatttgtacgggcgcagga

SEQ ID NO: 70076 - DNA, 1133 bp, Oryza sativa
gcatttctaggacttagacgcttgtcaatggcatttcttggattatctcaaataaataagtgaataacatgttgatccaaatataacaaagtgtgacaagtctaagttgtgggagtgaaacaaatatctacctaactgatgcatgagttctaaagaaaaactgagacatgattaaaatatttttcacgaacgggcaaaaggattgcacgtcaatgtattagaagaaagtagagtttcagttgtacaatgcaaacggcgagaaagaccattgtcggaggacaaacatgattaaaatatggcttgaggagaggagtaatgaacaaaacaaccccttcctatacacattggtggcttacaggcttaccattaaggtgcagtaacctctcttcccctgctaaggtaaaccgtggtgtaaagtgacggtaaatatttgttttagatttcaatcgctttaatttgtttgggggctagaatagctggatgcaattatcacctttcaaaagtgaaactgataacaagacaatgatatgtcggaggaagatgtaataaggttgacgagaaatagtacaacaagagtgtactacagatatgaacaaaaataatatcagctcgatctgttgggaagtttgctttctattcgaccatttgtacacacatgcattgatgcatatgtgcacatatctctagtcttttccaaatcatggacgagccatcataatatctcttcgacaatttgacgatgatatggcgcaaatcatgcaagatattgctgatcagattgcatggttggctatgtagacccagaggaatgatggaattgtacgtgcagataggtgttttgagacaatgacatgaacagcagctactcgtaacccgttgcatctaattctgcacttaattcctttgccaccttttaggttctcgcagcttttatgtgcgctttctctaaaggcatgagtcccttttcttgaaggaaagaatatactcaacccagtcgtcagtgcacgaatcgtcacgtactacctccgttccattgtaagtgcagttgtgggttttcatatctagtgtttgactgtccatcttatttaaaaattttatgaaaaaataaaaaaaatagtcacacataaagtatt

SEQ ID NO: 70077 - DNA, 7187 bp, Oryza sativa
aattcctgcagcccgaaactttaggggccaccggacattctggagactcgccacgaaggccctacaacccgttcctccaggggtgagcgtggggggagggccgcctcgtgaggaggaacctggcactctagatgaggaggaaccttcccccatgcgggcagctcgacgctcgtcccggcgtcgctcgatattgatctgagcgtcctgctccccgtagagaccgtcatgacgcctccggcttcccgaggctcccgacgacgttggagccgtggaccgccttgaggccatggccgactgacgggccctcctccttgctgacgaggagagggtaacgggggtacgcgacataccggtggcggcgggtcggccgcccgcggccaattgccgctgggcagtggtgaccaagttggccacgtcgtctagccagcgctgaacaggggtctccggctccgagttcacggggggatgccgcagaagggcgcccgccgcctgaagcgtgcctcggggtgagccgccatcaccgtaagtgaggcggcgccgtgccccgacgcgtcgtggcctctcttcgcccaggggcggggagagggccgaaccacctgaacgggtgggatcctccctccgcgagggttcgtggcggggaggagttggagagtcgcggcggtggtgacgagggccacggctctcgctagaatccccactcccagatggagtgggggtgaacgccaccgcctcctcctcctccaggacctcgaccatgatcgtcgagggcccagggaaacttggggcggaagaaaacgacttctccttaaaacgcgcgacttcctcctacctggcgcattagctgtcgccagctgtcgagggaagtccctcgatagcgggaggtcgtgaggaccccctttcgtgagttcggccgggggaagaagctcgtctcttggaaatctcgtatccgcccctagggctactagctagcttgcacacaatcgaattatacaggttcgggccggtgagaagcgtaataccctactcctgtgtttaggattatggttgagtgttacaagggttccttaactccggagagctcttgctcttcttctcctagaattcaggtctactcagcgttttccttcttctcggtgagcaaggtcctccttatatctcaaggggataccacatgcaccgcctctacctactcttctttcgggtggggacccaccctatcttgaccagaactcgacccgtgccttcgcctggaagctaagccacagcttgtcctcgagtggggcccagtgccgtccctcgcctgacacgggggacagccctgtcattcccccattaatggatgaagacttgtggtggccgccgtccgaatgaccctccgatgggacgggtcatacctacctccactccgccgggagcagacgcgacgtgggagcacggttgtcggtctagtcagacgtgaccgatgtcatgaccggtcacagaccggtcattcttgattatggcgcgtcagatgcgcacaccgcatgtctgcctcactacattaaatgcgacagggggcagttggggcgttgcacgcattaaaggaagctcagcctgggccccctcctcgctcgctccccccgccaaatggcggctgggtgagggcctcggggcgaagcggtgcaagggcccgaggggcatgacgtggcaccccgaggccccgaccccccctggccgctccagcggttcgcgggctacaggggcaggaccaggctgtagggacacgcggcaggataggaaggtagattccccacacttcgcatacccccggtcccatatctccgacagtagcccccggcaccatatcggacattggcctcctgaggtcggtctgacgtggtgcctcacgacttcccaagctagggttgcgggcccggcagggaatctaagggaatgctgccgagtggccaagttggcgtatcaaccacagcagcggtttggccgccactgaccgtgctgatgatgaggatgtttaagacacgaaaatcggggggtcggttagaccacgcctcgactccttcgctcgctactcatgcggtggtactggcgacggttcgcctaggttgcgcccgtgaccgttgcgtgccctacgccgagtgtgccgctgacgggtgcactaaatgcggggcgcggattcagtgggcgatgtgatgagtggacgcgggaaatgatgagacaaccgcgggcgcgagaatcgtggaggcaaccgtgagggcgtgaaacgaggaggcgagcgcaggcgaggtgaggataaaaggatacggaggcagggactttgcattcttcctttcgccaagtgctcacccgcctactcacccgcctactcgctctctaagccctaacattctcgccaattcacactactccgcgcgccaagcccttcgccgtttctccgccggccatcatggctcaagacgctggcgacacagtgctcccggcatcacgcattatggcggataggcaccttagcctcccccgcaagaccatgccggaaggcaccgtcgtgagggcgggggagttgcggccacggccgcgatatccggagggatctgtgcacctcttgtcctttgctatggtggggttgattccgccattcttcggattcttccacgaggttttggatttctatgaaatccatgccttgcatctcgcacccaatgctgtgatgacgctgcccatcttcgcacatctgtgcgagatgttcatcggggtgcggccgatgatgcggctgttccagtctttcttcatcccgcagctgctgcaaggtgcggtggtggggggatgttacttccagccccggccagccacggcggggcaatacatcgagagtcatctccgcaagaaatgagtggactggaggaaggactggttctacatcgcgctgccggaccacccgcgacttcggcttcccgctggccctcccgaacgatccgccgcatggctggcggtttcagagttgggcgaagagtacgacgcggtgcaggatcgcctcaggggcctgtgaagcctaggcctcacagcggcaatggtctttggcgattatttccgccgccgcatcgcgcctcttcaggatcgatcccgtggcgcatgggagtacactggtcctaacgaccccatgcgcacgcatgtgggtgagcgctgggaatggggggaggaggacgcgaagacggtgattcggcgggtgttgggtctagactccgccgagcaaacactgattccagacgggatccttcccctctgctgtgaccgcgatcgggagagcatcctggctgtgatgtcggccggcaggagccggtcctaccggggcggcgccggtggcagcgctgccggcgtgagtggcggtgacgcgaccgtatgcgggagtcggacaagcggacccggcgggggtggcagctccggggcacccggcccgagccacggacccagggacgactcggccagcgacctgaaagggaagcggaagatgcccaaatctcgaccgccctctcccccgcgtggagggggcgccgagcgtgtggcggaccgaccgccagcaggccacaagcgccccgtcgagcctgaggccggacggaagaagaagcggctccggaagataggtcaaacggagccgtgttgggggagcttcattgagcccctgaagtggactttcaaccgccctccccgcaggtaccactgccggcacccactacggtgctttttactcatctcggtctcttgttccttcctcttctttttcttcattaacgccatcggggttctcttgtagcgagattctttcccaggggatctcggggtccgaccctttgcaggggatgaaatccgaacgaatggagtggcccgggcttggccgatccagggccgtggggccttcacagcctctcggcggggcccacgggccgcacaccgggtccgaccccgggctaacctcagccgggactcgacccactgcgagcgatagcggcggtgacgtccctcccgggggcggctctgagaccgggatccatgcggagcgccactcgggatcggggggcgagggaggtcgcggctcggaagccgaggccggaggcggccttgagcccgaggtcgaggctgaaattgggggcgggcacgagcccgaggccgaggctgaatctacccgaggacccgaagcgggggccgagagggacggccgctcccccttgcacttgggacgccctcggggctggtcgcgcagaaggggggctgagagcagcccccagtctcgcgggggatccagcagcactctgtcgtcctggggacggaccgcggctttttcttctccgactccggcaagtatggagccgctcctgcaggtgctcgctgccgccgattccaccgtccgggaggggctcaatgccaatgttcaagccctggcggaagagcgagcggccctggaggcagagtgggcacagctcgctgcggaccgcgcgcgggttgacgagggacgcggcgccgtggacgacatggtgaaggtgggacgcaaaatgcgccaagcccaactagccgaaatccaagcgggactggccagaccgaggctatgacgaccgggggtcggggacggccgtgtgtaggcccttccgagcccccagggttcggcgcaacccggggcgcggcccgtgtttgggctccctttcgacggttttcaggtcgccccacggcacttacggttcggagtaagcacgaactatcatttgaaccaggacaagccagaggaaagagtgagaaaaaggggcgcataacggccttcacactaagtggaaaaatttattgcttggaaagggaaaaggatacacagtggtagcctccggccaagctcgcacaagccgaggtgttgtgcgggggttggcccgagctcctggaaagcaaaaaatctcgacgctatggatagaagcgacgaaggtgtttgatattccaggggttaggcaactccgtgccatcctccgtggttagtcgaacggagcctggccggggaacgccgatcactttgtatggcccttcccacattggcgagagcttgctcagccctagatgtgattgcacgcggcataggacgaggtcgccaacttgcagtgaccgggcccggacgtggcgctgatggtagcgccgcaggctttgttggtagcgcgcggcacgcagggccgcacgctttctccgttcttcaagatagtcgaggtcgtcgcggtgaagatcatcctggttggcctcattgtacagcgtgacgcgaggcgatcccagggaaagctccgaaagtaggatagcctcggcgccatacaccaggaaaaagggcgtttaccccgttgcgcggcttggagtggtgcgatttgcccacaacacggcgggcaattcctcgagccacgaatccccgtgtttcttcaggacattgtacgtcttggtcttgaggcctttgaggatttcggcgttggctcgctcgacttggccgttgctcctggggtgggcgggcgaggcaaagcacaatttgatgcccatgtcgtcgcaatagttgtcaaatagctcactggtgaactgggtgccgttatctgtaatgatgcggttgggcactccgaatcgggatgtgatgcccctgatgaacttgagggcggaatgcttgtcgatcttgacgaccgggtaagcttcgggccacttggtgaacttgtcgatggcaacgtataggtgctgatacccgcctcgagccgtcttgaatggtccaaggatgtctagcccccaaaccgcaaaaggccaagagagtgggatgagctgcaaggcttgggccggctggtgggtttgcttggcgtggaactggcatgccttgcaccgctggacccattcttgggcatcttgcaatgcagtcgactagtaaaaaccttgtcggaaggctttaccgaccaaagttcgtgaggccgaatgggccccgcactcaccctgatgggtgtcggctatgagctcgatgccttgctctcgagaaacacacttcaagagtatcccgttggcggcacgccggtagagggtcccttctatgaggacgtaccgcttggagatgcgcgcgagcttctcagcttctgcgcgatcctcaggaagagtattgccgtcgagatacgcccggatgtcagtcatccaaacgacctgatgaggggggtcggggtcgaccccctcgggccccgagggccgcgagtcgccaagggtcggggcagagggcgtgtcgtcggggtccctcgaggggttcggtcgcgccgatggctgcgcgagtctttcctcgaaggtccccggggggagtggggctcgtgccgatgcaacacgcgacaactcatcagcgactgtgttgtcgcgtcggggcacgtgccggagctcgagtctgtcgatgtgatgttccatgcgccgcacttcgcgacatatgcgtccatttgtgggtcggtgcactggtactctttggatacttgattcacgaccagctgggagtcacctaggaccaggagacggtggatgcccattctggccaccgccctcaatcccgcgaggagtccttcgtattccgccatgttgttcgtggctcggaagtcgagccaaatgacatacttgaggacgtccccgcttggcgatgtcagcgtgactctggcgcctgcaccttgaaggttgagggagccgtcgaaatgcataacccagtgcccgccatgaatgtcggcgtttgggtcctttacatctctggggaggaaggagacgttgggtggaacaggttcgtccactggggtccactccgcgatgaagttagctaggacctggcttttgatcgcgtgtcgtggtttgaagtgcaggtcgaactcagccagctcgatggcccactttacaacccgaccagtgccctcttggttgtgcaggatttggccgagagggtaggatgtcactacggaaacccgatgcgcttggaaatagtggcgtaatttccttgaggccattaaaactgcataaagcattttctgggcctgtgggtatcgggtcttcgcatctcggagtgcctcgctgacaaagtagacgggccgctgcacctttcggcggggccggtccgtgttgttaggggcaaatgatctggggcgcccttgctcaggggcctcgggggggggtctcgagtcatgttggga

SEQ ID NO: 70078 - DNA, 7876 bp, Oryza sativa
tttggtacttgagctactgtagcatgatttagataagtcatgcaatggcaaaaaggtggacagcaaatgtcaagcgctatttttctccctaatcatgctgaagttcatgagtgtcttgttggctcactttgcatagcagcatctccataagatgttccaaagtatcttactgcgagattgcaccatgtggaaaggttgcaaaaacataacaagggcacctttcaggatcagaaatggacacagaaagatgcaactatactcaatgaggaaaaaaaaagattaactagtcatgaacatctaaactttgccacacaaagatagtttgatagcaacatgcacatttcattcatgcagagctgaacccgactaaatatttccaacattattaggttatcaaaatgctaaagtttcagagatacctagctgctatctggggtgcacttcttaggactggatataattccaacggtttcaagtacattgtccaagaagagcacatactaccgctagtagtatcatccgttgcctgaaatcatgtggcagggagcgcctccgtaatcttcatcgccttcggtttgttctctcccttgatgtcaagcaagaacttcaccacaagcctcatcgacgggcggttgtttgggaggttcttaacgcagagcagcgcaatcctcagaactctacacatctcatccttgaaatgttcagcaatcttctcatctagcactgactctgccccattctgctccacattggtggctgcccatgccaccaggtccttgtcaccaatatcggatgacatgggactctttccagtaacaagttccagcatgaccacaccaaagctatatacatcgctcttctcagttacacgtatagtgtaggcatactctgcgatacaaaacagacaaacacacataagaaactaggaagaaattacggtgacttatgacaatttttagccaattacaacaacccacaagtacaaaaagaaatcctaatcagaacatatggaccaaaaaagactgtctgaactgatcatcaaatcaatctcaaaagctacattcatatatactctaattaggaacacttctcagaaacaaattaggaacacttctcagaaacaaattaggcataaggaactcaccaggagcaatgtatccacaagaaccagcaatgacagacatggtggccggcccatcaccaatagacttcgcgacgccaaaatctgctatcttggcacgaaaatcagcatcaagcagaatgttgtttgacttcacatctcggtggatgatcgcgggaacaaagtcatggtgcaagtagctgagcccctcagcagcatcgagtgcgatgttgtacctcgcaggccaatccaagatgccagctttggcactgtggagaaagtctcccaggctgccattaggcatgaactcatagacaagcaaccggcatgcctcgttcgtaagacagcagaagagcttgacaatgttcttgtgcctaactttgctcaatgtttccacctcggcctcaaagctgtcgatcttcttgctcgccaccgtgctacttgcccaaagcttcttcacagccaaggtatcactcctaggcctgacaacagccttgtacaccatccctgatgaacccttgccaatcaaattgttctcagtcaggctattcacaatgtccctctcattgaactccaccttgtggaaggatgtgagtacccactctgaattctcgctgtcaacttcgatggcgcgcttattgtagctcctatacttgtaaatgaaccaggcaacactcgtgagtagaatgccagcagcagctgtgaggatggctacagccatctggattcgggcacgccggttggaatcaggatcaccattccttgaacatagcccatagcacaggccaggattacccaagaagcacggtcggaattgatcagtgtcgaataagattggaagatgcccagtgagcttgttataggacaggttaagaacacccagcagtttcagatcctgcaattgtgcaggcacctgaccagaaagctcattgttcgacaaatcaagcgtgctcatcttatccatacccccaagctcttcaggtatactaccactgaggtggttgtctgaaagattcaacaatgtcaaattcttcagttctccgatgctgcgcgggatctctccagaaagggaattgttgctcaaatcaagcaggaaaagcaccgaaagagatgcgagtgacggcggcactgtcccggtgaagctgttgtccgaagccgacagcaccaccagctgggttaaattccccaattcagcaggaagaacaccggtgaatcgattgttatcaatgatgaggttggacaggttcgcggcacggccaatggcggcgccgacattgccagagaacgcattgccacggagctcgagcaggtagacatggggcaatccccagaattccggcggcaccgggccggagagccgattgcagggcagcctcaccctcatcagcgacctgcatttccccagctcgtcgggaatggcgccgtcgaacatgttgttcagcagcaggagctggctcagcttcccgccggcgcagagcgtcgccggaatccggccggacatgcggttgtccgagacgtccagcgactggagcgggcagttcttcccgaactccggcgggaacggcccttcgatctggttggcgaagatcatcagctcggtcagcctcgccgccgccgcgagcgtcgccggcaaccgcccggtcaggttgttctgatacatgtgcacgctctccaggctcggcgcggcgaacatgtcctccggtatctcgccggagatgtggttcatcgagatgtccagttgctggagcttcttgaggccgcccaaccccgccggaatcctgccggagagctggttggagaagagctctatctggaccaaagaactcaagttcacgatgctcggtggtatctcaccggtgaggttgttgctcgagaggtccagatcgacgaggttggtcagcttcccgacggaaggagggatgctaccggtgagggagcagttggcgaggaaaagcacgcggagcgcggcgaggtcgccgaggttgtccggcaatggcgacggggagaacgagttgtaggcgagcagcagctcctggagcgcggttacgttggcgaggaaccccgggaacgcgccggagacgaggttctgtatcaggttgagcaccgccagcgacgggaacccgccgccgtaggccgccgggagctcgccggagaagttgttcgacgcgaggttgagcgtctcgagcgcctggagccccgcgaggcaggcgggaagcgggcccgtgaggtcgttcgacgacatgtcgaggtgccgcagcgaccgcagcgagcagagcgcgacggggaaccccccggcgaggtacagaccgccgaggtagagccccgcgacgacgccgtcggagacggcagcgttcccggccgcggcgtcgcacgccacgtgcggccagcggcagaggtcgtcgccgcgccatgccgagagcgcggcggtcgggtccgtgagcgcggccctggcggcgaggagcgcgcccgcgtcgccggacgcggcgccgccggtgcccgcgcggacgcccggcaggaggaggccggcgaacacgacggcgaggtggagcaaccgccggtggagcggcgccatggtggaggtggtggaggtagagtggggagcgtgggtgggaggaggagaggtttaaagggagggaaggaagttgcataggaggattggaagcatctcctcctggggtggttttgtcttttagatagacgaacacattgaaagcgatgagggttggggattttggctacagctaccaagggaagtgtccacacagggagtattatcactacgagatacgcttggatgtggtggtccgcatcgaggggaggctggatatagcgagaggttgtacggatcatgtagcaagtttggaagatatctatgtggtgaacgtggcaatatatagaatatgctgctttttccgtacatgtaaagtcaatgcgcttggctgacgtatgagaaacgtatccggacgttgagttacagttagatgttggtaatggtacgctggcgttggaagaaagcaattgttccgatttttctatgttgacaagatgattgtggctttggctttcccaaataaaatatattattttagttgcttcaaatagaattagaaaaaaaactgcaaaaatatcttacgttacaaaagcgtcgataagataacgtcggataaaaaattattcaattttgtccatcttttcttaaagaggagggctatatttatctcaataatttatgatgttcttgctataccgattgccattaaaatagtataacagctaaaaggtatccgtatttcaagtatgagattattcctcggcattgtaagagcacatttagttagcaaactttaatagaacctttggatgtggcatacgattgagtcatgattttattttcaagaaaaaaaaagcaagaatatatcatctgggaacctcaccggttccaaattaaataagtatgaaaaacaaaccgttcaagatttatctcctgtctctactctatcaatacattcatattcctctaaaaaaaatgcattcatattttttttcatcagttttggtagtggtggtggcccttgtgtgcaaaaagaaatgtgctttgctggggttcgtctcctctgctattagggagtactagtagcgttttacagtgaaaagtaccgtaattattttatgggattactgtagcaactactctcctgcattcattcaaatttgatccaacggctacaaatagctattgacatggatcagagtatggagttctctaccattccggttgggatggcagaggatactatcccactttgctgtggagtacacggtcccgtgtggacgcagcgatatttgcggttgcttaattaagtcagtgtttgggcctgggaaatgcgggaagcgtggtttggttgggcctcgttttccagcgttaaacagtaacagcaacgcctcgtcttcttcttcctctcgcctgcagtcgcacgcgcccagaggcgccatgcacgccggccgcaagcaagggaccacgtacgtactgatcactctttctctgcatgcagctatagccagcttcaagccttgatcggtctgctacgatctggacgacgcgctcgctcagctggatggatggatgcatcagcgtttcgcgcgcgtggccttcctgctccaggtgattcttttgttgcttgcgctgtgccgtttcttaatttgtcttgcacgcgcggctcgatcccctccctttctatctctgccttggccatctctgccactgaattgagaagtgatgcagggatggatgggttggaactgggaggaagacgacgacgacgacggctcaagctgttggttgtagatggggggcgttttggaggattgagatcttctgtagccgtcgacttcaccatgccattatcactgatatgtgagcccgataatatatcgggcctacatgtcagtggcaaaggtacggtgctagataatcctgatccgtttttggatggttgtgcagcagcgagggtgcgggaggaggcgcccgccccggccgccgccgcgcgcgcggcgtgagcgtggctttccgcgcggcaactgtggctacgggagtggctgatcctggccggtgggctggaaaagctagctagctcgttgtttgtgtgttgtgtacttgtgtgcgggaaggttgtgacagatggaccgcatgccacacgcgcacggcgcgctagcgctactctcctcctccctgcatgctccttatatggtggtttccggagctgtttggcttcgttgttcgtatgctcttagagctagagctggtacaataacatactattagccaaatgtaacatattttaatgagataaaagataagaaagaagaatagcggactacagatctgtagccagctgcagcgtgaactccaagacgcaatgtgtgtatgacatgtatggccatatatctatctattatattattaaaggaatagaaaaaggagcctccacgttcgctctcatagcctagaaattctcacattaatcggagaaaaagaaaagcagagtccatatagaaatacaatttagaaatagctgaaattcgaaattaaaaaataaggaatattagaagaagagactagagtccatatagaaatacaatttagaaataactgaaattcggaattaaaaaataaggaatattagaaggggagactagagtccatatagaaatacaattaggaaataactgaaattcgcaattaaaaaataaggaatattagaagaggagactagagtccatatagaaatacaattaggaaataactgaaattcggaattaaaaataaggaatattagaagtagagtatagagtccatatagaaatacaattaggaaaagtcgatagaaatttgtaattaaaaaataaggaatattagaagtagagtatagagtccatataggaatttaaaactaactaaaatttggaataaacataataaaattaaaagtagagtctagagtctagagtctagggtctagagtctagattcagagttaaaaataaagaaatattgaaagacgagtttagagtccatataggaatataatttacaaatactaaaatttgatattaaaaataattaataactaacacgtatatataataaaatataaatattacacattagtagtttcgtaaagttagtataaaatttaaaattagaatatcatttttaatatatttgaataatacattgagaaaacatatatgctattacatgagaaaaaaaatataatgatgctagccgcgcaatctgcgtgggccaccgtgctagttaatagtatagtaagcaactattatataaattggctattaaattgactatagatgaattggagctattagtgggctatactattaaacttgctcttacatgacacggaaaaagatttttttgaaaaaaaaaagcaattagcgtacgattaatataatatggagtaatttagtacaaataagttaaaaagaatcgtttttacatatcataataaaacgaacgaatggagttagctgcaccagtgatatatgccaagctatttagctgtcccctagcttggtgtggctaggctagtaatccgtccgtcttattttaagtgtaaagatttttctatatcaaatatttgaccgttcgtcttatttaattttttttaaaaaaatttcacacataaaaatattataaaatttcaaataagaccgactgtcaaacgttgggaacagaaactcacaaatgcacctaaaatgggacgtatggatacgtgcagtaaccttttctggttttgaaacgatagtatatttcatgattaccatacggttttcacgataaccgcacggttaccacagtaaccacgaaatcaggagtgacgatgacgataatcaccctaaacggtttggtaaagtattgagagttgtgcagtataggagactagttactagtatagttgtacagtcatacaaagctatgcactctagcttgttataaatgatttgctggtcatttctgaaccttttgcagagtttggcaacgaatagatttcttaggcattgtttagttcccacgcaaaaaactttcacgatatcacattaaatatttagacacatgtatggagtattaaatatagaaaaaaaactaattacacagattgcgtgtaaaattgtgagacgaatattttaagcctaattgctacatgatttgacaatgtggtgctacagtaaacattt

SEQ ID NO: 70079 - DNA, 2935 bp, Oryza sativa
ctaacagtgtaccggtaatttcaactaatcagagagctcaaagtagtagagcttacctaacttctaaatttaattccagaagttagggtttgaagtggagttatgaagctggccaaacccagctccacctctctagttcattttgtgagagagctccaccagctctactcccattttaggtgggctctagctccaagagagatggaggtagagctggagctgtgccaaacaagcccttcacatgtatatttatcgtactattggactgtccttttccaaaaacctttcatttcaattaattaaagataaaaaccaagatcggtccatgtcaaggagtgaacattattccttctaggaaagcatcacaaaaatcaaacaaaacaccaaaagtatattaaatggctagtggtgattcgtttttcttattctgtttttaaagataagaaagagttgtagagatttagctgtcacgtgcatgaacgattcagccgccaacatgatcttttgtctaggcctagtcatagcgtcttcgtcattgtgaaaataatccccctctcgcttggcgtttaagcaaggccatgaaaatcactgaagcctcatcgcttgctttacagattggcggaaccagcgacactagcgataagcgatactgtcgagtccaggcaacttatagattttttcgatggccagccatttctactaacaatattataggcaatcaactatgggtatctcagttggccagccattttactagatattgtaggacatcaaccagggatacctttaaatttcggttgcagttaataagccaaaaaacagacgataggaggcataacaaatatatggatattttaataatcttttaagaaacctatatatttagtgaagcaaaaacctatatatatttatatgtagttcatatatccggcaactgtaggtaatgttataattttttatccgtcatcaagagtcacatgactcacatcggggattttaattatttgtcacttttaggatgaagtttaacaatttgttatttatagtctatgacatgcgagccatcacgtgtctacgatgagtccagcaacgaatcattaaatgtcacatctaaaagtggtaaatagttaaatatctcgctcatatcaacttaattatttctatcccttggttgtgtaatctataattcaaattgtttcctttcatttctttctcccctgaagtcatgtcgttcaattctttttatttgaataaccgatctatattctatatttaatctaaattgtttatacaatttctaatgattgatcaaagcgttaattatatgaagtagataaaattttatgtcgcttagttagaaaacagattcatcttatactttatttctaccattattatacaatattttttagcaacttgtgggccgggttcctttcttcaattttcagtttaattaaaaattgataaaacttcaagagaaataaaactagcttaaaagcatgagcgcaataaatataaatccttcattataatctcaatgcaagaatatttatacaactataaatataaatatatgtaattaattactaagatgcaaggcatgagagtaagcaggatttatagagattcggcaaaataaatttaattaagcatgagttctaaagctcttctcggattggctacttttctcgtttactgtaagcatgttttcctaattgctaaacgttatattttaaaataattttatatagattttatcgacgtttgatgtcgcgattccggtatttgcatggtatggggatcgtcggtactaggatatacgcgagactgaggtaaaagagacggggacgaggatttttatacaggttcgggcccctgaattgtcaggtaataaccctacatcctgttggccgaagccagtattgctcttattcactataatcacaccagtacaatatttggggtagcctatctaactgttgtcgacatggcggtctgaaggtctgactcgtagtcgacaatagggtagtcttcctcctcgagttcgtgcccggcgagatcagagatagcgttttcgtctctcctaacagtatccggagacaccgtagaggactagccgtgcttatccctgaagttgatatccggcatcttgtcttggtgtatgttggcttgtatgttgtggcttctgttgttccatgtatgttgattgtccctcctctcctcctagagggccttgtatttatacccataggtgtctccttgtccaagtagaactagggaaaccaatatggatataatccgagtagtacttatcgtttctatgtagaactctggttgtctttccttatccggaactccctcgaggttagtttccatataagacatggtatgtggtgggtcctgccgagatttagtcaactattattaggtatgtggtatccataaccctgacagtagcccccgacttcaatgcaaatgaacggattcatattctcaactgcagaccatggagtaactgttatcgagctcacgtgaatgttctcggtgagttcagagataacgttagacttcctttatcagcctcatgcgggcacctaaagggtttgtctgagtcaatctccgacgtcgaccaagaaagtacagagcatacgactaattctcccgtcttgctgtaatcgagaatttggattgaagtcaagaaatttatctcggcgggtacaccatctcttcatttcgtattccttgtcgagatccaccaaccgttcttgagtaatcgagtaggcatagagtctgcgacggagccttgtcaacacttgtcgtactcgctttagtcgatcttggtatagaaccatagagacatggagtcttcgataatgtcgaatagaattttcctgaaatccatactcaaaaaagaatattagataaaaatagcccc

SEQ ID NO: 70080 - DNA, 5438 bp, Oryza sativa
cggcggagctcggggcgaggatacgatggcaccggcgctgggaggcgggaggcggcgacggcgacaatggtttgaggggcgcggcggcggagctcggggcggggatggcgatggcggcggcggctcgcgacgacgaccccgacgacgacgacggcgccccgacgacctcgcgaggagtacagttgctgcgggccggtttggcgaggcgttttggctggccaaatctagccagccagccagcgattttggccaggcttggccatccggttgaccagtctgttggacctcgtttttgtggttgaatggctaaaatttggcttggagaggctagtagagaggccgttgaagatgctctaagaaagtagcgaatagcaaagtaaggagtgagctggtcacaagcgtccgacgtttttttatctaattggacgttccaactggagcattttcggagttttgccctctcgttggtggggtgcagcaatcgtgtgataaagatatgaaaagaagaggcgaatgtcatggcaagcacacaagaaaggatcccaacgggccgcgccgcgctcctctcgctccctcgcctccgcggagctcgattcctaaaccctacctcgccgcgccccgccgccgccgcgggccggggagatcgccctcgccatgccgccgcgcaaggaccccaacgggggcgccttcccctcggagcccgccccgccgcagccggccaaggccaaggggaagaagaaggatgagaacaaggacgacgacctggtgagctagccaccccccgattcgccgtctccttcccccccaactctctctctctctcacggatttctttgcgtggttgcagtcggaggaggaccaggcgctcaaggagcagctcgagctctacgtggtgcgggcgcaggaccccgatcccggcgtccagaagctcgccctcgagagcatgaggtaacgaggaggattttctgatggtgtgtaactgtataattctgatagttcgtgatgacttatgttttagtgtgatctggtttgggtggatgcatttatcacactacttatggtttggatgagagaggagctagccaattgaggatgatcatgtcatctagtagactataagactaattaactcataggtattttggttgcactgcttacttgtcctgtgcaagagttcgttgttctgcaaacttactgtcgtgagaatttaaaatgcgcataaattcggcccaagctattggtttggcggcacattgttggaggcttgtttatccttttgcccttaaatcttgggtacaatactacgtaatcacaattaccatgaggtcatgctttaactgttcaatttctccaatctctactgcatcatggtgagattgttttatctgctcagctggaatctcgcatcctagtggctactgctgctattggtggcatcactttgcattattcaaccagttagtgcatacacagttttcacatttgtcttattgatctcttgttaatggtgatttatgcttaacaggcaggagatccgttctgcgacaagttcaatgacctctgtcccaaagcctctcaaattccttcgcccgcactatggaattctcaaggcttactttgagacaatgccagaatctgagctgaaggtatcaaccaatcttcgatctctaggttgagtcatggttcaaatactacttgatgcttatatggtattcttcaattattttgcagaagtatatggctgatatcttgtcagtattggccctgacaatgtccgctgaaggagaaagagtatgtgaaaatgccattctgatgtcttttccttgtgtcaatttcctagtgtttttttttaatttgcttgtatgctaacttctgagaatgatttacttctgtaaatagtcatacattttttgtgtgtgttttaaatgatagacatatagagtttaactttttctcactgttaactgtacaatatcaatccttcaagaattggctaatatgctttctttttttgtttcaggagagcctcaagtaccgaatgataggctctgaaggtgacattggttcatggggtcatgaatatgtgaggtaacatcaattgccaggcctcctaaattttttagcactcacttttattcacgagacagttacttcttgtgaatcttaatggtaaacatttattcctgagatagtttatgatgaactaccaaacagtaccttcatatcctgtttgacaacttgatgtttttccctgttatgtttgaagttgaatccttaggcttatttagaatttatggtacggtcaaatatttaactgttatcagtgtattaaataatattgaatcgtaactcaggaaattatagataagaagttattcttttcaggttttcaagtgcatgcttatttgattagttgatttaatcattaatcaaaagaaatgattggttagtaatgctgcggatttaggttgtatctggaaataactttggagttttcagtttttctgtttcctttgtttgttattgagaataaggttgttgctgttggaaacttggaatacatatgtttgtctttcgaatctagattggattttctaacaatgtcaatgtctcacttgctagaaacttggctggtgaaattgcacaggaattccagaagcgccaggttggacccttatccatatcatcatatgaattgcataatatttcttcaccccaaagaaagaaatattttaacttttgttttaatccctaacaaaactttaattccattagcaataggtcttaaagccacaagataagatcacccttgtttatattatctaaatgactatattctttagtttaacatccattgtctagtctagctgctgttgattttaataacaagtgtttttaagtgatcttccctcagacctttttgatttttgtaccccacatctatattgtactgattgatgtatacaccattgttatttggcaagaattgagatagcttgattgctttctttttttttggttcagttagaagccccacacatgttttcttctgtcaattatgttatcacatgtgtatggactaagacagtgaaaagtttaggtgtgtggacctcatttttatcatcctaactttgtttttgcactttgcaggatgatggcatgacaactgattccctgaaggaactggtggagcaaattgtttcattccacatgaaggtcaattttgagtagagtccatgggtgtcattttttaaaaaaatttcattgcaaatgtcttgttacacttggtgtaatgcattaaatattagcaaataaactactagtgctcgatcaatggatggactgatactgattatcatttatattgcagcataatgctgaacctgaagctgtggatctcctaatggaggtatgtgaaacttctatttttaaacgtataaaaaaatgttcctttgtttgcattaagagttctcattatttgttcattggttcacaactgatgtgtgatatcaaattacttcataggtcgaaaagcttgatttgctagttaagcacgttgactccacaaactacaaaaggacctgcttgtacctcactagttcttctaagtatgccactgaaattgatctcacttgattaaagcttagtattctctagttttactgaattgaactttcttcactcttttgtgttgggatgcaaacttgcagatatcttcctgctcctgatgacatgtcggcacttaaaatagcttttgagatttacatgaaatttggagattttgcaaatgctttgcgtattgcacttctgcttgatgacaaggtgggtgaatgaatgttatcattcctgtttgctgtccagtacataatgacactgacaaagatttcattgatttgttagtctctggagttgaagcagatttttacagcaactgatgattttcacctgaagaagcaattccgcgtgtatcatagcacgccatgtgagcctcatcccatgcacataaacatgcaacagaagcaaattttctattgtgttcttgtctacaattcagtattattggtagtctgcattgttcacatttcctctttgcttatgtgttcaatggtttctttttttcctctgctgaagggtttaagcaccgacattgatgatgacatagctgcagatgaaaatgagaaggaggcttttcagcacataatttctaatattaaattgagtgaggggtaccttacacttgcacgaaatattgaggtcatggagccaaaatctccagaagacatatataaggttaacttgtttccccgaaatgctgtctgctgattgcatgtatctacttatttatttgtttatgaacttgctattaatgattaaaaaatgcatgctaatttgttaggttcatttgattgatggccgaggggctacaagctccagtcttgattctgcaagacagaatctggcggcaacatttgtcaatgcattcgtgaatgctggatttggccaggttagttatgcgaatttcatcaaaggtttccagggcaagcaaagttctcaatgttcttgttgcgggataaactcatgaccgcaccatcagattcttcgggcagtggttcttctggaaactggttattcaagaacaaggaacatgggaaagctagtgcagccgctagtctggtaatgcaatgcaacagcttggtttatttccttatacatggcatttaggttattaggtgatcatagtgatgataaaacaatctttttcagggaatgattcttctgtgggattctgattcaggacttgcccaacttgataagtacctgcacagtaatgatattcatgttgttgctggggctttgctaggtattggaattgtttcttgtggtgtgaagagtgactgcgatccggtatgtccatattctaaaacttctaatgcgcaagtctctgtacatcttctaaaacttctaatgcgcaagactctgtactgatgttgtgacatcttttccaggcatttgctcttatttctgagtatttcagcagggatgagtcaattatacgaattggagcaatccttggtcttggtattgcttatgctggctcccagaaagaggaggtcaaaatccttgctcttggccttgctatcccactggttaaaaactattaaccatgtgttattttgtgttaacatggtttccaaacatttcaggttagagagaatcttacagcttttctgagtgactcccaagtacctctggaggtcttagtcttcgctgccatctccttaggtttggtgttcgttggttcttgtaatgaagagattgcacagacaatcatatgtgtcttaatggagcatagtgagccagagcttgcagagccaattatacgcttgcttcctgttgcccttggccttctatatcttggaaagcaggtaatttgactg

SEQ ID NO: 70081 - DNA, 4107 bp, Oryza sativa
ttctaacagcaatatgcatagcttgacaataaaatgtcattagtatagagtaccggtgaatgaaattcccacctttaattttcatgcagctgtccacctcacttggattgttcgaaatttccattagagtcgggcttaatttcattaacccacttaaatgacccactattttgactcatttagaaacttctactaaattctttattttgttcatcaatctcaattattcttatatggttcgaaaaccatttagatgaacactttaatgtcttattttgttcatccatctcaatttacttttacatggttcgaaaaccatttggatgaacgcttattttttaatgtcttataaggtgaacaagctttatttagtgtttaccaccataatccgatctcataacttcatttgattagtatcttaaatttcttaaaggaaatcggaggtcgcttatgggtaaacatagccataaaaaatcatttgttggctaatatcttaacttcgtgaaatttccacttaaaactaaacaacgccattaaaatctaagggaaagaatatctctaactcacgagacgttccaaactcccctaggtatgtgacataagcgacaatgacactatttcaatgacgccttacttccatcattatagaataattattctcctcattcttatttaagcttagttcactaatgacgcagccgaatttaaaacatcatcaatgtttgatcatgtccacaaatggatttcttaagtctgcaccctatatgtgacttgtctttccataacaaaaccctcaagtcatgttatgtatatttaattgtgcaagtcacaaattaagagatacaaaattctagcgtccacataatggagctatgagtcataaatgaggtagaataatcttctcttattagagctcttgatgagctcccactgattgtattatttatttaatggaagcataatatcttatttttcataaacttgaatcacttaattttacttagtgaattatcatttaagtaataatagatgtcagaaatttctaagggtgaagtgtctcgaccttaatgagacatatattctcccctagaaatgtggccggaaaataaggccataatttcgacaatgtctcataatgattcaacccaaaaaataatgcccttaatcttcttatttaactactttattgaatcaggacattaagcatgtccctatttcttgcaaagaacttacacaagaaaatttcaagggtagcatacataggacatagaggcaattttatttccccttgcgaggaatatgagctttattatcattaaatttggaattgctacaaccccatagtaaagcttcatctttgccatcaaatgacaagattaataggatcttacttagtttgcctcttagtcttctatatttcttattgatttgcggaatgatgaaccaagtcaattatggtccactttgtcttagtattacaactctgaaaatgaccgtagtctaatgggagaagaatcatatgaaatggagaagtggcgcatatgaaatgtgcgatgtccatctcactaagtttgcacgccatgtgatttatttcttgtgctaccttttaaattatggcggcaaatgtgcatatgcactaaaattgtactaagcattagttttgacaaacttctaaagttcatctcaacgtttgctagatacagtttcgcaatgtcatgctcaaaattctcccctaacactaatagggatgataatctcaatatttatgagtgacatgcgaaacatagcattatattggccttctcccaggctaaagatgcctcttgagtttaggaaaaaattagtgacattagctgcgggagccacaaggaatcctttgttaatgctaagtcatactcaaataggccttaggctcagttaagtcaatgaggaataataataataattccatagactttaactgataaataaaattaagtggcactattattgtggttgcttgtgcaaattacgtacaatagtacattaacttacgcaataataacttaatctttatttcgctttgcatcaccgttgggcagagacaaaacgaaggaatcaataaatgaaattacttataatccaaaatcaagtcaccgttgggcagaaatgattagggaataaacattaatgtcttaagtcacatcaccaaaaggtagaagtgataaagtaaaaaaacccaaatcaaatcaccatacggtagaaatgattaggaaatgacgccattagtgatgccatagaattaaaattaaaatccttagccatatcaccgttggctagaaatggtaaaggaattaagcttactgacagagtagatcctcgatcacatcaccgtaaagtagaagtgataaaaggaattaatgcactaatggcatcaataaaattctaagtcatatcaccattaaggccaaaatgacagagaaaataattagatttcttcccttaattacatcaccgttgggcagaaaataattaaggaaataacaatcttaatgaaatcatctttctttctagataaacttcccgctggttccatttatctagaaataacttactcagtattgcaacagatcttaaatgataagaattgctgatggcatataattagtttaccatggctttaatcaatcatatgcaaaataaacttagaatttcatagtcaaagcaccattggtcataaataattatgaataatcttaaaattaattccttaattatatcaccatttggtagaaaataactaaggaataaaaaattataattgacatgcaattataataacgtgggttaaatatagcttcatatcttaatgcttctagtcgaatttctcgttggttccattcgactataaataattaagtttctaaggaaatgaccatcataatgatgttgacatgaaatcataaatactttctagttaaattttcattcaactagaaataaattaaatggcttaaagaaataataatcttaataaatattgacatgaaattatattaacgttagtcaaatataatatcatatcattaatttctttctagttaaacttcccgtcggttcccgtcggttccatttaactagaaatagttttccgagtgatcaaataattgaccataattttccagcaattttaaatggctaaaataatgccagatgaaattgtgtaattttgaaattaattagggcgtttagtgaattaaattgatttcggcccaattcttccgtagtcggcccaaacttgggccggcccgttttcgcgtgtgtgcgcacgcgctagctgagtgcgccccagccagcggcccaggtggcttccgcggccgaaggcgcgtggcccgtcagtggcgctggcccaacgcggagaggatccgagccgtccgattgatggacggctcagattgttcttgcgccggtaaagtcgccgacggggaggggtaaaccctaatccccattttcatttctcctcttctctctgatctctcccccgatctaatctcccggcgagcgagcgagtggaatcggcggcgatcttggcggtgacggcgttccggcgaggtggagcacgcgtgcgacgacgagcaccgagcggcttccatttgcgccggctggggggagcacgcacgagggcggcggcaagccgtgccgggtgtcggcggtccggcgaggcgggcgcacaagcggcggcgagcaccgatgcggcccggacctcgtcggcgggggggcggagcccgaaggcagccgccaagccgacgcttcccgtccccggcgagggaaagtgaggaggtgaagtggcggcgatgccgcttcccggagaaattccggtgggtttagaggcttcgaaatccggtaaattcccgatcccaaaaccctaatattgagtttaatctggatttaattcgggttttggtcttagggttcttagaaccgaaattagggtttctcgaattttggggattttaggccgatttgctccggcttattggggaaatttcaatcttgtttattcccttttgcctaacagtggggaatttaatctagtttatccccctgttttctccaatttacttctta

SEQ ID NO: 70082 - DNA, 5065 bp, Oryza sativa
acaccaatggaagtttgcgatgcgggagattgctacgtactggttcgagaaccagcgagcgagtagaatcatctctcgaacaacaatggagattgtggtacgggagattgctatgtactggttcgagaaccagcgagcgagtagaatcatctctcgaacaccaatggaggttgcggtgcgggagattgctacgtactggttcgagagccagcgagcgagtagaatcatctctcgaacaccaatggaggttgcggtgcgggagattgctacgtactggttcgagagccagcgagcgagtagaatcatctctcgagaaccaatggaagtgctagagttggtttattacatgtgcatctcatgtggccagcatgactcacacacccaacttgtagcatatccggatgtccgttcgcaatcatgtcgggtgatcaagccgataacgttcacgaggaattatccgttaacaaccttttcttgagtagtccagccatggccggtgctatgagataggttgtcggtcttcgttggtaggttgggcgcggactctgcatttgtcgagattgttctcgataatgcggtgtacttgaccacaacctactcgagtgctcaattgttcctgaataatattttctagaagacaagatatatagcagataatatcgagtatgtactaaaaaactacatgaatcttctagtattatcaggatataacgagcagattaaatatcagggcattatgtaaactgtaaacaagcatgatttatacagaagaagacagagcgagcctccagcgttagatcgcagtcgatttaacatcggggacacccgcgcaatagttattgtataaaaaacatactctaggcaaacataataaaatttggatctgacaatattatatagatcagaaaagtaggtacggtaaactgaatataaaatattgcatacctttatagatatatgccggatatatctacgaaattagtagatcaattaaattaattaatctactaattaccttgtaccaacaggaatatgcttgattgaaattggattaggcattaatctcgattagtatgcttcggataattatccatctcgatctcctggtttgctgcataatattcctcttcctttgtactgtacgcatgcatatgtgcaggcgttgactgagttgggcttcgtgtgtacatgcaatccggtaggcgtcggtgattaaactcgttaaccgtgtattggtcggcacacgtggtctagcaagtctcctgatcatggcaaacgatagttgtccgactcccacaatgcatgcgagctcacgtagacgtctaggattccaggagatgagtcgtccaattccatgggtgacggcggcgatgattctgatctggtcggaaaagacactccggttgagttagatctttccatagccgaagtcgtcgagtagttgctagagaatccatctcttgaacccatctcgtcgaaatcctgaagcaccaaaatccccctacctggtgcgccactgtcgacggtgggtacccgtagaccggatatagagggtattggggtacgctggtacgaggatctacgtggtacgacatcaagaaaacaagagacaaagattatactggttcagaccccttagtaggtaatagccctaatccagtggttttgggattatatggaaagaaccacaaattacaaagggaacagtagaactcggcgataccgacgagaccgtagtcgagttgattcgactagatcacccgacgacttgtctcctatagtctccgacttcgtaggctgtggttgtggtctaggctctgagatccgatcccttaggtcccctggggggtcccttttatatcgcagatcaggcggtctccaagtaggactcggagacatcggaccttgcacgatatagtaacgacccagtcctatacgggtaggaacctttccactggcagacttcgtgatggattcccttagcgtgttcagagggcgtccgtatatgcatcgatataccgcattgccgtgtagcatacatccaagggtagagggtataccttatccgtaaccctgacagatttttttaaaaaagacagataaatcaattttataagtttgtactcaattaatcatatactaatgtctcgtctcattttgtgtcactaaaaggctaagaaaaaagacgtgtctggtgtattactatactaaaacattggtagtaacaaaatcttgataaattttggtactgccaatgttttgttagggtagcattgaaaataaatgtgtttggattgatgccaattaggagccaaaatttatattatggtgaagaaagttctaaaatagtgccaaattgagcatgaacattatcaaacaagcttcaaaccaaaccaccacatttactattcaaactgaaaaatttgtagggcatatttgacattgatccaaacgtttgtgcatagctcttctttctttatattggtcgatcagtactgcttccaaattggagtaatcaaagacttatcttgagtagagagaattgagacaaatatttgacgcagaataagggaaaccgagccattttccatgcattgtgggtatatatatatatggatctccaccacatatttaccccttccgttgacataatagaccaaatggctagtttgtaacaagaccatggctccactttcttttatattataattgattgatacaattttgaatttagtttggttatcctttttgaataattttaggcagctcattttacatgtcttacagtactactccctccgtcccaatataagtgcagttttgcactattcacctccaacgtttgaccattcgttttatttaaattttttttatgattaatatttttattgttattagatgatagaacatgaatagtactttatgtgtgactaactttttttaaatttttcataaaattttcaaataagacggacggtcaaacgttggacacggatttttattgctgcacttattttgggacggatgtagtatcaatcataagggagttgggcactaaaagcaatgaagaaagggctaaaaactaatccataatattcaatcaacttaattatttatagatattattaaaagtttaactatatgatagcatttttactgagaaatctattaatttatcttcacatatcaaatctttttttttcatatgttattgatttaatatttttagatttattcccttaaaaaaagggatgttgaggttgaagtacgacatctatttgtgaacatagcaattaagtaattatcattgtagatgtaccagtggtttagtcttgctgccacttttgtagtagtttgtagcgtagtaatctatgatttgaaaataccatgtgttaattttttgacttggctacccgcatgcggacaaggagacttgctaatccatgttttgaagatgaagaaacaggaatgcgtcattgacagttgacaataaattattaactagtttgtccaaaccatttggaaactacataatcaataaataggagtaccactagctagtttgattttgtttgtctgattagtgacgatttggcatctgcccaggtgtctatcttttacagaaaagaagaagaagaagaaaaaccactcttccaacctctccccggccatgatctgtcgtaacaattgtcactttactttttaaagaaacatacgtctgaaaactgccacgtttaccataatttattcagctgaggccacgtcttcaccgacattgctgtaaggggtgaaaaaactaacatgtttggttggctatcaaatttaatttagttttgctaatcaaaagtgtgtcaagccatagattttgtggcttaatttcaaagtaagaagctgccaaaaattaaatgggctacctgcctcgagcggtagatatgtcatatgttaagttgcttgtggtcaaatagttgccaattggtgatgaagaagtttctgttgtggtttagttaccatctccaaaatgatcactgtaggtaatggcagaagcgtaaacaaggagcttttagaaaaagaaatattaagcgaagcaaaatgatgagatagaagaattctgatttcatctttggattgcattcaggacaaatgtgtcgttatggattgtcatttatcctatctttcatggaacgtatcatataaatgcgttgcttgtcaaatctattatctaccgtatgtgtatgtctaatcactgttgtatggatcataatcctctcctatatatctagcgttgattgggacgggcccgacccccgagcgaggagggggcagccgccactctaccccgggtgccaccccctcgaggaagtgccacgtgggtctgggggcagcctcctccctccaaactcggtgccctaagctgggaagggggggccgccgctccacccaggcgccgctctcctcaggggcgccacgtgggtttgcgggcagcctcctccctctaaacatgatacccctggacccatatcaccgacagtagccccccggagttagccttgaccaaaaccttccccagatggccagggttgacgccactctcctagtctaatgatatgtaggcccggttttctgtcctgtctttctgggagttgggcggttggagtttagccacgttcatacgttgccttaacttcccagttccttcccggtttccgaggcgctgtgggcacgggagcggaaccgatacacatgggttttttgctcaaaagaccccatcctctccatgattcgctcctaccgagccctagctcctctgcttttcctttttcgtcgccaccaatcttctcctttctttgctagcactagggcccatgcgcctttttcgcctcagcttgagggcgactctccagccgtaccttaggttgtgaacttattttctatatatatttagcaaacgttgttagattctctcaggcccacgacctcatgctgcacgcctcgcttgcccctgccttttgttaacctctgttcatgttctacttcatctactcaaacgattattttcacgtgtgag

SEQ ID NO: 70083 - DNA, 1826 bp, Oryza sativa
ttttaagtgcaaaataccccgttttaaaagttcaaagtatgttttaagacaagataaatagtccaatgatgtaaagtagttttatcccatcattttctaagatcactctagtatgattcactctccttttagatggagttgaaacattttgattggactttaactgtaagaggggtgaagctaaagatatagcctaattatttagatacgagtatgtctacatacataactaaaacataactaaaagttagatacgagtatgtctatatacataataaaagttagtatatatatctgaaaacgtataaggtgtaaaataaaacatattttatgttcacgttcataattaaaagttactatattatgaaaatgatatatggtgtgaaactgtgaaatgagacatattttcgtgtttagttttagtctggcggcaaaccgccgtgccggctcagtcgctgtaaacgcctataaaacctccaccatatcacacagcagctcacttgtctcgcttcctcctccgactcgcctcttcccaccaactccttccccgatggagtccctcctcgccgcctcttcctctctccccgcggccgccttctcgccgccgtcgtccctctcttcgacctcctcgtcgccgcacgccctacggtcggccgtcgccggagccgcccgcgcggtgcgctgctccgccgccaaggtgctcctcctctcgagccacccgtttcttgattctgcagctctggaaaatcgcgcgttcaccgccgtgccctgtttttcctattcgatcgatcgtttctgcgggttttgatggcatctggttttggtgcaggattcgatcctgtacgcgctggagcacgacgagatgtttaactcggcggaggtgatccagtgggagagcggcaagtccatcaactccatcgccgccgcgcagggcatccgcatccgccgccgctgccgcccacgctacccctccgagggctccggcgccgacaaagccgtcccccgcaacatgctcgagcagatcatctgggacaaagaggtcgaggtgtcccaggtaaactcgtctgcgccgcgcgtaaactgtttgaataaattcgcacacaagaataaccatttgttactgattggcatgcattttcggttactctgttcttgtgcagaggaaggcgaagaagccgctgcagaaggtgatcgagtcgagccagcacgcgccaccggccagggacttcgtcggcgcgctaacggcggcctacagccgcaacgtcgcgccggcgctgatcgccgaggtgaagaaggcgtcgccgagcagaggcgtgctccgggaggacttcaatccggtgagtttcagagagttttgcttgcatctctctttacgaaaattcatgtctgaaggttgattgcctggtttataatttaattgtctgaatactgtttcatgtgttgctaatcttttgaactgataacaggttgagatcgcgcaatcctatgagaagaacggcgcggcttgcctcagtatcctgaccgacgaaaaacactttcaggttggctgttcttctgttcttttttctaagaaagaaggtctcgccttctggtagctttcgacttcgtagttctcaaattcttatccttacaattattaatgtttttttttcgcatatatctgacttttcaaactctttgattcttcagggtagctttgagaatctcgagaccgttcgcaattccggagtaaaggtacgcgctagtattcaaaatgggcttcttcttttttaactttttcggaagaatattcttcagctgcagttgacagttgaaacatgtgcatt

SEQ ID NO: 70084 - DNA, 7825 bp, Oryza sativa
aaataactgaaatttggaatcaaaaaataaggaatattataaggggagactagagtccatatagaaatacaattaggaaataactgaaattcgcaattaaaaaataaggaatattagaagaggagactagagtccatatagaaatacaattaggaaataactgaaattcggattaaaaataaggaatattagaagtagagtatagagtccatatagaaatacaattaggaaataactgaaattcagaattaaaaataaggaatattagaagtagagtatagagtccatgtagaaatataattagtaaataatataaattcggaattaaaaataaagaatattagaagtagggtatagagtccatatagaaatacaattaagaaaaaaaaatagaaatttggaattaaaaaataaggaatattagaagtagagtatagagtccatataggaatttaaaactaactaaaatttggaataaacataataaaattaaaagtagagtctagagtctagagtctagggtctagagtctagattcagagttaaaaataaagaaatattgaaagacgagtttagagtccatataggaatataatttacaaatactaaaatttgatattaaaaataattaataactaacacgtatatataataaaatataaatattacacattagtagtttcgtaaagttagtataaaatttaaaattagaatatcatttttaatatatttgaataatacattgagaaaacatatatgctattacatgagaaaaaaaatataatgatgctagccgcgcaatctgcgtgggccaccgtgctagttaatagtatagtaagcaactattatataaattggctattaaattgactatagatgaattggagctattagtgggctatactattaaacttgctcttacatgacacggaaaaagatttttttgaaaaaaaaaagcaattagcgtacgattaatataatatggagtaatttagtacaaataagttaaaaagaatcgtttttacatatcataataaaacgaacgaatggagttagctgcaccagtgatatatgccaagctatttagctgtcccctagcttggtgtggctaggctagtaatccgtccgtcttattttaagtgtaaagatttttctatatcaaatatttgaccgttcgtcttatttaattttttttaaaaaaatttcacacataaaaatattataaaatttcaaataagaccgactgtcaaacgttgggaacagaaactcacaaatgcacctaaaatgggacgtatggatacgtgcagtaaccttttctggttttgaaacgatagtatatttcatgattaccatacggttttcacgataaccgcacggttaccacagtaaccacgaaatcaggagtgacgatgacgataatcaccctaaacggtttggtaaagtattgagagttgtgcagtataggagactagttactagtatagttgtacagtcatacaaagctatgcactctagcttgttataaatgatttgctggtcatttctgaaccttttgcagagtttggcaacgaatagatttcttaggcattgtttagttcccacgcaaaaaactttcacgatatcacattaaatatttagacacatgtatggagtattaaatatagaaaaaaaactaattacacagattgcgtgtaaaattgtgagacgaatattttaagcctaattgctacatgatttgacaatgtggtgctacagtaaacatttgctaataacagattaattaggcttaataaattcgtctcacagtttataggcggaatatgtaatttgttttgttattagtctacgtttaatactactaatgtgtgtccgtatatccgatgtgacacgccaaaactttttacccctgaatctaaacacagccttattttgagctataggttgtgaagttctacgctcgatgaaaaccaataagggaaagcacccatgcaacacaattgagcatttcctactactttctaccccttcgtctaaaaaaacaaccaacaatcctacctaagaaactgacacactaggatttttttttatagattagcagtaagtagtaagatttttcttaggattcaagtttgacagatgccaccctaattttcactggctttcctgtttgtttttcaaaatccgtgttctggcatacagatacggtaggccgaaaattgctaagaaacggccaagaaaattcagttaaagttgcaaggcagtttctgaatgatcggtagtatagctctgttcaaaatgatctgttgctagctgcctgctgcatgtaacgtgtactcctacgaacgagcttagactgcagcagcagcagcatctactacagtgcataaggcacatgtaccatgcagtacccggggtagtttgacgctagccatgaaaatttacgttaaattattttcctttttctttggttgcatcggttcatcacatgagttgtacgcttggcttttgcacggttgcttgttgttttggtggcttgcggctgcaggggttttgcactgacacgtatcgatctagaggcatggtttcagcttcggtgaataattaaaccgtcaaatttaattagaatatgtttcttttgtcactttttttaccctcggttccaggtacttccaatatttgaattttattgaaaaactagaaaggaagcccgtacatatgcacgggcatatcgtatttattgctaagagaattaagtcatatctcaccatatacatataagaatagatttggcctcgtaataaaaaaaatatgttgtaaaatagaccgtagacttttatataaatgataagcatgtctcttatattcaaacaaaaatcacttttgtccaggtaaagtgtaaatctcctattatcaccattactaattatcatgatatgtttttaataaatagaacttcatctgtaccatcaaaataaggctaataaatcattaatacataaaatgttcatttcaactacgtacataaatgttatgtcaacacttatttctaaatctacgagtaaatattctaaaactaccgcttctattggttattaggataacaccatttaaacacatttaatttgttttttatattgatctggtttaacttgcatatttatttttggagtactaaaatttattttattgtatagaaaatcctattttgaaaacatctatattccgatggttctaccaacttatattagtattttttttgggtgttatagctttattatggtatgcacataccttttttttgttttattcaatcgaacatccggtaaaatggtttctctcgtatacataggagattaagagggagcgggccgatctaatgatctaaaataatgggtccatcattttgaatgaaaattgacaacgaaattatagagtgccacgtggtattctaagagtgcttgcagaaatgccacatgaccatatttgtggagtaataaattttatttttatagtatagaaaattctatttttataagaccgtctatttttttcttccgacgcacataaatttttttgggtcttatagctttttttactcatgtaactgtacatacttttttttaagagaactaaagggctttattttgttttatagtctttttatcgtagtacatactctgatatataattttttggtctttatagctttattatcgtatatacgcatgtttctttgtatttttttttcaatcgaacatccggtaaacattttctctcgtttacacaggaaattttgaggaaataggctaatgtaatgatataaaataatggatccatcattttaaatgaaaactgatagcaaaattgtaaagtgtcatgcatgtagcagtctaagattgttatatagtatagaaaattctattttaaaaaaccatctatattttttcaaccgacgtacatatattttttttataggtcttatactttttttattactcgtgaaaagtgtcatgcatgtgacagtctaagaagagtgtttatagaaacgccacgtgaccttatttgtgaagtaataaattttgttttcatagtatagaaaatcctattttaaaaaaaaaccgttaattttttctactgatatatgtatatattttttaggtcttatacctttttcttattactcgtgcatacgtgtaagtttttcaagtgtaggtacgtatttatcgtaggtatgtactttatggatagtactgtacgtacgatcacgatcacgatgccatcggcaggtttagtttttttttttttcccgtcgtatgtatatacgccacagtaagtttttccggtatatatattgaaaggaagtattagatttaatctaatggcttaaaataatgggtccaccaatttaaatgaaaattgatgatgagattataaactgccacgtggcaacctaggagtgtttgtaggagcgccacatggcggcttaggaatgtttataggaagattaatggatttttagtatataatagatagatagatagattgatagatagatagatagatatagctactatttctaaatctcttatctcaaccaatatttacaacaatcttttatttaattttttcatatattttatcaacccaaccgatcactatcatttctcttttagtttcacgtcccttcttaatcctgtgaaaaacatcagaagtgcttgtgttttttatatgggaatcatttttcaaccttgatttctggaccgtttatgaatacaagtagtatatgattacagtatatgtcagggttatggataccacatatctaatagtagttgactaaatctcgacaggacccactacataccatgttctatacagaagcaatcttcggatataggaagagttccggataaggaaagacaaccagagttctacgtgaaaacgacaaggactactcggattgtatccatattggtttccctagttctacttgtataagaggacacctatgggtataaatacaagcccccctaggaggaggagaggggggagaatgaacacccaacataatcgacatagaagccacaacatagaagcctacatacgctaagacacgccgccggatatcgacttcagggataaacacggctagtaccctacggtgtctccggatactgtcaggagagatgaaagcgctatctctgatctcgccgggcacggattcgaggagaaaggctaccctgttgtcgactacgggtcagatcgtcagaccgctatgtcgacaacagttagataggctaccctaaatattatactggtatgattatcatgaataagagcaatactggcttcagccaacaggatatagggttattacctgacaattcaggggcccgaatctgtataaaaatcctcgcctccgtctctttacctcagtctcgcgtatatcctagtaccaacgatccctataccatgcaaataccgtagtcgagacatcaaacgtcgacagtggcgcgccaggtagggggattttggtgcttcaggatttcgacaagatgggtttaagagatggactctccgacaacaagctattcgacgacttcggaccaggaagatccaacccggccagagtacgtctctcgatgaggttggaatcatcgtcatcaactatttgatccggcgagatcgatcaagctccaagatatcatcgccgcgaaggataatagttcaatatcgccagatacgggacttcggttcatgtcgactacaacggaacttgccgatctacgatcataattggtcccgaccgagtccaaatctgattacgtgcgcctgtaaattctcaaaaccggctggcggctgcaccttgtgcctggatagtcctactcggacacgatgacaagaggatgcacactatacgtgaagtctgtacagggaactgaagcacgtgtccaccatgtgacgggatgccacccgttttcaggtatttgatagattaattttttaaattaatctactaattttgtagatatatccggtatatatctacacaggtacacaatattttcgtacctatttttacaatctatacagcattgtcagatctatattatgtttacctagagcatgttttttatacaatatctattgcgcgagtgtccccgatgttaaatcgacaacggtttaacgctggggctcgctctattttcttctgtataaatcatgcttgtttacggtttacataatgcctgatatttatatctgctcgttatatcctgataatactagaagatacatgcagttttttgagtacatactcgatattctctgctatatgtcttgccttctagaaaatatttttcatgaacaattgagcacttgagtaggttgtggtcaagtacatcgcattgtcgagaacgatctcgacaaatgcagagtcgttgcgcccaacctaccaacaaagaccgacgacctatctcatagcaccggccatggctggactactcgagaaaaggttgttaacggataattcctcgggaacgccgttggcttgatcacccgacatgattgcgaacggacatccggatatgctacaagttgggtgtgtgagtcatgctggccacatgacacgcacatgtaataaaccaactctagcacctccattggtgttcgagagataattctacacgttcggtggttctcgaaccagtacgtagcaatctcccgcaccgcagcttccattggtgttcgaaagatgattctacatgtttgttggtcctcgaaccagtatgtagcaatctctcgcaccgcaacctcagatggtcgaggtacgactacagcaataacgcagcggtcctcgcaccacgacttcaaataatcgagagacacctacttactggttctcaaccagtcaatcgtagcgatctatcgtacatttacttctagtggtcgagtttagactacatctggttctcgaccagcggtgtagcgattctcccactgcccttaattctagtggtcgagtttagactacatccggttctcgaccagcggtgtagcgattctcccactacctttacttctagtggtcgagttacgactactacctggttctcgaccagcggtgtagcgattctcccactacctttacttctagtagtcgagttatgactactacctggtcctcgaccagcggtgtagcgattctcccactacctttacttctagtggtcgagttatgactactacctggtccttgaccagaggtgtagcgattctcccattacctttacttcaacaaagttgatatcaggtacacaatatcgccaactgttttacccagagatcccttaccacgatgacacctagcgttgaaacctatcctactgttcctttacgctgtcttgacaaggcctctgaggaatctaagggaactttagctgggacgcccagagccgataaggccttgtcggatccttcagagacgaaagaccatgtaagatctggtcgtgtaagagttctcgccgtgcgtattaaccaagctgtgtaatcagaaatggattttccaacttcacggctgggggctaggatcagtgcttattcaactaaggcaggtcaaaggtccaagagccttatcctccgagaacgattctccgacgacaatgctgggggctagggagagtgtataactcaacaaactgactgatcgaagtcggtaaaagagtagacgctcatatacaaaacattggtctgtaagtttaattcattttcggttttccatacatattataacatgttaccctttgagcgttcgctcgggggctat

SEQ ID NO: 70085 - DNA, 56811 bp, Oryza sativa
  unsure (1)..(56811): unsure at all n locations
atgtggaaacagcttttgttaatcatcatagtacgaaacaaccatcccaagctaagaaaaggaacatgcaactatatattattaaccagaagaacagaagcaggttaatccggtcttgagaaatttattatcctaacaaggcacggagaaatcccataattacactgctccacgtcccagtcgtttcccgggtctagcattcggggtattgactacacgctgaatttagtgagcaggtcatcccgtcaagagagccttgcggatgacaaatagcaaaagaacatagattatttcatccataatggtgccccagcagacatcatagctgattcagtgatagagcttgcccagatcatctttgaatttggtctttatctgctccctcttcagtttaagtgcagctgtcaccagcccagactctggagtccatggttcaggcagcaacacaatctttgctggtatttcaaacttctcaagcctcgctgcttttgcagcctgcaccgttaaaacacattgcgttagatatcatggagaatgatggtatgtaattaacatgagtataaaaatcatactagtattatcatttgcaggttaagatcgccttagattacaagtacattaatcagcaatctgaatgacatcaaagacgatggattgcttataggaatcatctgtcatctccatcgcgatgcttttttaagtactttgtcatgcaaacataaactgtattgcactcatgtgatagcaaaatcctctgaaatccacagtaggtcggtctccttacattagtcacaggtcatctaatcgccaggttagtaaagacatacccatttcgtgtcataaatctgtgatgagctttggctataatcaggataacacagcagaaagatcaatgtgctactagttgttttcagttatgaagatactacaggctccaaataatttgaagaatacaatatgttcttcagcataattatatcctagtagttctataaacaagtctactgcatccatcttatctgttgttgtactcactgatgagcttgtaaaatccatcagcttttgcacttcacctatgttctttcataatttatatctttcaaatgtaatccagaaaatggcattgtctaatccatgaaatgaacccatttcaaattaaagatgataaaagaatttttaagtgctcctttggatattgggaaatattcctgcttcttctgggaaatgaactactacaataaaattcctgcattttaaaggagccttgaaattttaaattactttaaaaatagaaatgaaaacagtggggatttattgaatttctatgacatataaaacggacgattgattagagttctagtgcaagagttactgataatttgaatttcattttgatttctgaaataaagatggacactcagtttcaatagatgctcagataatgaaaacaaaagaacgttaaattctagcaatagacagctgatagatcaagcagacaactctccaggagaaatgcaagatcatactgatgtaatggtacatagaagtgatcaactcaagtctaacctttgatagagattgctggacctccttaatggcttgatcattgtggcacagctcatcaaagtttttgtagttaatcccagaattttgagcccactgctctaaggcctggtgcgccggcactaccaacgccacacaataattatgaaatggatcagcataaaccattatgctgtccacataattgctagtagttagagctgattcaacctgtaaaggccagagagaacgagagagagagggggtttaatataattataatacaaaaagaatacccataatggttgaggcactattgtaaccaaaccttgccaagagacacatattctccatgctgaagttttactatatccttttttctatcaatgatctcgaggcacccatcaggatggaactggccaatatctccagtgtaaaaccagcgcattcccctctcatctacctggagtaatcagaaacaaaaattgaagtgaaaaatattgtatttgaccaccaaggatgattggcaaagatcctttaccttgtagacctcatttgtttttgcttcattgttgaaataaccttttgttatgctgtatccaccaactacaacctctcctcggggcattggagaatcagaaattttatagccaccttcttcccatgaaacgagctgaattcatttgatcagaaaaaagagaattagagatacatatacaacatgataagagaacagaaatatctcacaacagaatgaaatgcttgctaataaaccaaccaaaactattgtggtattgtaaaataattttacagactttctgtgtgccactttaagttttagaatggggatgttggtcattcttaaggtaacaaatttattgttgtctataggccatttttcctaacatcaagatgaacatacagcaactcacataatctttatttgggttgaaacaaaataattactataacttgaataaaagtgagagaaggggaaggggaagacttatgtattgtttgataaagaaagagagtctaatcatccaaaatagtgtagcttctgaacaataggatcaaatagtaagagcatctctagcagaagccctcattttaaagcccctaaaaaccaaatgagggctgcccccaattctctaggaccctacaaatgccttcaactccagcaacagcccccatttcttagaccatatttattattctctattatattaatatagactataggtttatgtctaatttaacatctcaataattaaaagataaatattttacaagatcatatcgatgtaaaagttaattatcaggtgcattatgcccgaacagcataaactatagagtatatatttaaccaaactactgaaatattatcctatatgatgtgtcaaagaaaaaaatgaatatataccactgtctctttccccaatcctgtatatctcgacccaatggaaaaataataatctttccactagaatcctctatgcctcagtaaaaaaaatgcaaagaaaaatctactccctgcattctgcgtgcagggacattgcaggggaaagcagacaggcagaagagggacaggcggggatgggctagtgggcaagcgctggccctccgggtggcagcgccgccagcgcgagcaggaggtggcgcgggttggcaggcaaaagagctaaaatcagtgcggtgattcgcagacgtgcgagcggatggcggacctttctggggtggtcttgccggaggtgaggggtcaacgacggtagccggaggagatacaaatgcatcgcagggtgttgtgggacagggaatgtgagatgagcgcgcgaagggaaaataacgtctgcaccagaaaaaacgtcgataggggccatcctgttgagcccccaggactgggggtttcgagggaggattcaggggcctcctcactttggggtctatagtagggtctctgctggacttgattttttcatgttaactctcataatttagttaggggctgggtttagggtccctgctggagatgctctaaggaagacgtattatcatggcaggccagctcatgcagatagcaataggtgtataatattatgtagtatgtcaaaactgataaaaaaactatatatgtatgaacggtatatcagaagagagaatccataggtgtatggaactatttccacattgttatttacagttacttttgactggttattaataattaagttgttgtctgttgttatatcctcatggaaatccccagggtgataaagccttgtgggagacatgggctggtagccttggtcggagaggtgtggggccgtgagacagtaatttctctctaggcatagtataaacagatttttaccattttatgtatcttaacgctattatgttcatttaattataaatttgcatacataaatatcacttatatctgttaattatatgcatatacatcagataagttgactgtccctagtaagtataagcaaataaatcagataagctgactctccctagtaaggcacagaccttgacatagcaacaaggaaggggtggaccaacacggcccacacttgtgtcatcccattcagaaaaggctgctccagcacaagtctctgtcaatccatagccttgacctactggtacactgcagcacaggtaattcaaaactgcataagaaccaaaaacaaatgcagcgacatacaataaaaggaagctcatcacattatagcatagtgcatgtactctagaaaggtcctctgtttaatatttcaactttcagcatttgattcactaaacgtgcaaatacaaatttcactataaagtgatttttgacaaactgtttgaattaaaaaaacatataagtagcacgcccaaattttatgagcttatccaacaaatgttttgttttctgtaaataaataaatccaaaggtttgatgagcgcactacctgcaaacgtacactctaacaatgtctaggacttgagtatggcattgaacttgaattttccatgaggtaagttcattaaaatcagtattttttttagtaacgtcttaaacaaacttaagatgtacaataagacaaaaaaaaaagttgactccttgtatgtttttggaattcatgtaattctagcctcatttttcgaagaaaaaaaagataattcaagtatccgagaaatgacactatgctctacgactggcacacaatcttcaacaaataaactcagtggaaatttttggaagaatacttcttcagttgacatctcactgattgcaaatggttaaatttaagataatccaaataggacaaaagaaattacccaagacatatattcataaatctttgtgtgtcactcgatagaggtgcaccaccacaaagaacaaatctaatgcgcccaccaagcatggaacgtattggtttaaaaatgaggttatcccatatcatcctctctggtgcccaggatccaaaccaacttccttcaatagctccaagatttcgtttataggcaatgtcaaacagctttttggtcagaccacccttctcaccaacctggaaacataatttaaatattaagttttgagatgagaagtatgtttaaaccatattttggtgcatgatcataaaatttgaccgttcaattctgcctgcatgatacatgccatttgatgcaatgcatttaaaatattaagtctacagaaactcattgtttcaaacatgtttccagccttcggtttcatcatctgcttgttggcttatcagccacaaccaatttgaatttgaaacttaattttagagttgaatttggggttttctcatcatagtctattctccagccttgtacctcccatttttaatatatgatgccgttaactttttgataaacgtttgatcattcgtcctattcaaaattttagagcgaatataaaaaaatttaagccatgcttaaagaacatttgacaataaatcaaatcataataaaataaatgataattacatattttttaataagaagaatggtcaaatgtatctcaaaatgtcaacagcgccatatgttaaaaaacggagggagtataacagtttaacccaaaaattattttcggttgcttcattttctatggcttatcagcctcagccgaagctcagacttgtatgctagacaagacatgaagcgtgctacggtatggtaggcattataatggctagggttgggaaataagagatgcagaccagagcagtgcaccaaaactgaaggttgtagtgttgtatgataccaaaaacatgcatgttatactatgctagaaatggctggggcctgcacttgactttgcccattgagctagccagaacatcaatttttttttttaagatatgcctggtgtaaggtacagaaaaatctacaagttgctaggctgctagatgtgcaaacgacaaccaaacagtgcatctatatcctaatcttaattccttaaaaatactgaattgggggtgatagtgtgctcttctataccccaccaagttgtgtggtcaggtataagtggtgacatataaactgtttgcagtatttaggttttagctgatcccatatggcatgtacatccattgaaatacgtgggcacattgctagcagtagcactcctttaaaaataaggttgtggtggttgtgaatccaccactcaccaactctgcactgcaatttttatgaattgctgccttcatttccttacattacaatacctcaatatcccatatgttgtttgttcttatttggccttctaaaaattagaagttgacatgaaaatgtccaagatggaccaatgtatatgtggcatgtgcgaatacagtcaaacattactaaaacgaaaaggaaattaagtacatggccatacagataacgcttaacataaaacaatattaggacctgtatggttcaaaacttttttctttagtttattcacaggcagatatttaaacatataaatgattaatgcatcaaaggcactctaaagacatgttgcagctgaatgcaaatggcatataaaagattgcagaactagtcaaagatggaaagataatggtgtaaactactgagatagatggtatgagaggagaatcttgaacctttttaaacacggcatctctgatgcggtctaaaattgcagggactgaaatcataagagtaggcttcagtgcagaaacatctccttttgtccccttctttattttatttgatgtatctgtcatagtcagagctgagccatatccaatggcagcaccagaagctaacatgacagtctggccaaacaaaacaacaatatgtcatagaaatattcacagttcttaataatggcatctctctcaattgcaaaagatgtcacctctgctgctagttcaaagacatgagccagcggaaggtatgccagataaacatcccctgtgccaagttttggtatgattgtcatgacagctgcagttgtggccaccatatttccatgtgtaatcattacaccctatgtcaaaggaaaccataaaactggattaaaagaggacacaagaactgcaaactcaaaagtggttgacattgtgataaatgaaagtacatagctgtggatccacaatggattgtaattcaagtttgcacaaaaaaatatgcattatgctgatcattttgtcaaaaagacgaacgttgtcacactcatgaacagttaattcatatattttatctatacctgtttttcctaatccgaggaattttgagttgtttgtgcaaaatgatgttctcgttatgaatttcaaatttgagcctttttcgcgtatcaaaatgcatatggtttctgaatttatttttttttttctctgaatactagagtcaacctagagatccagtggttatagagggtcttaattgtacattggaacagtccatggatctctacatgatggtgaggagtggatgaagcagtgatggatcagtttggttcatcctgttcccatccttgttatccttccacaataagcaaagtgggtaattgcacttgcaaaaataccaaggaaaaaccaactttcctttggggaagagaggaaaagagagtatatatcaggaaagtgaatttaatttgtagaaaggatttaatgtcctgctttatttctcatttgtaaattaaatgggcataactgcatattatcataactctcaatgttgcccttaattatggagagcatcagttcaaaaggaagttatgtgagtacgttgagaataggcccaagagattatcataatatctgtcaagctaatgggctaataggatcgtaattctctatatcatacatcacttaagctcttgttcagtgaaagtaacaggatggtaggctcatcatgtgtgtacaccttcagatgaagcaaaaagaaaaggaggaacaagaaagaatgacccctgcttttgtccttatttattttcatgaataaaaatagataacagcatatgacagaaaaaatcagaatatctttgagcacaagtgtaccttgggaagacccgtacttccacttgtatacataataactgcagtatcagtgcttgaaggtaatcttgcatctgtatgtgatgttttacccaattcttcaacttcaccaaaagaaaatgttgtccagtgcttcatttgattgagtacctcagcctcaacaggttcatcctcaatatagataacatgcttaacactctgcaacttggaactgattgcaggtagcttcttaagttgctttgaatcacatatcagagttgaaacctgtgtctgaaatttataacacacaaaaaaaatgagtttcccatctactaatggttgctgtcatttaactcttctaaagtgtaaccatctactaacggcaattcagcatggacatgtgtcaaaattcaagaagttgaactctgcctttataactctcttaccaaaacaggtggatgcttgtagagttaaagattttcgctccataagcctcattcacagttttgcgatgttggtttcaaagatcttggcaaaccgtcttgctccgctgcttcctagtatggtttctattaatcaaagtgcttttatcaaagggagaagtatccatgataatttcttccttgtgcagcaaatggccaagtgtttgcatgcaagaaaagaatcacatgttctgttgaagctggatatatctaaggcttttgactcagtttcttggccttctcttttggaggttctacaacagttggattttggtcgtttttggtgcaacctactttgtttgctgctgtctacctcttctactcgggttctaatcaatggggagcctgaggaggtgattctgcaccgccgcggccttcggcaaggtgatccattgtccccgatgctttttattctagtcatggatgttctcagctcactagttgattgggtggcccaagaaggatggttgcaacctcttgcttttcggcaaacgcagcagcgatgctccttttttgctgataatgtggtcttgttctctaggccaacagctgacgatctctcagttatcacacaggttcttgatatttttggtcatgcttcaggacttgtgactaacatgcagaaaagctcgataactcccattaggtgcaatgaggatgagttgaaagtgatttctaacatgctgccatgtgaggtcaaggattttccttgttcatatttgggcttgccgctgaacattaagaagccttctaaagccaagttgcaagctcctgttgataaggtagcagattacctcccaatgtggaaggcctccctcatgaacaaggccggtcgactcatcttggtgcgggtggtcctctccgcctgagttgggcactacgtatccgttggttatggctccagaagacagatagtgaccgtgcgtggcaaggcctacccatccaggttcctcgcatgtctcataatctcttcagtgtggctgttgaatcacgagttgggaatgggcagtctactttgttttggactgataggtggttactaggaaggaatatcttaaaaatggcccctaatctgtgtatgttggtcgctaagagggtggttaaacgttgtacagtggctcacgctctcaataacgggaaatggatcacggacataaaagggcccttgactgtgcaagtgattaatgagtatctccagatatgggactcagtttttggtatagggctgcaagaaggcgtcccggatcagcatgtttggaaactaacagactcagggtcctacacttccaagtctgcctacagggccttctttgttgggactgtccgttttgctccttggaaaaggatttggaatagttgggctcctcttaagtgtaagttttttgtgtggttggccatttacaacagatgttggacggcggatcgacttgcaaagcgaggcttgcctcaccgggacgcttgtccgctttatgatcaggccgacgagacgatacagcacatcttggtttcctgtgtgttcagtcgacaagtttggtccttggtcctgcaaaggcttggtttctcctccacacttccgaatcaggatacacgtaagttttcgagttggtggtcaaggacagtgaaaggcttacagaagaatgagaagaaggggctcaattcgctagtcatcttagccatctgggaaatttggaaacatataaatgattgtgttttcaatagagctacgcatagtgtgcctgtggcaatccaagccatagctaatgagggtgcactttggtgttttgtgggagcatcaaaactccaagagctatttgcgaaagcaatagctcctgtaccataggaggtcgaagcgcgtgcttgatgttttgtgtgtttttgtgaggtgttattgttttgtataaccttggtaggtgggtgctgaggtttgctaaatccttcaccgcttgcctctttattcttgcttaatgaaatgatacgcagatcccatgcgtattcggaaaaaaaaaatcttctcatagagttttttaagccttgggaaacaatttgcatggttattgcttgaatgttcatactggtaaagatttctctcaagaacaaccaactaatgaagatagtttaggcaagacaggtaataaactgattaaacaatgtaaaccaaacagacaaaaatagtatcatatcaacaacatgaactaccatacaagcttcggtattacatttcatccaccaaacagttcgcccaaaatcttaaaagttgctgacatataaggatgacccatacttcaataaaatgtgtaaaattacccatatataaagaaaaaaaagaaacggtaggaatgtactagtttcccaagtggataattataagaatgaacataaatactgcacaaaaaagccacatatgggttgtacctcattcagtgaatgcaccagtgcatcctcgccaagagatgcatagatagttacaactgttagattttgtcgaaagcatccctgacaaaataaaacaattattgtcatacaggttcataggttctcacaaatgtatacagaaagccacactatttattataatcacctgagcagcaatgatccactcagttcttgtatcagcaaatattgcagcacgactatctcgttggtgacccaacttgatgagaccagaagaaaaattacatgcacgactaaatgcttctgcgtaggtatcccattcatattcacctaaatgcaatttctcgaacttcctgccatcaggtgactccacaaattctctattgattagcttccttgtgccaagacacctgtgtcgagggtattttttgctagccatctcaaataaagctgccattgtggtggcaccctcccatggaacttcaactaacatggaaaatctactgtttcgcatggcaagtcctgcctcaccacccacatcagcttgtactgctcttttctttccctttttgttgaatatggaagaaagcatgataggaataactacagcaagtagaatggcaccaataattccaggcagaccatactctttcaccagtggaacatcacttgtggcaattctttgaagaattgacatgtttggattatcgccagtattttctcccatgattttaagatttcatcaactgaaagatttcacaaatttcgctacaagaaagtataaagtgttaataaccgtcatgttagtatgttgcaaataagtaataactaatttcttctcaattttataaataattgccttgaacagaagaaatgagtataactagattagtgcagcatggagaatgctttcgcactacagtagcattctatttaacattatgaatcatggaaaaatgaaaaatactagcaatgaacaatatttagaagcactggtactcttcttccaactaacaaaattaaaaatgatcgtatggtataaacagattcagcagctattagacagccttgttatgcagagcaaaaaactgtaaagtgcagtaaaacagtaaatacttggtagttttaatctctttgagtaaataacatatccgcatctccagtgaatgttaaatggtattgctcagagcaccgcacaaattattttatgatgacaacaaaattcccaaaggtcaacttaagttgctaaaaagtacaataatgaaattgcttgtgaatcctgcagttgcctacttctacagtgagaacgactcaacattacaagctgactcgtggaagcaacagcactatcacaacaggttagcagtcaagatgatatgtaagattcagcacgaagcaacgaagttgacagaaatattttgtaagtggagtaagtagattagcaggaatcttatgacaagttgaagacttgtagagaagataattcaataaaatatagcatccatctctggtttgctcaaagggccaatatcttatggcaaggtccttcgaagttgcaagcaattacaaagggacacggatttacatttgaagaaaaaaaaaagataacatgatctcacctaagaaacaaggagtaaagtaaacaaccactttgtgcaaattagcagcggtaggagaggaataattgaggcttgaggaagaaccattgaatagggacattaattaaacggttaaagttataattattccttactctgtacagcagcatagtctgtgcgtgggatcaaaggaaatcaggggcggatcaaacttgggacatgggggctcaaacttttgggggagcaaacaaattaagaaagatctagaatagaagctagggttaacgcgagcaaattccaggcaaaagtactcccggtgggagagagagatgaatcagaaagaggatgtggatgctcaccccgatcccctcccctcccctcccctgctctgctcgccagatggagatcggcgcacctcccctccgttgctctgctcgccagatggagatcggcgtccggcgtcccctcccctgttcacccgcgactcgtcttggcgcaaggagcggagacgacgagacgagagatttctgtttcttttacgccaagggaaggaagtggaagatgctcgagtgctccaccttttgtataaaaagctttcaggccgcgttcggcagttagctttcccatcttataatacgcatttcaaattgctagatggggttgtttttataattttatataaaaatattgttttaaaaaataatattaatatatttcttgagttagttttttaatacttaattaatcatacgctaatgagctgctccgtttttccaaagagaaaggtttccaactcagggcaccgaacgcaggctgcgaacatggaaaacggtattgcccatgagtgtttgattaattaagtattagcttaaaatatttaaataatagattaatatgatttttctaaagcaacttttctataaaaattttttttcaaaaaaacacatnncgtttagcagtttcagggagcaccacgntngtgaaaaacgagaggtanaagttggaaaangaacacnagcctgttgggcacccacccttgctagcatttggtgcggataagtccactttgactccctcaactatagctctactatgattcatatccctgaatcgtaataccaggtatctcaccccccctcaactataaaaactggtgcaatttaacttcctcgttttagtgggtgttttcgctgacgttgcactttgacttgttccaatccgctgagtcacctagtgggacccgtatgtcagtgccacatactctcttctcttccttccctttccctcctcactttcctctctcatggaaataacaacatacgatggtgattaggggaggtcatcgttgtgtcgccaacccctctttccccttcctctcgtctccgtcggggaggacgaagcacgagcgagaatgacagcggcagtgagaggggaggctgtcgtcgtgccgccgtctctcccgtcaccatctccgcctcccctctgctgccctttccactcgccgtcgtcgaggagcggaaagcacgagcgaggatgacaacgatggtgagaggggaggtcatcattgcatcgttgtccctcctgccaccgcctccgctgctccctttcgttcaccgccatcggggaggaggaagcacgagcgaggatggtggcggtggtgagaggggaggtcatcatcacgtcgccgtccctcccacccataaccttgcatggggaaagccgccgcacttactctgccaacaacgcgtcatcatcgctctgacggccaccacgctctgtctcatctagccgattccgctgagggaagagaagaccggagtggcacgacacgccgtcgtcacctcgatggccaccccggtatgtctcgtcctacaccgctcatcccttccgccaccgcctcttcctcacctttgttgtcgccaacatgtctgatttcgccgagagaagagaagactggagtggtgtggcgcctctgccctgccttcctgccagcaatgatgagagggaaaagataaacgtcattgataggtgggtcccacaaggtgacatagcaggttagaccaaatcaaagtgccacatcagcaaaacagtccttcaaaaccgtctgagggagttaatagtcgagatatccgatattgcagttcatggatatgaattagatttaaccactaaggagtcaaagtggacttattcccattggtgctcgactcactaaggcctgcgtgactgcacaattaagaatgtagcccagttactcctcccccactgctccatccatttcaaattacttaggtcccgttcgtgtccactagaaatagttgataaaattttgaatatttgtggcacgcttttcaaacggctaaacggtatgtttcgtgcggaaactttttctatatgaaagttgctctaaatatcaaattaatctatttttcaagtttgtaataattaaaactcaattaatcatacgttaatatcaccttgttttacgtaaaacacttaatcttaatcttaatcttaatctttatctttaggaaaaaagaattattctaatcaaacattttaatctttaaccgttaatttctatatataaaaattttaacatcataagaattacacttttgacactatgagaaatatttttataattaacaattcatatgtggttaaactgaacataattctaaaaactaatgttaaacatagggatgtttcacttaggacaaagcctataactttaagtaatttgaaattgggaaagtagttattagtagtatcaatagtaaaccaacatgcatattagcgatcaccagacccgttccttttacacccgcaacagtagaggcgtgagaagatataaaacacatgtgtccttccttttacaaaaacatagacaatgtacttcctccgtcccaatatataacaacttaggatgggattagaccaatcctagaactacggatctcactactacaaaagtgatttttctgtacgagagcccatgaattttgcaaacggaccattactagtggcgtctgcaaaaatcgagggtcattgtcccatacggctccttaagtggcccgtatggaaaaatcgattttcccctacgggcctcttaagatggccgtatgcaaaaatgagtttatttttgcatgtggctgtttgacgaccaaatttggtaaattatgaaccacgttcgacattgagatcgaggcggattcaacaaagaggttgattcgaagaacagagtatgcatcggctagaatctgcattggctgagatggatcggacagaggacagccgatacagccgatagaggtgatgcagccgatttcgatgatgacagtttcgaagatgtttctagaatcaatcaaggtgcttcatgaagattgctgtgatggagatagggctcttggataggcaattgtatctattaattaggatattttatgtaatttctttagagatatgtttgggcaaaagtctgctgcaaagacttatggtatcttaaagtttattagaggtaaatgtcgtgtccggcaaggacatatcttgtatctcgggtataaatagaacccgaacccatgtaatcaattaacaattgttcaatataatctcggcgcattgccattgtcagggttacgggttaggtataccctttacccttcgatatacgtcgcatatcggtatggcatacccacgcgcatacagataccctccgcatgcattaaggaaatccttcacggagtttacggatggaaagagtcctactcgaaccagactgggtcgtcaacgtatcgtgtgaggtttgatgtctctgagttctacttggaaaccgcctgacctgcgatataaaagggaccccccggggaggacctaaggcatcgaatctcagagccaacacaacccccacagcctacgaagtcggagcctgcaggagccaaatcgctggggatctagtcgaaccaacttgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacatagacccttgtaccaacgtaccccaataccttctatatccggtctacgggtatcacccgtcgacagtggcgcgccaggcaggaggacttggtgctcaaggttctactactatgtcatccagcttcgtcgacaacagcgtcaacaccaactcaaccaagtatttcctgcttcaacaatgctggtgtggactcaagtcggcgaaatcgtcttcccggtttacaccacgatgccgatctcagccggtccatcaatgaccagaaacgagaacgcagtggctacaaaccaagacgactccatgtcaaaagatcctcccgccgaggcggagaacggaacctcgacgacatccgagctcgagaaggattctaatgcggccaaaccttgtcattccgacaagaaccacgagccgacgaggatgacttctgaagcgacaaggtcctggtgtcctatccacaaaaccaggaaacacactttgcaagcctgctgggtttttctcaacgtccgcgctgaaattcgcgcctgcaaagagcgtggaattcagcgtatttctccaactcgtgatgtctattgtcctattcacaagacaaagaatcatgacctctcaagctgcaaggtctttctcagcgccatgaaggcgccatctcctaaggtccaacagtcacacgtccccatcagggataaagacaaggaacgaggagcgacgccaacttcagatcaatttgttggggtaatcgacatcgatccccacgaaccgtcagtcttgcacctcctcgaagactatggatcatcgacaacgagcgcgccgcgggaggtattggctatcgatgatgtcggcacgtcagcgcgcaccaatgcagaagcagagaatcaaatcgccactccggcccagcacatcagagccgtcaacgctatactgagggaaaccccctacgatcccgttctgaacgacgatctcacgcattggacagaacgactatgggaataagtgaccaaccatagtaacgcgttcgaagaggccgctgccgcagcgcacccggagcagccaccaactagcgatgccaatggtgaaaaccctgaacagagggaatcgcctcatcgagccacccctccacctcgcggcactggcgatctccgagatcacctcaacggccgccgagaggcacgacgcacacgagacaacgagaaccgttcccggcgtcatgtctcttcacggcgccatgataacgaagatcgaggagaccgttcaaacgaagaccaagaccgtgataaccgccacgatcacaacgatcgcgaacggcgggtgccaagcgatactggtcgaggacgttgccataatgacgacgatgatggagaccggcgccgagacaacagcgggagacgacgacaggattctcgagagccaggccaacatcctcgtaatcatacgccggaaccaagcgacccatcgtcatcgtcatcatcctcgtcttcctcatcatcagatagacatccacgaaggacacacgatcgccgacaacccagcgctgggtgtagagctttcagtcgttccctgcgtgatgtccgatggcctgagagattccgacccggagcaatagaaaagtacgatgggagcaccgacccagaagagttccttcaagtctactccacagtactctacgctgccggagcagacgacaacgcattggcgaattatttgccaactgcgttaaaaggctctgcacgttcatggctgatgcatctcctgccttactcaatctcttcggggccagacctgtggcagcagttcgtcgccaacttccaaggaacctacaagcgccacgcgatcgaagacgacctacacgcgttaacacagaactcgggtgaatccttgagggaatatgttcggcgcttcaacgagtgcagaaatacaatccccgaaatcactgatgcttctgtaattcgcgccttcaagtccggtgtcagagatcgctatactacccaggagttggcaacaagaagcatcacaactactcggagattgttcgagattgttgagcgatgcgcccacgcagatgatgcgctaagacgcaagaatgataagccgaagaccgggggagagaagaaaccagccacggacgcacctgagtcaagcaagaagaaaaatcgcaaaaatgggaaaaggaaagctcaagcggaagtcctcgcaatagaatacgcgaaccctcccaaacgcccagacccacaaagtagcgacacaaagaaagcatggtgcctcatacacaagacggacagacattctttggaagattgccttgttttgaaaaaatcgctcgagaaacacattgcatttgaaaaaggcaagcgagtacgcgtggtcgaaaaggatgtggaggcggctccccaagaatcggattcagcatatccagtctctgacctccacgtttcacacatcttcagaggttccacaacgtactcctcaaagcgagaatacaagaaagtggaacgcgaaatctgttcgacatggcagggggctgcacccaagatgaagtggtctgaacagaagatagaattctcggaagaagaccaccccaagaccgccgtcatcccaggacgatatccgatcgtggtcgaaccctctattcggaacatcaaggtcgcacgggttctcatcgatggtggcagctcaatcaaccttcttttcgccagcactttggacgcaatgggaattccgcaaagcgagttgacaccaaccgatcaaccctttcatggaattactccccaatcctcgtccaggccattggacaagattacgttgcctgtgactttcggccaagctaacaacttccgaacagagcatatcacctttgatgtcgttgaattcgatatagcttacaacgccatcaacgggagaactgcacttgcgaagtttatggctgcatctcactacgcgtatcaagtgctcaagatgctgggaccgaagggaacaattactattcaagggaacgcaaagctggcgatgcaatgcgacaaacggagtttcgacatggtcgagcaaacacccagcccacctgccacgactgagccacccaagaaagtgagcaagacaaacaagaagccgaaaccggacggcgcaatcaagatcgttccactctccagtgccaaccccgacaagaccgtcaagatcggggcgacactaagcgagaaataggaactcgcgctcatcaccttcctccgtgacaatgctgacgtgttcgcttggcagccgtccgacatgccgggggtccccagggaggtgattgagcacaaactcatggtgcgacccgatgccaagccagtaaagcaaagactgcggagatttgcaccagaccgaaaataagtcatacgagaagagcttgacaaacttctcaaagctggcttcatcagagaagtacttcatccagagtggctagccaatccagtcatggtgcggaaggccaacggaaaatggagaatgtgcgtcgacttcaccgacctcaacaacgcgtgtcccaagaatcacttccctcttcctcgaatagatcaactggtggactcaacagccggctgtgagctgttgagctttctcgacgcttactctggctaccaccaaatcagcatggcaaaagaggacgaagagaagacagcattcatcacgccgttcggggtattttgctatgttaagatgccgtcggactgataaccgcagggaatactttccagcgtacggtccagggcgcacttagcgaccagctcggcaacaatgtcgaggcatacgtcgacgacatcgttgtcaggacaaagacaggcgactcattgattgacgatctgcgggaaaccttcgacaacctccgacgatatcgcctcatgctcaatccagagaagtgcacgttcggagtaccgtcgggcaagctgttcggtttccttgtctctagcagaggaatagaagcaaatcccgagaagatcaaggcaatcgagaacatgaagtcgcccacaagactcaaggaagtacaaaagctaaccggatgcatggcaacactgagcaggttcgtcgctaggatgggagaacgagggcaacctttcttcgctctgctgaagaaacaagacaaatttgtatggacacaggaagccgaagaggcattcgttgcactcaagcgctacctatcaaacccccctgtacttgttgctccccaacctaatgaagaattattcctctatattgccgccacgccatattccattagcaccgtcattgttgtcgagagagagaaagtacaacgaccagtctattacgtcagcgaagctctccacgacgcaaagacaagatatccacagatccaaaagctgctttacgcggtcatcatgacatcaaggaagctacgccactactttcaagcccacagagtcacagttgtctcctctttccccctcggtgaagttgtgagaaacaaagacgttgttggccgcattgcaaaatgggtagtcgagctgagccagtttgatgtccactttgtgccacgaacagccatcatgtcccaggtactcgccgacttcgtagccgattggactatgcctgataacaaatcagacaaccaagtcgacaacgaaacatggacaatggcgttcgatggtgcactcaacagccaaggagcaggggcaggatttatcttgacgtctccttccagagatcaattcaagcacgcaatccatctcaacttcagggcgaccaataacacagctgaatacgagggattactcgccgggataagagccacagccgcacttggggtcaagcgactaatcgtgaaaggggactccgagctagtcgcgaaccaggtgcacaaagattataaatgctctaaccccgagttatccaagtatatcgcagaagtcaggaagctagagaaaaggttcgatgggatcgaggtccgacacgtctaccgcaaggacaacatcgagccaaatgacctagcacgacgcgcgtccagacaagaaccgctcgagcccggcacttttctggacatcctgacgaagccattagtaaaagaggttagcggcgaagttagcccggccgcccccgacattagctcggaggccacaaaggcagaacgcgccgttgccgatattgagaccacagatgactggcgcatcccactaatcaaattcatcaacagcgaggatttgcccaaggacgatacagaggccgagaaaataacccgtaaagcaaaaatctactgtatggtcggcagcgatctatacaagaaagcgccaaacggggtacttctcaaatgcgtctcgtccgacgacggcagacacctcctccttgatatacatgaaggcatctgtgggtcacacgccgccggtcggacattggtcgggaaagcttttcgacaagggtttttctggccaaccgccctcaaagacgcatgcgacatggtccagtgatgtgaagcctatcaattccacagtaaacacacaaagctacctgcgcaagcgctccagactatccctcttacttggccgttctcgtgctggggctagatatactcgagccattcccatgaggacagggcggctacaggttcctattcgtggcgatcgacaaattcactaagtggatcgaagcagtacctacgggggaaatcaaggccaacaacgccatcaaattcatcaaggagatattttgcagatacgtactaccgcaccgcatcataaccgacaacggctcccagttcatcagcgccgatttccaggattactgcatcgggctgggagtcaagatatgcttcgcctcggtctctcaccctcaaagcaacggacaagtcgagaaggcaaacggcatagtactacaagggatcaaaacccgcatctacgacaggctcatgtcacatgacaaaaaatgggccgtacacaccacaccgacaacgtctaacaaggaaacacccttcttcctcgtgtacagctccggggccatgctcccagcaagctacgacatcagagtacacgagtacagaagcattccgacgaggaccaggaggagcagcgaaacgtcgacgtgaatctactcaaggaacatcgcgaacgagttgtcgtccgagcaggcagctatcaacaggccctccgccattaccacgagaagcgcatccgagcacgcatactttcgatcggtgactacgtcctccgacgggttcaaagccaagcagggcgaaacaagctctcacccaaatgggaaggaccttacacgatcacacaagtcttgcggccaggcgcattcaaaattgcaaatggtgatggtcgcgagttggcaaattcttggaacattgaccaactacgtaaattctatgtatgagtcaatatcatccataccagtaagacaccttacagtatcaataaagcctattcttaggcccatattataatcaaagtgttcctgcccgatgatcccttatcctgatgacacctagcgttgaaacctatcctcatgtccctttacgccgtcttgacaaggcctccgaggaacctaagggatcttcggctagggacgcctagagccgataaagacgaaagaccatgtaagatctggtcgtgtaagagttctcgtcgtgcgtattaaccaagccgcgaaatcggaaattaactttccaacttcacggctgggggcttaggactgagcttattcaaccaaggcaagtcaaagtccaagagccttatcctccgagaaaattcctccgacgacaaggctaggggctagggagagtgtacgactcaaacgacggactaaagtcgtgaactgagaacacactcttacacacgacatccggagtaagaaagatttgttaagatagatttcttttctatttcacaaaatactccttacaattttttacacaagtctaaaactatattacacttcttcctaagatatctatcacagggtacgaagactaccaagaaggccaacgccagtccatagactggaagaccttctccgccaacggcgccatcgacttcgccaggtggtctatctccgtctgagtcctccgagaacgagaaaaaccttcacggagaaaatcgaggtccaggcgcgggcgatgatctcgtaggcaagccaacacgtgccctccagcatattagctcgatcgacgacactcctgcttcaaggcctcgtcgatgcgtttgccgacgccatcgaactgagcacaggccccgttcagccacgagatgtatccggccgccgactccttgggatccccacggggtactcggagctctctacaaaccttggccatggatgtgcagcaactcttcaagtacgagttgaaccacacctcacgacctcggagcgtttccacagcctgctctttcttcactgcaagcatggttctctcgagttccactacttcaaactttgtcttccaatattggatacgacgatcttgaccagcaagagcaatctcgagatctgttcaatgtgggaacaactaagtcaagctgtactcctctttcgagaacatagctgatctagtcggaggagcaaaaagggatgaatggaccactaacctaaggaagtcgtcgccatccccgtccccgtagctaggatctggtctacattgtctggcgacgcatgtggttcaaacgcgagagccagaatgatcgccggtgactcaggttgcccacgctgctggacattctcgtcatcaacatctctacaagggacaaaaagtactcaaaatcaacatgcaagagtaagctaggataataactgcacgcacaaaggcggttgagatccatcaaagttttacacaacatgtctaaggagtacaagagatcctactcttcaaaaagagggagaacagattcccccagatcgccgacttcttccagcacccccttacgcgtgtcgctagccgccccctgatccaagatctcgcgcagatcgagttcaggatgcgccagcctcacacatgcaaggacgtggcacgccccggtgtagatcccgttggacgtctcctccccgatcctagccgcatgcttggaggggatctcctccatcgccgccgccagctccgcaaaagaagatgtcagcgagaactcatcgggattcgccgggatggtggaattaatgccgcactccccggcgagctggtgcagaccagtataggtgacccgcaacgagccacggatttccgacagattgttcccgagcttcgacatgcggtgctcgagcccctgtcgttgtcgctcgttgccggccaccaactccctcatcttcttgaggtcttcacgagcctccgccaactcgtgtgccagccggtcagcgcgctcggtcgccgatgccgccgccaaccttgcctcagcaatcttgcaaccaatgccgcgagcaccagcttcgaggagacgccccatctcgacctggagctcctcccaggtgaggacagcagccgatggaccacgaccagccgcgagatcgctggctgggccacttggtgtcgcctcgcggctcccggggcaagcacgacatccgtcgaggtcacagcgggagatgcgccgaaagtccctccggactcatcttgcaccgccttcgcccgcgccgccctatgagatagccatggttcagacaacgctcgaacaaaagcacgaacacttagattcatccacttacttctcgccatgtgtcacaagttgttgtcgtcgtggaggcgggggagacgcgtccgaggcctggagaacggttgatgcgaagtaaggcgaaattgttctggctgtaagatcagacaacaggatagcttactgagggggtagatgccttgcgacgatgtccgcttacagaggagaacttcctcccctttgtcggaacattgccaccacttgtagtagcagcagtagcagcagcagcatcggatgcctccttggcgactttctctttcaatgacgccgccacctgatggtccacgagcggcccgacgatgtcagtcagaggaagagcctacgcttcataaagtcacaaagtgatctcagaagaaaaacgcagaatgtctattgagtacacttacattgatggcagcgtcgtgttcggccgcccccttctcacaaaggggaacggggatgttactcgccgttgtcgggccactgatcatcacctggccgacacgacgtcccacggtttcattgttcagacctgtaaatcgagaaccaaatttcgataaatcaggaggaacgtgcacacgagcatgtcaagataaatgcaagaaagataccccgaggagaaacccgggtcgcgtcctccggtccggaatagtcaaaggctagatggactcgagcctggagcggctggatccgtctaccaacgaagtcagcagcgatttcatacctcgacaaacctcgtactcggagatcgtcgacaatatcgatgaacgattgaagagaaggggtcaaagggggctttgcggtccaagacaaaatcttgtccggttgttccttaggaacgatgaagacaggatccaaatcttcgatctgaagatagaaccacctcgtctaccatttgctgcaagaggaagggcactggaaggggatataacgcgacttcaggccatcccgaagtcggaacccgacgcatccagataccctgttggactccatccaacgcagctcatagtagaagcgaaagagatcaagaaagggctctaccccaatgtaggcctcacaaagatgtgaaaaaatactaaggaaggcgatagaattggggttcagatagagcaaagaaagaccatagaagttcaaaaccaagagaagaaattcggaaggcggagggagaaaaccgcagagaatgtagtcctcgatcgcaaccatgcgacctaagacgggctggggttcagtacctcctgcttccctttccatggttccacgactgggaagggcgccgtcctcctgaagcttctttagcgacgcgttggtggaggatgatttgccaagatccatcgccgatcggagatcgccggagaaagggctaaggtcgacgagctagggtttcttgtgggagcggagaagacgaagaacgcttgcaggcgggatgttttcttcacagtaggcggacttcaaaatggatccccaaaattcctttaaatagacgcactactgacggtgcgaattccaaggaaaggagagagatggccgccggaaatttctgggtccgttacgcgtggtagtttcttggacttcagtttaaattcactcgtgaccgttgggcttcacatggtgttctcgactacgtcctatctctacggtcctcacaccgggaacaacaacaatctcgacacaagaagtcgcaaatggttacacgagttcatttaagcagaagtcgggggctactatcagggttacgagttaggtataccctttaccctttgatatacgtcgcatatcggtatggcatacccacgcgcatacggataccctccgcatgcattaaggaaatccttcacggaatttacggatggaaagagtcctactcggaccagactgggtcgtcaacgtatcatgtgaggtttgatgtctccgagttctacttggaaaccgcctgacctgcgatataaaagggaccccccaaggaggacctaaggcatcgaatctcagagccaacacaacccccacagcctacaaagtcggagcctgcaggagccaaatcgccggggatttagtcgaaccaactcgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacgtagacccttgtaccaacgtaccccaataccctctatatccggtctacgggtatcacccgtcgacagccacccttttactttcgtttatttctacgagttcttgctttcgggttgagctgcatcgattcgatcttcaactagaagtaaaacttgttatggcggcttgcgttatcgaggttaatgcttccatctctatgatactttaaccctgtttatgtaatccatcgagttatcatatacatgttgcaatctatgctagtggcgctatataacttgttatcggctggttcttatcgttaggaaacaatcggtagagttatgttttattattaatttagattgtatcatatatctaccatctcttgtagattttcatcatcctgcttagatctcatacttgtctttatgtttaatgctgcatcggttgagttcgatctattaagtagaattcataattgtgatatctagcttgttttatgatcatcgagagagatagtatcggggtttcagccgatcttacctgacttagctttatgttttatatgcttaactaatatgctaagtctgccctttatattaagattttatcgcaataaagtatatcagacttctgtttgatatattctatctgttttaatatcttaacgtagagtagtatcggagtactagccgatacatgctagatctatctgatcggctatgctataagcgtttataatcttcatgttaatgtgtattttgatctaagtgatttatactatctcggcatggcgaccgatctatcccaatcacttgatttaaatatacatcgacagaaagattatgtagcgttaatatctatagccgattgagtagatttagtcttactttgcttatttacaattgccgattgattcacatgtgacacatcggctcgagaataaataatatgtcggcggcggctggccaatcagctatcatttatggattcaaccacggtttttcttgtctctctttctggttgattgcaggatcaaatcaactggcacgctcacgatcctaaaggcaagattttggacctgcactgaagttaagcaaatcttctaggccaatgtatgtttttcgcatcaacagcggctcacttaagcgcccgtaggccacttaaggagccgtatgcgaaaaaaaatttgaaaaaattgaaactagtttatctcactcatatgaaatccaaattagatggttttttttcctaaatgtttctaaaatcatgctctatcatgttattgtgttcttacttctattatttgggtcatttttcttgtgactttatttaattatcaattaaaaatttgaatttcaaaacttcaaataatattttgaagcagtaaatgatttatgatgaaaaagtcatcaacaacaaagttgtctccctcatcaacatctatataacttctatcttggtcattttttcatccgacaaagtgatggtaacattttcacaaaatttatatatatatctctctatagtttataaaactatataagatatgtacattttgtgaacaatgttacaaataactttgtcgaatgaagaaatgaccaaaatagaagttatatatcttgatgagttatacaactttgttgttgatgactttttcagtttaaatcatttagtatttgaaattgttatattttgaaaaatcaaattcaaattgttcaaataaagtcatatagaacaatgaccaaaacaaaaagttgtagatcttgatgagttatacaactttgtttttaacacctttttcatatgagttcatctagtgctataaaaatcgatttgaaatttaaaaagccacgtataaaaaatcaatttttacatgcggacgcttaagtagcccgtatgaaaaaatggtccctcttccgcagttcaaaaaatttcacacttaaccctatcttatcctctcctctcactttatcctctttgctccatgtttccaacccctctccctcgtattccgtgggcacgcttttcaaactgctaaacggtgcattttttgtaaaaaaaaattcaaattaatccatttttggaaaaaaaattgttaatacttaattaatcacacgctaatggaccgctccgtttttcgtgcggaggagatgggttccaaaccagggcatgcgaacacagcctcagtcttctctctcactctatctcttctctctctcagaccgagagtggcgcagggcgtggcggcggcactggccaagtgcagagggagcggccgcgggctctggtgccaagggcggcggaggcatggatccggcggtggcggcgcaacctcgcgtcgatccggcgtcggcggcccgtctcggcgtggatccgatggcggcgcgacgacggcgtcgatctggcgtcggcggcccgtccccgcgcggatccgccgcctctacctccctctgttgtcgccgtcgatttccccgccctcctctgcggcgcgacgacggcttcgatccgccggcggcggcgcgacctcgtgtcgatccggcgtctgcggcccgtccctgcgcggatccggcgctgacgacgatggacgacggtgggagcggcggattggccgacgacggcgacgaatccggcggcgcggaggccggctggattgggcagcagtgggctagggttcagcttttttctttttttttatttcgctgaattcattttcgcatgcggctagtataggggaccgcatgcaaaaattggatttttacatgcggttgctctagccgtatgcaaagatgacgatctttgcaggcctagccgtatgcgaaaatcgttgccatccgtatgcaaagacgtattctgtagtagtgtctggacatagatttgtacagattaaaacacacagttgtacatattaattacatccagttagactgaaggacctttcaagaagccatataagtttgtacagattaaaacacacagttgtacatgtacggatgtacccctctcgatcaaaccggggttattaggtaacagcttattgctagattaattacggatcaccgcccatacatggaacatgctagatatgaaggtgacacgcacaacacaatatactatgattattccattgcagatttgatcatgtcactgtaattggatgttaggttgagcaagatctcaggattaggacagtttagcacttttgtgcctttcgtcgtaatgtcgtggttccatgtctctggtgacactatagtaattaacaagtacattcccatgcaatgcaaaaggccaggcaaagataagaactatagctatctagcttggtaaagtgcttacctcgagaaatctcgtgttaggtacttgcatgctaggagttaggcctaggttagttggttttcctacccacccattttttaactggcatatgtgcatcaaaacgtactaaggctgtgtttgttggtggggttaggaaccatctctcacgtacagaaaaccaagcggtccattagcacgtgattaattaagtattacttttttaaaaaaaaataaatcaatatgattttttaagcaacttatgtattgaaactttttaaaaaaacataccgtttagtaatttgaaaagcgtacgcgcgaaaaacgagagggggagttgggaataggctatagatatttatatataaccatcgtacgaataggctatagattgcctataaatgatttgaattagtagttggctatactattaaacttgctctaatggagtagcattaatctctggaagattaattacatgaccaataattaggaagattatgtgattgctacaattaacttcagaatgaggttattcctaacccaatgactagaatgatatccatagcattaaataagctgccatctaagataaaaaaatgatatgacaagtaaataaatgaggaaagagaaggaaaccatgtcttgcatgggatttggtttctacacaacatccaagtcatcatgtgaaataagaaatagtggtatttacattggaagagtagtatatagtactagtttcttgattatgagaagtttatgaaaattatatatagtgttttaggttgggaatggcttgagggaggctgtggtgttgttggtctcggcgtatttttttctcccataataattaaaagagaatggagggatattcgacatagaaatcacaataatggccacctgctgtatagttccacgaaatacggcgaattgtgtattgtacaccactcaaattgaattaactaattaccggaccgcacgggtccagcaacctacagcacggtgcacgtaccattcaatttgcagcacgttcgcgcacacaccgttatctccatgtgatgtgcgacgacgaaccagaggagttgccgtacgtacgtgtcacggcgccacacacccctcgtcctccctgcaacctaaaccgttccacgcacatccgcctcggtcgatgctgcctcctcctgcttgcgttcggccctcgtattccggctcgacgaaccaggaccaatataaaaagctatggcctcaagaaaaagtaaatgtcaattaggataaaaccataatgtgatattctttacctaatatgaagccgagcattgctaatttgctatacgttcgataaaacttcatatgatcagagtacgatatttcgtagcctctggtgtgtgctgcaaatatggggcataacatgtttccacccaatcaaaaatcatggatggtaggatcgtattaaaatcctacaaatatcatcgtacgcaaagcaatttccatatgaagccatagccacattatcttttctttatccatgtcaatcggttacttttgtattaaatcctcactttttttttctattcacacatgcaagtctaataaattaataatccacaccctgaaaatcatatataagaacccatcccttccctttcattctacctttccctcatttctccctgtaactcctctctcatgtcccacggcatcaccacctctcccctctctagtggcgattcttttcccctctctttcatcaacaaggccaccaaggagactagatcggagacagtgagggtggatatcaagacggcagggtgtggattgagggggcaaaggtgtaaatcggggtgccacagcgtggatcagggtggtgacgatggatctgcccaatgtggtggaaggagcggtcgaatagtaggtggcagtgtagatagaggcagcgatggcaggcagagcttcgaggcgacgtcttcccgcaatggagcatctcaccatcgtcctcaatgaaccgtcaggtaggccctttttgacctcatttgtgatggcgacgcgtagaagtttgtttgcagcaacggcacgggccgacggcatggggcgaggccgcttcctaacgcgtttcctcgcatgattctcgcctaccagcagaggcgtggctatgctgaggacacatggacctcctgcatggttcgcacacctctgtagggtgcagtttctttatagttggcgtgaatatttgtctcggatggggtaagacaacatgccagctaggaacgtttggcattgccttaggccatgtacaatgcatggtctccgacttgtggttccatcctccaactaggctaagatgccacagtggaggttcgagagtgtcttcatttgttctagaataacctatagatgtcacagtggtttgaggagaaaagcagtggttttgggagaaaaagaagtggtccaagcccctgatcggaagccatctgagaaagtgcaagagagagtgcacctcgtctcactgttaaggggactcccaccatcgccatcagcgactgcaaagctcgccgactgcgccggagtggggataggagaggtgggggcgtcaccatccaccagatgcgcggcgaacacctgggatcccatcacggtgaccaaggagggaaccttaatccgcgccaataacagtgaccgaaggagaggcggcagggagggagctcgatcgtcgtggcggcggagagggagctcgatcgtcacggaggcggggagggagcttgttgtcctcaacaagcagaggccggatccgacgaccttgcgtctagatccagtggtgaaggggagcttgccatcgtgctcccaccatgtcccttctcccccagtggcagacgatgctgcggttgatgggaaaggtagagatgcggagatggatgacgaaggcgtgggcatcggcggaggcagcaaacatcatcaaaggtgagggcaagaaaaggggataggtgtaggaaggagataagagagagattgtggggagggataaaaaatatatgatgggagaagatgacagtgggaccgtgtaaaggctaagggtacctacgtactctttttgttattagaagatccaaaatacaaatgttgataataaaatatattagaagtactgacacgtaaataagtagggactgaaacacaaatatactttacagtgctttccatagtgagtgttgtgatatttgtgtagttctatcctatatgacttgttgagactgctgataacagtggtcttcgttgtatgaatacataggagtacattacttttaatcttttttagttatacatatgtttttttgaaagatacgaaaatatacgtgtaccgtgatgtggaggcgcgcaaccggttcactggtgctgcgtggacgtgcgggaccgatggtcctgcggcttggccgcatggcaccgcgcggtggcgcggtccggtcgcgcgccaccgggtacacgaaggcagcgcacgcaggcatgcatacatgcatgcacgttagtcacatactcacattagtcggctgcactcggtggggcacggccaggccgcggtgttttcctagccgttggtcccacgcgtccacgctgcgccacataatttcgtaaatcttttaaaaagacatgtataaatgcaaaaaattaaaaatagtgtatatttttttcctttgtcgtacatacccatggggtgggggttatttagttggtgaagatgtagtcgcccgcggccggtgccagggatcaccccgccgcagggcagcactatcatgttttagtggggaaagcgacggtgtcgattgtaatttttgtacccgcatatatatatagaacaactcggcaagattagttcttttagaaataatatttttttaataaataaattgtaaaaatagatgttgattggctaaaatcgtaaatttaataccctgtcgagcaaccgcagtttgacatctatattaaaatctccacgtaaatcatttttttacctcctattagctctcacttagattcaagtatccaaataatagtatggcataactgtgtaaggacaaattaatgacttataactgatgatatgcaaatatgctatattatatattcaaattagttcatttaagattccaaaatatataaaatcaccatttaaaacaatattaaggataatatggatagtattgtaaagtttagggactggatgtccggtttgaaagtcttggatgctagacggatttccattcaaagtttagggagggggtacttggacttttttataaggccccatttagttcccaaaaagtttttcccaaaaacatcacatcgaagttttagatatatacatggaacattaaatatagatgaaaaaaactaattacacagttatgatggaaatcgcgagacgaatcttttgagcataattagtctatgattagtcataagtgctacagtaacacacatgtgctaataacggattaattaggctccaaagattcatcttgcggtttccaggcgagctatgaaattaattttttcattcgtgtccaaaaaccccttctgacttccgatcaaacgtccgctgtgacatcaagaaattttcatttcgcgaactaaacagggcctaaattgtaatcgttaaaatgatcaaaagaaaatttattttcctccaacttagtactcctttcgtcctaaaatataacaacttatagcatttaaaatttaacccaaaatataataacttcttcatccacgttgtattcttaaccaatcacaatcattgaacttcattttttttccacatacctccacttttcaaccaatcacacacctcctatcttattctactcaccttttaataatcgtgtttaatcctaaaacttttatattttaagacagagttagtaacattttgttaaaattatgggacatgcttatattttaaaatggatatttccttgataagaaaaacacttctagagttaaatgtgaatacgacgatttttttttttacggagtaccgacttgtaaaagaatcttggagaagacaaaactttttatctatcataaaaccattgtacccgaagaatcctgtccagtggagcccacccgacgaaatcagatctcctaaaccaacaaaaagaaaagaaaaaggaaaaacaaaattccttgtctctatcaggcttgaccgcgactcccccacgaaccggtggcgcctcctttcctcgccgcctcgtgggccagctcccaggggggcattcccgtcatttcacctcggccggcgtggcgggaattggcgcgaaagctggcctcacccccggagacgacgagacacgtcgggcgtttcccgcccaatccacacaccgcgccggaggtgggccccactacccgacgcccaggatcgcgccacgtggcgcgccgacgcgaccgaggcgcggggcccataaacccggggaaggcgcgagagtgggggagcgggtgcggtgcggaaacgtggcgaggttgccgctttgtcagctgtcgtctcctcgcttcgcttctcctgtttgcgttgtttttcttctcgtcgcagccgatgcgatgcgatgcgagctgtgacactgacacatgcacacaccgctgcctgtggccatgttcacttgatctggctctggctgctgcaagtactcggcttgtggaataataacctcttctgttcttcacgttctgacttttcttcgcacgttcttaaaacacaataattcgagacgtaatactgctagtgattagtaaagaaaacaaaatccacttgttcgaaagaaagctacggaagcgtggaagactgttgctcctcataggagattcatccaggagacgggacaaaagtagtagtaaatccggacatccattttccctcatcagattaaaaatcaccaaccacattaacaaacccccgttgctgtcaccggtcgtgactcgtgagacgaccagggtgtgtaattaacagctaatcacccgcatcagcagccactagtcacacccgattctttcactccaactgcggctgtgagcgctgacatggtctgaccactgcgcaccacgtgagacgagagacaacgccacaccaccatttaattactcctcccccactccactcccaacaaaagcaaaaaaaaaaaagaaagaaaaaataaatatctgccacgcaattacactgttccgtttccacgcgggagacgtgccattcaaggcagctcacgcacaaagcgagcgcccgccttgggccccacgccaccaccatttactactactgctcacttcactagggagtacaaactccgctgggtttttttttactgccacgaaataataataataaaattaatataatactagtagtaataacattgctgctggttgctgctgatgcgccgtctcccgccaacttttcccgccccgagagcgcgaaatgggtggaggggggcagcggcgtcatttcacgctgacggcgttgctcgccgtcagccccgccgtcacgaagtcctccccttcccaccacggcagccagtcgaactccgccgccttggtggaaggcggcggcgccgagaggtcgcccagctcgacgaggaggtgctcgaaggatggcgcggtcacctcgtccgctgccgcgtaccggagcacggaggtcggcgacgcgaacgggttgaacgagctgtcgttggcgcggtcctcctccggtggcgccggcgtcggatcggggacggaggccttggcggcggcggcggtggaagagcttggggtcttgtccggggtggtgtgtcggcgagggtggagcttcatctgcttggccttggcggagggggtgtcggagtcggaggggaagttggtgacggcgtgggagcccttgatgcggagcgcggcgtcgtcgtacacggcggcggcctcctcggcggtgtcgaaggtgccgagccacagccgcttctgcaggctcgggtcgcggatctccgccgagaacctgccccacggccgccgccgcacgccgcggaaccgccggctcgccgccatccccgcgcgccgccgggccagcgccgccgtcgccgtcggaaccagccgcctcgggtgcttcggcgccggcgccggcgaggcggccccgacgtcgatgtcgatgacctcccggacgcgcggcctggagcgctcgtccccggaggagtcggtgtccgtggcgtcggcgtccacgaagtagacgcggacacgcttgggccgaggcatgctagccccaacacggcggctcctgccggcggcgagggagtccgccggagacatcgccggaggacgcatatccaccgcccgctacgaggacgtcaccccaaatctcatccaagaaaacgcacgaaccaacccagcaaacaaactcacccgaattggaggtaaaacccaaacaaacaagacctcaaatttctccttcaaacttcccaaatcaacttcaaaaaaacacaaaagaaaatcccaaagatttctcagatctaagcactcccccagtgagtgaactatcactaccaccactagctcaccgctcactctccaagaaccgggtcaaacaagcaaaggcacccggaaaatcccaaacccccaaaacctcaaaaccagagagatccaagaactcctcaaccgaggcaaaagaaaacacgaaaccctccgtcgatctcaggataatccggggggttttaagaggggttttagctttgaggttaagggcgggaaagggagaggagggggatttgttggctgtgggaggagaaaggggtaagacgaggtggaggatatatttatggcacaggtggataccactaccactgtagtaccactgttcttgatcttatcacgcttggggaaattactgttttgcccacctgctaggtccagctggaccgcgctgagagtgaaaccgagtgcaggggacagtgtgggcttcggttcatgtgttcagtggaagtttacttctttgcccctccctgtctggttcatttattgttttttttttatttcccaaaagaaacgtgtgtggttttgaatttgaagttgcttgaattcaacttgatgatgtattgatgttcataaccatgatccttcatggtgtaataataaaatccacttcaatcaaggtgtacttgttagtactcctgtttaaaagacatgatcacggggaagtttcacatgtgctcgagggattttccgtgtgcttcacctcgttttttgatggcttgttcacatacaatggcttgaaacttttgtgttaggtaagtgactggattggcatgattggtgagtttacaataaaataattaagtgacagttgtttctttttttaaatactatcaatatcgtaggctgaaccggtaaatataattaacgaataggtgaaaaagttatatgtgtacagcaagtcaataatttcacgagtaaaatggccattagtgcaaccagaggcacaagaggcacaagacccaaatgtacttctactaagaccctgtttctttcagcttggtattattataatctagattattaagccagattactataagctatattgttataatctgtagtagaataagcgactagttgtttttttttctaaattattatagcctagattattgggtttgcaagtctaaagagtgagtggggtggcatggtgggtaatttttcaccaataatctggaaaaagcttacctaaatgagcttatcagattataataagctgggctccagattataataagctacttcaataagttgtgtgtttctttcagcttactcccaataatctggattataataatcccaagctgaaagaaacagggcctaaataattactccatttttcagttcttgatataacgtttgacttttcgtcttatttaaaaattttctatgattagtatttttattgttattagataattagataataaaatatgaatagtattttatgtgttactaattttttaaaaaaaaattatataagacggatggtgaaacgttggacataaaaaactaaaaatgaagtcagacggagggagtaactatcatcaaatataaattctttaagccccatcgttttgcttatccttatacttatccgcaccacttattagcaaattaaaaaaagagtagttttgtagcaaactgaaacatatgtcgctattgttgtagcaaaccgatagttttgtcactaaaattgtagttttctaaaaattactaaaaaaattgtaagtaaaactttcatacgtctccttagtggtataatagcaaatgttgtaaaataaacatgatgaaaaatcacaaaattaactttaaaatttacatttaaaatgtaaattttagcttataagtataagcataagcgaaataatgatggcctttctgactataatggtgaactgtcctcatataaaacttattttattttgttttcaaaacaagtataaacgcagaagctcatctgcacgtgtgcacacactgaaccttatgaaagcacaccctgtaaatttatagctatgaaagaggacataactgagaaaatattattcgctttgatttcaaacaaccaccatcgctgtctaatttttttaactttgaccataattaaattttaaattattatatcattatgtatgaaagttttcaggactggaatgcgacctatttcgttgacatgaaatatttttcagtatttatatattctcttcaataaaaaaaattcgagcagacaatggtcgaagacaaatgggagtcctatctaggagtagcaacaagtatttaaagacggacataccagtgagttaccacagagtatagtgctgccgttctaaacacaacaatatatgtgcactcaaacatgaaaaagaaaattaaaaaaaattgatatgtgcaacataatgccatgtaccatcattaaataaaatcaactcaaaattaaatttacatatatacaaagaaacacagattaatttcaggctcgaagcggtgcacaacacacaccacatattcatcccaaaggaaaaaaaacagcacatattactgttaataaaaacacatttttttttatttttaccagctacgttcaaaaatacttcatctctggttattcacctcacaagtgcttgtccatgtgcatattcatagaaatccttttagaaaaattggtaatatatcaataagttgtaacacgtcatataatggcatagttccaattttccctatccgtttcatgtatactaactttgggacaattatctatttgaccctactttgaagcttaactaccaatttgacatcgtttttcccagtttgcttatttgacctcgtttttcaaaattgaagttaccgtttcaccctgtttccaaaaaccgtcagggttccatttagaacaaattaaaaaaaataaatttacaagcctaaataactaaaatgcccttatttactcatttcttatgctctgtatcctctctcaccagagcacaaatggctggaggtgcgacggtcatcgcggctgcagctgcggcggctacgttggctccacggcggcggcacgatgaggaggaccgccagcggcagcggcggctgcagaggggcgacgagggctggcagaccatcggcagtggttgtgtcagctcggggggcagctgggctcgacggcagcggcgcgacgaggaggaccaccggcagcacgacggctacagaggggcgaggcgacgagggcaggaggaccaccggcggcggcgaccgcggcgacacgcggtgggagcagcggcggaggcgataaaccacggtgggagcgcgacggcagtgcgtagtgggaacagaggcggcctcggcgatggtggggagcgggagagacggcgtgagcggcgaaggggttgacccgcggtgggagcggcggcgacggcgtcggcgtgcggtttgagcagggacggccgtggcgacggcgggagctttggaggcgccgacccgcgatgggagcggcggtgacagcgccggcgcacggtgggagcatgggcggtcgtgtcggcgcacggcagtgaccgcgtggagcatggtgtgggagctcgttggcgcgcggaggccagatggttgccgacagcggtacatgcgagggcgggcggcggcgcgggagcttgtcggcccgaggaggctgggcggcggcacgagagctcgccagcgtgtggagggcagagcttggcggctcgggagcacgccggcgcgtgaaaaaaaaaatgttgaataaacaattttagaaactagggtcaaatgagcaagggtataaacgtctattttctccctgaagttaacactgttagcttgcccttcacataatacggttagatccgaccttcattttttaaaataagggtcaaatgagcaaacttgaaaaattagggttaaattggtagttacactccaaatcaggggcaaatacgcagcaaatacgcaattaccctaactaactttttatttttcatgtttgagtgcacttgatgtatatcggtgtagtagcacgcgcgtgagattctcaccgtcagacatgacgcacctcgactttggggctgttcaaattgatgacagtttcaaccataccattatttggtaaaattgataattatgtggttatatttagtttgttactaattattggcaatacatatagaattttggcaacactattgaactaatcctaccaaaattttgacaatgttattaatttgccaaaattttggcattactaaattttggtagcgttcattttggcacaaactgaacaaaccctttattttaagagcaagggttttgtcgaatgtttatttaaatcaagattgttcttaaggggtgtttagatcccaccccaaaattgtacgctatgtcacatcgaacgtttgaacacctgcatgaaatattaaatataggctaaaaaataactaattgcacaaattgtgactaatttgcgagacgaatcttttaagcctaatagctccatgatttgataatatggtgctacagtaaatatttgctaatgatggattaattatgcttaataaattcgtctcgcgatttactggcagattctgtaatcagtttttttattagtgcctgaacaccctatgcgacaccctatataataaccgatgtgacacgccaaaactttacacccctggctctaaacaccccctaaatgcaactagtgcatgtgcattcatgcataaatatcacccgtaccacaggcgaagccgacaatgaaactcgccaatatcatagggtgctaatgccaccatctcaaaataagcaaacttttatatattatcagattcatacataaaaactagttaaaatcaatccacaaatcttatcgattttggatcactaaatgtgctttacgatccgtgctctagacccttctcctctatatctgatgacctcatcttcttctccagtgtcagtaacgtcccaaactctcacggaggaacagattaagatcctaagttggaataggggtgaaaggggatgggaggaggaggagttcaccagctttaaaggatgaccatgagagacgctgtacgatggtggacgcgcggcagaacgggccggtagttagacggcgacatcactgttgaagttgtaggggtcgatggtggatgttgggatggtgtttgcgacggggataaagtggggcgaaaaggttaggagacaatgacccatggtggcgaatttggtagcggggagtcatcggagacgaaaacgatgagatgcgggtatatcgcgggcgtcagctcgaggaggatgagaggtggggaatgagaagaaaggagagggaaagggaggccttaccggcacggcttgcacctttccggcgttggcgaggaggagaagggatcacgaaaacggtgttgcatagtcggtggtgttatgcaagggaagtgtgacacacgctacaaatctcaagacaacttcaacagttaaaaattatataatttaaattaggattttctgtcatgtcatataggtactcatagtataaagtgaacatcgtgatgaactggatcgagaaattaggaattctgaaagaacgaaaacattttcggataatcgagatcgttaattcgttatccactagaggggacgtacgtgcatgtaaacgtggaagcgcactaggcccgtcgtacaggagaagcacggaagctacggaagctggagcagtgcattaacacgctccaattacttctcgtgtgggtactaattaaatacggatcagtactccaatattaatagggatcgatcaaagatcacacggcacgtacgcgcgtaccctgcactgcatctgtaccgtctggcttgggatgccctcgatccatgcatccatcgatcgatcgggtccggccggtccggactgcctgcttgtacctgcacaggatatatgagcagtgactgtaactgtattggctacaaatgacctggccggtttcattaaccctcccatcacatgtgaatcagtaagtgcgtattaattgtgcagtagtaaaatcgaactgtactgttagaagcctaaaaaaaagcttgattttaaatcatcttaactacattttcggcacatgtcctgaatgcatatatattatattgatatatatcatgttaagatgtactggtacgtgctttcaagcctaattaacaatgatacgataaaaacaggtgtaagacctctttacctactccctccatacctaggaaagcttataattaatattataagaatttgctggttggtaacccgtttttataatctaaagaagtttgattttttagttttctttaagtttattttctgtattctacaactataagtgtttatattaatacttaatttccattccgaattacttacatagaaccattatatcaatttttaagatgaaatatggagttgtgataaattatggagctgcccctattaattacaacattagtacgcctttgagctggaggagtggattacaataaaaaagcagatgcattgataaggcgcagagagagaagatattagccaaatgttttgaaacatgggaatgagaggtattttgaaaaaaaaaaggaatgtaatttgagaccgacggagtagcatttcacaattcctttttactaatttcacatatatgtattcatttgggctaaaaaaaattaataatttgccactagttcacatcaccataattttttgggcaaacacgattaattctcatggtggagttataggcatataactctattcatcaggattgaaatcctaatatctaaaaataaattgcgtgtatttttagttggtgcacgtattgaaagtgatactccatatatatatatatatatatatatatatctatttatttgcacggtcttcaataatatattttgacaattaatttatttcatgttatatccccacaaatatgaaattaccatcacatgaaagtaatttaaaatataaatctaatgatataataagtataatactgttagtatgattattagttaaaagttattgagtttataatttaggacggaaggagtattgtcattattaataaaaaaccgaaaaaaagattgaggacacaaagcactaggatagccagcaggtcggccatgtttgagaggactctcgcggtgcatgttttcatggattgggggattagagacggtctgttatagcaagtataataggggctgaagagccggcgataacaaattcaaaggctgagttggcaaaaagctgatgagagagaggaccagccggcgactaagagcaaggataataataaagcccactttttactattagcctatcttaaagtcaacatatataatagattagctataaggttggctataattttcttctcctctctctatctctcacttacacatttaatgcatttgtcttgaagcttgtgataagctaactcttgcataagagccaacatccttaatttttcactacctctctcctccacctaagcttatagtacgtttatagctcactattatacttgctcttcttgctctaagagcaaggataatagtagagcttacttcctactattagcccattttaaagccaacatatataatggattagctataaggttggctataattttctcctcccctctctatctctcacctatacatttaatgtatttacccaggagtttgtgttaagctaactcttgcatgagagccaacattcttgatttttttgttatctctctcctccacataagcttatatagtaggcttatagctcactattatacttgctctaattaagcgctagcgtcacactctccaaaaaactctccaaaataaaatgtgggacccgttgcatgctttctacaccatacagaatgaagatgtgatgtagaatgagagagaagatagaataaataaataatagactattgcaactaaaaaaagatggatagactacttgttgtatgtattaactttttaccatggctatagcagacgtggaaattactggagtaagcagcgagcgcttctattaaccttgctcttagatcaggtacaatagcaggctataagccagctgcaaacatattttaataagataaaagatgagagagaagagcagcgggctacaaatctgtagccagctgcagcacggactccaagacgcaatgtgtgtatgacagtgggaccatatgctaatagtatagtaagcaactattgtataaattggctattaaattggctatagatgaattagagttagtagttggctatactattaaccttgctcttagcatcagtatagaagcccactgtttccacagatcgctgctcgacaaagttactgctattagcactagtatatagaacagagtaggggtgacatcttttaaaaaggaaaaaaaagggcacaatttgccactggatatatgtaattagttggaagacaaaaaaaaaaaagtgacactgccaatggacattataaaattttataatttgtgtaattagctgtagtacacccgagacaatattttatcatttccggtaaaaaagaggagagagaaatttcaaaaggacagaaatgccctcggcctcattaacatgtactcgaagctgagccccacggcaccgtcgccgccgccgcaggccgcggtctgcaggttcaaggccatggcgatgttgtcgcccctgccgtagctgctaggctgagcacgtagaagaagcaacaaaggccgacagtgaccaccatggcgagcgggctccgggtcctgttctccaccgacccgtcgccatggatccacctcaaacctgcacacacatcaacaagaaaccaatcaacggcaacaaatcgatcaaatgcaatgcacaaatcacaatggcgatggacgccgtcgtgacgagttgctcgttgccgttggaacttggaacgccggatccatctgttgaggtggaggcggacgccgccgtgacgagttgcccgccgccgcgataggtggtcgacttcctgctggttttgtgccgacttggcgcgtcctcctccgcatggcgccccgtaggtgagtgcagaacgatgcccaacaacaacagctagcagcagcaacgccgtgaagccggagatggcaccgaggccgacgatgccctacgaccaccaccacccgctgctgcagccgctctgcaatgccgccggcgccgccacggcgtagtgctcggccaagtccgcgccaccgacaccgcagccgcactagcagctgcccgccgccgccgcgcacctgtctgccacggtgcacctgtccgtcacgctgtgcgtatggtggccgccgcgcctcgccgtcgccgacggtgagaccctggcggagcgccgccgctttttccgccgcgcgccgagccgtcccgactcgggccgtcgcgccggccgcgcaccgtttctccgctccgccgcgtgcgtgaggaagaagaggataggagagagatgtggaccccactatgattagcaaatagtaatcaccctactaattacgaataaattaatccatgacgcgtgggcccaggtggttaaaaacctattaaaaattagattaaacatacactgtccatgacacgtggaacccaccgaagtttaaagaaggaaagagaaggggcaatctggtcatttagataaatatctcactcttttgacccgaaaataataaaataatgatacttgtgttctacggctaattacatttttttagtcttcatcagccgtgtcacgttttcgcggtctctcagtcaattacacgatttttgcatgccgtgtggtaaattttgccaaaaaaaaaaaaactacagaaacagaagctttggtagccttgacaggagaatagaagaaactactactactccaaaagagctattgttcggacaagtgcaccattaggtggcttatattattattattattatgctttccatttcaaattactaatagagtatcattatagcaattttctgataaaatatgaaggaaaaagataaaatatggagttctgataaatcactgagctacccctattaattacaatagtattacgccgtgtttagttccaaaggattttttcaaacttcgaacttttccattacatcaaaactttcctacacacataaactttcaactttatcgttacatcgttccaattttaaccaaacttccaattttagtgtgaactaaacacaaccttagtaccactttgggatgaaggtgggggtggagtattgatgaggggcaaagcataaaatatgctttgaaatgtgagagtgatatatatttttaataaaaatttgaatgctaatgacaaataatttgagacgaatgaaatagcatttcatagttttttattactaattttcacatatatgtgttcattcgggctaaaaaaaacttacaacttccttcattttaaaatacattgttttaatctcctattaggttattatatttttagtgcggatggagtacatattaatttgctactagctcacatcagtagaaaaaaaatatttgggaggaacacaattaaacatggtggcagccatggacgtatatacggagtagctctttccatacgggtaaagttcctaatatacaaaaaaaactagtatatgtgtatttttagttggtgcaaatatcaaaagtaatactcattacagtattaattaaactaagggtgcgttcgatccatggaaaatgagtgagatagcacatctttttccgcgcgcacgcttcccaaactactaaacggtgcgttttttgcaaaaattttctataggaaagttgctttaaaaaatcatattaatccatttttgcaatttaaaatagttaatactcaattaatcatatgctaatggctcacctcgttttacgtattttcccaatcttctcaatcccctattcctcaaactcaccctaagagaatgtgttggaagtttatgcacaaagtactaggacagccagcaggttggcgatgtttgagggaaagacagccaactgcgctgccacagtgccactctcgcagtgcatgttttcttggattgggggattagacacggtccgttaacatcagtatacaactagaagcccgctgtttccacagattgctgctcgacaaagtcactgcaattagcactagtacacaaaacagagtatgagtaacatcttttaaaaaaggaaaaaagagctacacaaacagatgctttggtagccttgacacgagagaatagaaggaaccactcctattccaaaatccctgctctcgatctcccaaagcaaaatcaccgatcgatcaggatcaaaacgtacgtacgtacggtctcgatctcccccctttctttttttttttgctcagctctcgacccaaacctttctgcttttcttttcccccttctctcctctctttgtgatgctgatgatgcatactgctacggtccaagacgtcctttggccgtctgcctgtctgtgttcaaaagaacgaaaaagcacgagcctgcctggctgcctgcccggcgtccgtcctggggcgccgtatgtcacgctctgcggcgcagtaccagtgcggtgcatgcatggcacggcacgcgacgaccaacgctacgctgcgcagcggctcgatcgccgagcgagcgagaccgtgattggaatcaccacccaaccgcgtgccgctgcccgctgcggctgctgccccccctactactcctagcccttgatgtccgaagaggatttggattggattggaccggtcgtcgccccaggggtggggggcccacgcctcgcactctcgctgacctggcctaaccgaatcgctgtgccgacgtcacccgtgctgctgctctgctctgctggggtgtgagggtagatgggtcatttcgccgcggtgggacccgtgggacgtgggaccacctgggcccctcttgctaccaggtttgcgcccacgagacttttctgttgttttctttctcgcgtactctgtcccatgaaaaccattcattgttagaggttatttgggagctagtgactaaataacatcggatattttgacactaatttaaagtattaaatatagattaactataaaacccattccataatcttggactaattcgtgagacgaatctattgagcctaattaatccatgatttgataatatagtgctacagtaaacatttgctaattatggattaattatgcttaaaaattcgtctcgtggattagttctcatttatgaaattagtttttttattagtctatatttaatactccaaattagtttctgcacatccgatatgacatgtactaaaaagttttagccccatctaaacacctccttagtattaaacgtggatatatcctaatagtacaaatatagatgttttttaattaaatttatagtactagcatattcaatatctaatactagatttttttttcttatgaagggtgtacggggttacggtcaatctttcacatatttcacgaggggttacaatgttgggaatttgactctcagattataataagaaagcagctacaatgctaggccatgttttcgttggttattgttgacggtcgttaacgatcagtttcgcccgtcaataataccaaaatagaggagaactagttatggttgcaatgcatatccatgttagaataataatattccactagtatttggatcactaaccttttgcagagaataaccataaaatggagaggaatcggcatcaaaccagacgataaatcaatcggacgatgtcgaggatcagacttatgtatgaatgagccaagaactcagaaatgacatgaccaattaggctaaaattcacaagcctgcagagaggagaagtctaggaggacgctagccgaaaatgggctggattggactagtccatggtttggccgaaccagggggttcggccgaacccccatctgctccgttggacatagggtttggcgtggacgtctaggattgctccccaatgacggttagagggcatttccgaccattccaactgccatgatcgtcattgggaggctataaaaggacttcacttcctcactcttttcacacacctcaaacaagagttctctcatattctctcaagttagtttagtgttctcaagctagtggaataggaatagagtagaaatcggagtccggaagccttcggaagagtttgggtatggctctagtagctcttctcttctcttttgtaagctttgtactttttattagaatactcttctttatacatttatggtattggaatactttccgagtatatgaatgccaactttaccctatgttcatgttatactgagtatactgctagcttatctgggagatgatttggtacgggtatagtgtttgattatgcaattactctatgtcatgatgatgatattagagtagtatctggtagtttaggagtggtttctagattacgggatatcattatttagggttatatgctgcggatgagaggtgggccgctgatggtgacagatcagtaagggtattccttcgcgcgtgtatatagtcctaagttaatttccaggggagggtactcctccgtatttagccccggttgtatggtcatgatgggctgtcgtaaggaactcgacagtcaggggtggcttctcgaagtaccaggagggcatcggatagagggtattagctagtatgtcagataactaggatgtatgtatactatgtatactagaagtatatgaatagatcctctttctctttttctttccacttggcttagatattttagtatgagaacgagtagcttcctgcttgtgtgtcactctacctttggatttatcttaacccctgcttagactatgattattacaagtaacatataaataattagtcaggttctctctactatgatctttccacaggattaaataaatacgatacccttggaatactctcgggtgaaatgctacaatagtatatccgtgcgcttgcggatgaactctgtaaccaaaatataccaggagtatttctgcgccattactaggaattatatttctggtaatgtcgttaagaaataccaacagttatcatttttaaccttaaacaatactttcatttcatattatgaaacaatttaacttctttctaatcaaagttatttaagcttggttaagtttttagaaaaatagccacatttaaaacacaagattacatttattaaatctaaaattaattttgttttgatagtatgtttgttttctcttaaaaatgttgctatgtttttttatcaatttaatcaaacttgtgtcaaaccgtcttaatataaaatggagggagtattaacatataataaaatttggtagttccatgcacctctatttgtaaaattagttaaaaaaacaactagcttattcccacgctccaaaataccaataagtagtaaaacatatccctagttaaaatccaatcacaaattccaagctggatgctttttacctctcaaccaaacaaacattttgcatcggtaaacttacaccattatggtcttatcttatgttatgttaatccaatcaataagggggaaaaaatgatggctagtccacatgtcatgcacttctctcattttctttctccgcataaattaattcaaattgcaagatccacgcaaagctactcaagttcttttaagatcattctttgttcatgcatctcttcctgtccccgactatttaagatcctattggggagcttttgagagctgatgtcgctatcagaatctctttcttgtctatatatatttatatttaagattctctctcaagatattactcactccatctcagaatatagtaacttgggattggattgaaagttttgtagcagtacgaatctaggattgtacaaatccttatatagatttatagtactagatgtgttcaatttagtcttgggttaaaatttttaaacagaggtactaagatttggtagctagaaaatacagaaaataaactgtggctataagtttgaatgcttaacagttagctggcataagtccattttacacctgatcacagctcttgcctttgtctaaaatttactcttcaactctaaaatcaggcatctaacacctctaactattaaaaccgttccatttatcccccagaccaaactaaagtggtttttcatgggcgtgcttacgtggtgtctacatgtcaatcttagtcagcataactattaaaagtaataatggcctcacatgttaagggacatctctctccctatcttttctctcatccactggtccccccctcccccgcttcttgctagccttcagcggcaatgaccgccaccaacgtccgcatctatctcctggacctacctctaacaacgagcacctcttggccataaaatcggtgttggcgagctcaaactctgcctctccaagagcctcttccatgcactggcggcctcgagctttgactaaccgcctcctcctcaatgtgccggtgagctcgagatcaacctcctccccactctcccacccctctgtatcaaggtccaacttagccactacgtctgttgagcttgctgccctggtcttggtgacgggtcgcttaaacaggaggaggtggcagtggagaaggagctatgacaatgcatcgaagggaaaaagcagtgtcgcctgactgcgtaggtgcagcatggggaaggaggtgaaacaagctgctgcggcaagcattgatgcaacctacactatcctccatttctaggagaagatggtcagctgcaaaggtagaggagacggggaggaggtagccaacaacggaggagatggtcggcatcaagatccaatgccagcttgcccaacattatcgtaagccggagtggaacgagctcaccggccaataggtgagatataaattgaagaggagacgatgcgcagagtcacctccatcgagctcatcatggaccctcatgtcaggggcagcaggacagagaggggggagggagatgagaggaacaagaagatatggtggcaatgataggtgtgacccctctctctcctcgctgaggtggactattgtgtacatgtgcattgatatcctacgtggcatccaatattgtataataccactacatagattttttttccaaacgagaacccctataggttgctggtggaccataatcgctctcgcctgcaaaaattgttttcagggggaggttaaggggcttcttaagactctttaagagatccgtctacgaaaatatacttattttcctaggcgagactcttaaacagctgtgtgcgaaaatgtattttcgcaaacaggcctattaaaggcccacctacaagtctaacttcctcttcctcttagcacttcaaaaattttcaaagtcatcatccttataatctcctcatcttctctctcacctcctctcctcctcatattatctctcactcctctctctctctctcagtctctctctctctctctctcatttctcacctcctctctctcgcacgagttctcctcccgagtggcagcgacgggtggctggctagtggcgggctcgagcgggaccgggaagcagcgggcttagcggtgatgacggcaactgcggcaccaggatgggctgatccgcgcggccgctaccattggggtgaggaggggcagtggtggagatgcatggaggggcgacagcagcctcggcgacgatgacggcgatggactgcggactgcggcgacgacgtcattgacggatgggagtttgctagggttttgagttttgattcttttttctttggaatttttattttttcggatatttatttttgcatgtgtatgacataagcacccgcatgcgaaaatctgatttttgcatgcgatgcgccacctgcatggaaaaacaactatttttgcagacacttttgggcagacggatggctcaaccgcatgcaaaatttggttttggccacatgcaaaaatacttgttgcagtagtgaaaccgcttcacaagagttcagaggcgtaaaatggaccttttacctatcaattactacttaaaatctcccgttaagaccttatttttgggagcttataacaactatacctataattttgggagcttataacaactatacctatagactctagttcctatgctgtcaaattcttacttaagattctgagacacactaattataaaatcaagaaataagtatattagtcattaaggcctccatacgacggtccttatcgcttcgcctcaaaagctctagcgaaaggcgatatctcaggggaaaaaaaatcttcgactcccagccccttttcttccttctccaatggccatacggttgtcagcatgggattaggggagggtctggctcctttattcactagtagagataggtttagatttagtcgggtctctctcgttctcgggttctacctgttctttgtgtagctcaagagggtcgccgacattcgactcttcttgtctcagcttgatagacatggcagacctcgtcggtgttcttgtcgttgtcgtcttcctgctcggtgaatcctaagctcatctcaaacgctttcagttgggagttttgctattttgcttttgggttgaaggattgttctctagcccgtcgaacagaaggagtgcaccggctttttgctccatcttcggtgtgtcccgcacctatggtggtcatctccaacatcagttctgtaaaaggcggccgatgatttctcctatgggctaaggtgtcttcaacctctgttgagaggccccatttgggtatgctttttggctctacccattgcagttaaccattgttcttttgctccttccgtcgccgtgcgtgaggatctgatcatcattgatgtagtcgttgcaaggacctgattgcttttttctatattttcgcgtatgttacgtttgaagtgtaatttgctcatcactcatgggcttttatacaaaactagttgttctttcagccttaccccattggggaatgtaactcatgtactttgtccttaattataaaacacatgagttttaaaaatacatacattagtcagatgcattctgtcatggtataaggcatacctcctatcctacgacttatggaatgtacgagactggcataccatcgttcatatgatatatttccgtatgtggtaaggaagtatacaagatattatgggaagtatcctcatgggctggtgattaacagagtcccactcgggaggattgggttgattctatatcatgcgggattcattgtctctgagttatatttggagactaaggcaactcttgatataaaaggcacactccctaaggggttcagatcatcgaatcatagcaccaacacactcaccatagtttacgaagccggaggatgtaaagccaaattcgccgggagatcttgtcgact

SEQ ID NO: 70086 - DNA, 2088 bp, Oryza sativa
tcaggatatatggattgtgaattacttacttaataatagggattacttgcctatactataatatgttcatttgtatgaatgggataaaatccaaagaagtcagttcggatccgtttgtgaaagagtagaaaaagaaagatagtgaatcttgtttgaaccattaatgaaaaatagaggttggtaaaatagttagaaagtaaaatggctttttattggggatagagggacttgacttgaaccctcacaatttataaagtcgacggattttcctcttactataaatttcattgttgtcggtattgacatgtagaatgggactctctctttaattctcgtccgattaatccgtttttcaaaagatctaaagaatgaatgatttgattactcaatattcgattcttctttcaccttcgattggaatggattcacaataattctgaattttatcctaatttattatttcataatcattcataatttatttatatatttatataatccagatgttgatacaattcattttttttagtacttcagttgattttgctttgtttatcccagttttaatttggattttgtgtgaaaatgaaaaaaaagaaaaaaaaggagtctttatgtctcgttaccgaggacctcgtttcgaaaaaatacgccgtttgggagctttaccgggactaactagtaaaagacctagatcctgaagtatctttaaaaaccaattgcgttctgggaaaagatcgcaatatcgtattcgtctagaagaaaaacggaaatttcgttttcatgatggtctgacagaacgacaattacttagatatgtacatattgctggaaaagcaaaagggtcaacaggtcgggtttgactacaactacttgaaatgcgtttggataacatcctttttcgattgggtatggcttcgaccattcccggagccaggcaattagttaaccatagatagacatattttatttcacggtcgtctagtcgatatactaagttttcgttgcaaactccgagatattattactatgaaggataaccaaagatcaaaacgctgattcaaaattctattgcatcatccgcccacgaggaattgccaaaacatttgactagtgactcattccaatataaaggactagtaaataaaataatatttagtaaatggtgaaaataaatgagttcttagtcgtagaatattattctcgtcagacttgaacctaacgaaaataagaaaggttcataaaattatttccccttttcgcggaagggccttaatccgtattttctcattcatgtatcacaaatggatctacagtaggatttttttttattgccgtaccaaagtaattaatttttaataatgaatttctatcaaataaaagtcttattgctgaaatctatttgatttgatacattgtggtcggtggtgaattaacagaaacggaaagagagggattcgaaccctcggtaaacaaaagcctacatagcagttccaatgctacgccttgaaccgctcggccatctctcctacataatcttattattgaccagaaactgagtgaatagcgagttttcgtatccctgcaagtacaggtacaaccacaaccgctcgggggttccatggttctaaaggaataattcctttcccatttccatggatacgagcgggactattacttactatttcatctaagctatttcatctaagtggaagaatcctggatttatttttactaggaattccgctaactcgaaaagttttagtttggtttttctccctcgagaaaaagaatggaagaattcttcttattccataataaccctagaattctgtttgcataacgtacgctacgccatacaatcgaaatagaaaatagggtaatgggacaattaatgactttgaaaacgcgaaatagctgatgagagaagttgttgttgagaaataagaaagtggaatgaaatccaatctgattcaaatattgaatatctctccttgtccaagcagaaggaaaagggacaatttgagcagaaagcccatatctattatctatttttagaatcgaattagtctggtttttgctatttcg

SEQ ID NO: 70087 - DNA, 684 bp, Oryza sativa
attcttcctagtatggaagaagtaaataaaaagtactgcgtctcgatctatacgaaagggcactggttttttctttcggtttcattgatagcagaagagtacgctagctagcggagcctgaaaacgcttgcttgcgccccaccccgtaagctgactctattgcctatgcttgctgctcgctcagtgtcagtagaagggaagaaaagatggtcacttcttttaggaacacggcgagccttacttacgactgttgcacttcactcgcagctcgttcattcacttgctcatgaactcgctgcttcgccagaagcgactagtcgcctcctttcctccgccgaaagatgcttagccagaagcgacgaaggaggggagctggggaaggccgacgatggcaatgagggggaagctgtcgtagaagctttgccccttgctttacagaaattgttatgaacttactaaatgaccttatttattctcccggaacgctagcaaatctaatagttcccatctgctcttcttaacttaagaacgaaggtccttcttattcaggaaccctttgtttgaggggggcgtatccccggggaggggagagtggccgagcggtcaaaagcgacagactgtaaatctgttgaaggttttctacgtaggttcgaatcctgcctctcccacttgttgtagacttaa

SEQ ID NO: 70088 - DNA, 690 bp, Oryza sativa
  unsure (1)..(690): unsure at all n locations
atctttccccttcttgatgagcgcactacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgcagctaaatcgataggaataggatttatcaaaggaaagggcgggtggacatacgttgcgggtgtccagttggcatgggtctgggttccgctcatcaactcgaacggtcaatgctggccagatacctgcatcgttatacgtcacaagttggggtggttgaacaggaaaaacaacaacgctttccttttatggcactgctcaatccgaataccagctactatacccttttcaaaatactagctttttcccttttgccttcccctcacgggtaagatattttatattccctggactagtacgcgtacgctatttatattccttgcgcaagagctattnctatcctttcagccaaagctttctgtcggaaaacaggtacgaatcactagaataccctacctcatttaccaacaaagagagaaaaga

SEQ ID NO: 70089 - DNA, 10275 bp, Oryza sativa
taaaagtaaagccttttatttggatttttgagatactagttatttataggttaagttcgatatttcactccgtgggccggctaattaatgaaagtaattcctggaggggaatcaatcgaagagattgcctgcccatgctacaattacttactctttaggactagagtgctaagctgcctccccggcaccaccactataatgaatggctcaaacaaataggagatgagaaagtcgagtagcagcactgatgggaacattttttgaaactagaatggttgatagtcaaataggagactcgcgttgtaggtaaggcttttcaaaagcctcgacttggctaacgccctttggttttgaggatcaatttgcccgtgcttgctggtgtcagggttgcagataagttgtttcggtgccatttcctttgttatgaatgaaaggcattttggagatttgctcagttgataccgaatttgaagataagcccttccctctcgtgaacaccttcgtttagtagatcggtacggttccattcagaagaaactattatacgtggtcccgtggagtacgaataaggcttgaaagttttccttcatattgtttgctagcttccttctccttgtttcctgcctttcattctttatgaaattcttattgattttctttgctgactgacgttacaccaagaatttatttaatagcgtatatatagcctgggcatcgataccagccttccgttcgcatgatattaagaaagtgcctactactcaatttcgcattggcaaatccttccacttgctatctaatgtagtatataaagcctttcttttctatttcttctattggctggtctgggggaagcggatcacgcgaagatctatagtgtttaagtccatctttctcttcctgcaagctactgagatatgcctcagctgcaggtgctttgtatctttggtcaagagttggcaagggataccaatgttgtcgaccacctacctttgagcatagcttttaccatattcctccctcgattcgccattcattccttcacagctgagtcaatagctgtgtcaactgaatgtagttcttttttaaagaacgaggccgctaaggtcaagggacctgatccagaacattgaatccaaccatcagcattcgcaagaaagagaaagaactcggttcaaagaatcgcttcggtctaaaaacgagtcttccaagatcatgtctatgtgaagagcttgaaccaagcgttcacacgcatacgccctctgaagattggaaagaatccatcagcgagaaaatcaaatcgtattctatagaatatggtagtggtaattatataactgctttgaggaggaagagggaaattgtcaataactgtttgcaagatccacgtatattaaaagaatatataaataaatatgtgcaaacgcactatgaaatccgttatagatattatagtcctaattggaataatatgtgcttattccacaataatatcgaattcaatcaaccaattgtgaggtttcattataattatataagggatatgctttctttaaggagtctctctcctatgaaatttggtgaactctctatgcgaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttataccgttgtatggttcaggtatataccagttagcggtatagaagcgttacccgttgatctgtttccagaagattatcatgtctttctcaatgagagggcaaatgtgactgattatagtaaggtagttttcgtggaaacgaaggatcttactccagtagtgctgtctgcctttcaaaatgattatccatttaatgaaatgtttggtcctataccggaaacagagagtcctcataaaagaaaatggttactatccatgggtttaggtataatgatcactttccgcttatcggtaggtgtgctacctgacataaacgaaattctactaaattgaaaaaatgaagatgaaaccaaatactatgataggattgattggattaaatagataggaatgattggattgaatagaacaactatgaaacataatagttgattgaatagaatgttggtctcacaagtcggtacggtgtgcatatccatccttggaagaagtagctccgtcccagtctttgtcggaacttgaatcgaggtaggcaaaagaatccttactcggaacgagcccaagataaaaggtctagtccaattttagtcttggttgtacatcggtactacgcacggtaggcatttcttcccgttatcgggacttgcacttgcccggccttagtggtattttaatgattttcttccccagcaaatcaagtaaatagaagtaataattcaagtccctccgtggatttgaacatacttcgcttcgtggagccgaggattagatcgatctgaactttcatttcttccattcgcagtaatcgttggttttgtccaattccttcaatcatcactgttttgttctgtaattccatttcattttatctattttcttcaagaaattccattgatgtgcttttctattgctctcattcattcctattcaatctattcaaaactacgggtactggtctcaatgggaaagagccctaattcgatatgtcgtttctagagtatcagcaagtggtaagcggattacaagcaagcggcgaaggtttgaattgactagcttgatccctactattaacaaggaagaagtaagcaagcaagaaagaaagtaagttcagtctcttatttcgaagttcgctgtgctcttgttcaatagacattctgctggaactcacctttatctttagagatgatgatgaatattctttagagactcctctaaaataaaagaaatactttacaagaaaataaaaattatgtttatacggacggaattcggtctatcctttattgaatatcattgggcctgcctcctatctatcaactcattactctcctttgttctctggtaagctctcgcattgccttaaaacaagcattctttcgtattcaaagaaggtttgcttgcatgttctagcactggaagagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaaccttttggagttacctagtagcattggaaaccttatgttccttcgataccttggcttctttgatttagtgattaagctacctctacctatatgtttgcttcaacaacgttctagcttgcgtattctgatcacacaatggaattcaggtggaccagggtttgggacactaatctttaaattatagatgcattataacatgtcaagggaggcgccgagatatgatatgaccaaaggccttgttgttgttgcgagccgggctcgaactgacgaggagagtggagaggaatacagtagtagtagtcgggccaggggcttatcttattccttgtattcattggtctgtataggggtcacatatagttggtgtgctttgtgaactgcgatcttgacggtgagactgataggaaaatgtctgaaaaatggggagaagccgagtaggataggactcgaaagccgagctattaattgaatcatgcttttgattgaacgacaaaacatcgatctgttaaagtcgataattctgattcgtcttcggggtatgccgtaaagatagccgagaccgaggataggtgccgatctgttttacgggcagtaagtaccgttgttcgaaaggaaaggttggcattgcctaaaccaaggataggtttgaccctaggattgggattttagaaaaaaagggatagcgctcgtcttttctctactctagcgtatggactcgtcccaggattgccggagctagcgttaggtgagattcctttgattgaatttagcttgccatcatgatacgctgcagttagattaggaaccgtataggcggcctcatatacccggaagctttggattcacggatccgaaacaagacatattcactgctactgatatccctccctttgctttgaagccgaagataacgataggatttccggaaccgaaactattattaattataattagattgcgaactcaggagggcttagtaccagctacaactatcaaatccgttaaggagcagatcaattggcttagccgaaaccgtgcccttatcttttctttgcattagccgaggacaatactagggatgcgggaagttccgagaataggattcgattccccgatcttctaattgagttggatcggcctagtccagagggagaggagcaatcaacgctaattcgtattgcgataaatcgtagtcatattattattattggcgtacgtaatttctttactacgtctatcgctcgtaggaatatctctaaataggaatcgtagtcctcgtatgtacatgtttcgtattgtgataaagcacctatgccgctagaaatagtagcgccttaaagaaggcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtctttcctgccttaccttaaccccgctttcacgtggcgattcggtatgtgatctgtttacggtattcttgaagctttctttcttggtcaccggacagagtgagaactgctctgctttctttccctagcacacacttagtagatagtaggcacaactccgctaagagctcatcgaacttgagttctagagtaagaccacagctcgatatggctcattcactagtatggtttaccacatgccagtgatagatctctctcaagcgaggtttggtatcggtgaagtcaatcattgaattgaagtggtagagtgcatagcggggcataaggccccatgtatttcttatcagtgtgtttataccttgaattcaattgatgctgttctagcttgttttaaacaagttatagagtttgttttggttccaggtggtcatcccaactcgtattagctatcgaaaagccgtacttacttgagtttcccgctttccataacgaatcccccgctgaaagcaccacagggagtgtaaccggaggaggatgttgtcttttctcactcacccagtagtcgagggtgtattattacccgtttcactgacatctgccttcccttctctggagcagttatgtagataggagtggtaggaatcagcgagcatgttgccattcgaggtagtccaaccttcctattaattagaattctgggtaaccctatcgttgattgacggatcggagggactaaactgttccctttccttcccagggctaggttatctatttcctgttcgtgctgcgccatcagattaatcgtatcgtgatcctggtatcgctcgagcatctctttctgatgaaacctttgcccttgctttctccactacacctggtaacgcacagtgcttctttcttcgatctatccaagggaggcttattgctttaagcagagtatccagttctgcatccgttaatgatttctgaacatagagaaaagaattgatagctaaagtttgcttttagtagtttagtcaccaatcaaaaaagtagctaggctgaagccgaagcacattccctagcgtactagcgtacgagagaagcacattccctagcgtacgagatatgccttttaggaaagagatcccttttatgagcaatggtttttgataatgctaacccctgttcaaagcaaaggtcgaagctggccaccctttactcggcatccgttctcatatgcatagatgctccgagaagcttcttttagttagccaagcgggtcatgtggatgggtcaagagatgcgtaaacgtgcccaacaaggggtaggtgtggtaaaagggtatgcgggttgatgtgtccttcaccttgctagtaagagtggtatccttattggcagcaataccccatttcagtttctggatttgcggaatgatttgaacccctattttaaaaaccaatctatttggcccggtacggttttccttcaataccactcctacgatagaggctgatatgactacgagcgagatatgactattcctatccttaagcgaatgctggaacgaaagtaaggtcttccctcgaagtgaaatgaaagcaaagggtattgcaaatcaactaattgttctctaataccacctcctcctgtatctactattggttgactgaaaataaaccaaaagcaagggtggttgcacatcttctgaaaagataagggctcggtatcggctcaatcgaacaagctgaggtatatagggaatagtagaacatattgattatcctattggattggttccgctcagtcgagatatgatgagtcaatgggcattgagagtttcgattcaatgtgggaatgactaagacaagttaggcgaaacagatatgcaccatagaggtttatccaccgtaggtttgtagacaagaatagtagtcacagcgagggatgcacataaataagatctgcactggtataagtgataggttttgggtaagctcgctcatatcgaaagaagaattcgaaggaaatgaagcataagctgtcaccactaggataaatcaaattgaatcctaggctgtttcgatagacaaaagaaaatagaaaaaagtagtgagtgagaaagaaataagtagcggcgctttgcttgcttggaaacgaagtagcagatttttgagtagtcttttcttggctggtaactattcaaacagagctagccctctttcttgatacctatgtactgtccacatatagtactgtttcgtgaaaaaccaataggcattctacacagagaacaattcaaagctgactaccatatactactgtccctgctttacctgctgtccaagtaagtactaatttcgaatgcgaggttgcgtagcaaagctacaagccgaaagtcaagaatgaactgagttaactagctggtagcactgtcctacttgtctattcgttccaactattctatttgtttgcttgctggaacaagggaatatagggctgctgagctgtccaagtagaagtagctttcctactagttgttccaactaaccaacaagcaccggattgagcgcactagcgcgaaagcgttagcacgcgcatccgttttcttgctccactcataagtccaatctggtaaatcaagaaatgaagaggtattggtatatcaatgaacacactccatagagtttctgctcaaatcagagtgttggaaattaagaaacagtttcatcccgccttccactcatccccgcatttcgctcaaagctgctctctcatttcttcgcccttaggaaggtctctactgcaactgagtttgaaagcttttactcatcaaatatttttggcaagtaaagtaggtatcaatctgcttgaaagcctgcagagtccaattttgagtattttcagttagaatctagagtcagcctattcagttcttagcccttaagggtaaggcagggggtaatatggatagtctctgtccctgtattcacattccaccttcaacaaagtgttgatttcccgtaaagctaactgtagtcctttaagtaagtagatatcttaggcaagttagcaatctcgttatattaccaaggccttcccttctattgtagaaagagttctcagccatctaattgcagtgccagttgccagctatccagtttcatttgaagttgctgggggtccaaacgagctagttgcttttattcgtcctataagtccttccacaagcgagtcaatagggtgctggctagttgtagttgttggcgtgcctttcctttcatcttgaatattaataaatatttggataaattactttagaataagaagttcatgttttatagactagtaagataactaactagttaagtaatacgaatccatactaggaaaatgaaaatgtgagtcctaggcactggaattggttctcttctccctaatccctataagccagaaagggtaataggcttcagtgtaagcatttccttcaagcaagtcatctcaagttttaaattctagagaatagctccgatcaacccattttagtttggttctgcaattcattcgcataaatgaaaaaaaaagcgagatgtgcacgaaagaagatcatagttcagctttaaaatggtggtgtccctgtgttagtaagtggttgaaatagctcatgggagtgtctgccccattcgataatggcatttatgatctagtggagtgagtgattgtgtggtgttcagtctaaggctttttgaaaagcggatttctcccttctctcatccatcgtctttgttaaagtatggaattctcacccagagctgcggaactcacgactctattagaaagtagaatgaccaacttttacacgaattttcaagtggatgagatcggtcgagtggtctcagttggagatgggattgcacgtgtttatggattgaacgagattcaagctggagaaatggtggaatttgccagcggtgtgaaaggaatagccttgaatcttgagaatgagaatgtaggtattgttgtctttggtagtgataccgctattaaagaaggagatcttgtcaagcgcactggatctattgtggatgttcctgcgggaaaggccatgttaggccgtgtggtcgacgccttgggagtacctattgatggaaaaggggctctaagcgatcacgaacgaagacgtgtcgaagtgaaagccccagggattattgaacgtaaatctgtgcacgaacccatgcaaacaggcttaaaagcagtggatagcctggttcctataggccgtggtcaacgagaacttataatcggggacagacaaactggaaaaacagcaatagctatcgatactatattaaaccaaaagcaaatgaactcaaggggcacaaatgagagtgagacattgtattgtgtctatgttgcgattggacaaaaacgctcgactgtggcacaattagttcaaattctttcagaagcgaatgctttggaatattccattcttgtagcagccaccgcttcggatcctgctcctctgcaatttctggccccatattcagggtgtgccatgggggaatatttccgcgataatggaatgcacgcattaattatatatgatgatctaagtaaacaggcggtggcatatcgacaaatgtcattattgttacgccgaccaccaggccgtgaggctttcccaggggatgttttctatttacattcccgtctcttagaaagagccgctaaacgatcggaccagacaggtgcaggtagcttgactgcgttacccgtgattgaaacacaagctggagacgtatcggcctatatccccaccaatgtgatctccattacagatggacaaatctgtttggaaacagagctcttttatcgcggaattagacctgctattaacgttggcttatccgtcagtcgcgtcgggtctgccgctcagttgaaagctatgaaacaagtctgcggtagttcaaaactggaattggcacaatatcgcgaagtggccgccttcgctcaatttgggtcagaccttgatgctgcgactcaggcattactcaatagaggtgcaaggcttacagaagtgcccaaacaaccacaatatgaaccacttccaattgaaaaacaaattgttgtgatttatgctgctgtcaacggcttctgtgatcgaatgccactagacagaatttctcaatatgaaaaagccattctaagtactattaatccagaattactaaaatccttcaacgaaaaagggggattaactaacgaaagaaagattgaacctgatgcttctttaaaacaaactgcgaaggagattaattagatagacctttttatttttcgtcgttcgatcacgaaaacagggattctggaacggccaaaaatcccagcggttgttcgggtcgaaaaaccgagaa

SEQ ID NO: 70090 - DNA, 26292 bp, Oryza sativa
  unsure (1)..(26292): unsure at all n locations
agagcctagtcctcaacctcttcttccccaaaaggtagttatgaacgtgccaaacttattggatttattcttggaatgctcataaccacctttactctttttttcattctttactcagaggaagccatgccgtttggagaagagcaccaagtggggggagtgtggagtccccgaaagaggagctttctaaaggcaagagaaaagctccgatggagcccttggagctacagggaccaccaacccttcgcagcttggacgatttgattcttgtgccactcagccctgaggagggcgcctgctcgacccagtcaggtactactccgccgccggccccgagtaactctgcgggggtcggtgcagccctttcttctattccggagtgcataaacaaggatcctcaaaaagcgaaatcatttcgttaatggcatttcagaaatgagtcataggcgcctgtacaatgacagaatagagagtcctttttttccagaatgaatcattctattcaaatctcacaagttctctttacgcgtcttctaggggcattgttgaacgcaatctgcaggaacaagaaatgattctttcttattttgaaacagaattcaaaataaaggaggatttaattcggttgctttatgaaggccgacgccgtgccgatagatacgttatacacgaaacgaaaatagccagtacggtggacgcgttcctttccaaaaagggattatcaggagctcccagtgccgagggggtagttcaactcaagaaggagcggtactttctggaaaatcccgggaggaatggagctcctttgtatagggaactcgaagaactcttctaagggggccccaagccgaaaaaaagcaaatctctttcgtgattttgtaggtgtaggtatatagtgaagtgataccgaggccctctccacaacctagtagttgatgggtatggggaggggagagaagagtgggtatgagggcttctctcgccatccatagccccctttctttaaaatgcaaagtggacgttcccgcacgaatctccggaattcggattcctgatattgatcactagaatcaagctttttatgaggctctctgcccgctatgtaaaataacctgactctgagtagttacatactactctatataacatagaaaaagcaggctacccataacgggagaaccaaatcctcattgaattggatttatcaattcgaaggggggtcgtacaaggtcagcagtaccccctgtgaatccaccacctgtatgataagttcttaatgttagttgagtgccaggctcttcaatagattgaaccgcaataatacctacggcttcccccaattcggggggggccaatctttgtttaaggatgttggataggtgattcatcaatgatgccgattgggaatctaaggagggggctccgccctagtaccgctatatatccatcttctgatagtgggtggttttcgtacgcgtagcgccttgctaccaagtgccagtagtgtaggagatccctgcaataagagttgtgagtgaaatcggttgcttgttgctagcgggaaggaaggaaaggtcagattaccaaaaaagccagctgcatgtatactcgtaggaaagacaagatcagatagaaccgatagaaagtaagaagggtaagcaatcctctgattctatttttatagtcgtccgtcattcgatcgatagtgcaagcctaaaagtcagctatttaaatagtcaggtattgaaatagcatggtattaaaagggtaccgaacttctatactataatagtaccgaaggccttttcttgtctcaccggatatgaaatgcaaccttctactaaaagtatgggggataatatattttatctaattagtaccctaaggatactcttttttctgcacgaacgatatagaagtactatctatgtatttggttacctatgacctattaccaacttaactatgttggtctttcccattgaatgtcagtcttgaaacattgccttgtatattcagaacagtaatgaaatgtctctgaatctggtatccaaacgttgtaagtcgtacccggttatacgtatcacccaacaacacgtcaaggatggtatctcttgaataggcgtatgaaagatttcttgcttctttcgaggaaccggacactggcgcttgggtaaggcgttctcgcagcaaaatccttcgtgaggtctatctactgggcttgagtttgaggtctacatcgtaggtagggtcttctaaaaaccacatgaaccttcactcttctgtctgaggagggcaaatataggtataaagcctgggcgagtgtctttgtccagcgcgagaaagctcggaattgaatgctttgaatgcgcaaaatgaatgctttggaacagttggtactttcagatcggaagatgctctttgactttcgcctctattgttcatacttatttatgtgctgccagtcgtactcctgttaaaaatccaatttttgatacaagataagaaacgcttcgtgcctcgcatttgacgggcggagttcaatggatgctatttctcctgagcttaatctcggaagtgagttagcgaataataaattatttccattcttccagatcattctttcttttcccacgactccgtgttggttttgcagtagaatgagctgcagactcccagtgttatttcaaccttaagttccatcgacttaagcgtaagcgccccacctctcttttgagagtgcgagagatttccgcggcctgtaaacacatggtttttccagccgtgaccctaatttacttactgattttaaaacctacctccggccgcccattggttaggatcgccctttggttggtggaagcgagaatcatcttttgatttttttaagtttcccgaaaaaactgaaaaagcttatattatatatagtatctggcatgcctaaaagagatagctggcttaaaacacgacagaagtaggacgcactgaggccgagctttactgcttgagtaattgtctttccagtagagctttcccttgttaagtagagaattactgtccttcactcatattttgagaaacagtacgcagcacgtatggaaaagtcagcctaggcagtcaaccttttcttgacttcacgagtttcaaacctgtctgttagaggggagccaacactctctaactacctatactacgcccctattgattggaaaccctcggggatcccataaacaaaggaattatacagtacgaaatagcaaaaaacagactaattcgattctaaaaaatagataatagatatgggctttctgctcaaattgtctccttttccttctgcttggacaaggagagatattcaatatttgaatcagattggatttcattccactttcctatttctcaacaacaacttctctcatcagctatttcgcgttttcaaagtcattaattgtcccattaccctattttctatttcgattgtatggcgtagcgtacgttatgcaaacagaattctagggttattatggaataagaagaattcttccattctttttctcgagggagaaaaaccaaactaaaacttttcgagttagcggaattcctagtaaaaataaatccaggattcttccacttagatgaaatagcttagatgaaatagtaagtaatagtcccgctcgtatccatggaaatgggaaaggaattattcctttagaaccatggaacccccgagcggttgtggttgtacctgtacttgcagggatacgaaaactcgctattcactcagtttctggtcaataataagattatgtaggagagatggccgagcggttcaaggcgtagcattggaactgctatgtaggcttttgtttaccgagggttcgaatccctctctttccgttctgttaatcaccaccgaccacaatgtatcaaatcaaatagatttcagcaataagacttttatttgatagaaattcattattaaaaattaattactttggtacggcaataaaaaaaaatcctactgtagatccatttgtgatacatgaatgagaaaatacggattaaggcccttccgcgaaaaggggaaataattttatgaacctttcttattttcgttaggttcaagtctgacgagaataatattctacgactaagaactcatttattttcaccatttactaaatattattttatttactagtcctttatattggaatgagtcactagtcaaatgttttggcaattcctcgtgggcggatgatgcaatagaattttgaatcagcgttttgatctttggttatccttcatagtaataatatctcggagtttgcaacgaaaacttagtatatcgactagacgaccgtgaaataaaatatgtctatctatggttaactaattgcctggctccgggaatggtcgaagccatacccaatcgaaaaaggatgttatccaaacgcatttcaagtagttgtagtcaaacccgacctgttgacccttttgctttttcagcaatatgtacatatctaagtaattgtcgttctgtcagaccatcatgaaaacgaaatttccgtttttcttctagacgaatacgatattgcgatcttttccagaacgcaattggtttttaaagatacttcaggatctaggtcttttactagttagtccggtanaagctcccaaacggcgtattttttcgaaacgaggtcctcggtaacgagacataaagactccttttttttcttttttttcattttcacacaaaatccaaattaaaactgggataaacaaagcaaaatcaactgaagtactaaaaaaaatgaattgtatcaacatctggattatataaatatataaataaattatgaatgattatgaaataataaattaggataaaattcagaattattgtgaatccattccaatcgaaggtgaaagaagaatcgaatattgagtaatcaaatcattcattctttagatcttttgaaaaacggattaatcggacgagaataaagagagagtcccattctacatgtcaataccgacaacaatgaaatttatagtaagaggaaaatccgtcgactttataaattgtgagggttcaagtcaagtccctctatccccaataaaaagcccattttacttcctaactattgtaccaacctctatttttcattaatggttcaaacaagattcactatctttctttttctactctttcacaaacggatccgaactgacttctttggattttatcccattcatacaaatgaacatattatagtataggcaagtaatccctattattaagtaagtaattcacaatccatatatcctgacatttactaagtccaattttagaatactttttgattttttagtccctttaattgacatagatacaagtactctactaggatgatgcacaataaatggtcannnnnnnnnnnnnnnnnnnnnnnnnnnnnnnnnnnnnnnnnnnnaccagttcaaatctggttcctggcacagaaaaaaggatctaccgaataggtattgatacaaattactcgagatggattgggatacatattcgttaaaaatatagctagagtatgatttattcatctaagtagagaaatctctaaatagagacacttctttttagagaagggtaaaaatctctggtccttttctttatggtacaaaaggaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtatttttctgtttatatgaaggaaatgaatatgtgattttccaaattggagaatcgaaatgaagcccttttttgctcagtctatctggacccttttgtataataggaattaattccaatataataggtattctgtttctagacgaaacagaacgtcaaaatattccttgacttgaataaaatcaggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcataagattcgcgttctttcttgaaaatcggcacttctccaaatccagaagacagatgggattctaggattatccttttgggcaaagacttttatgcatacttcttctgggttatctataccatactgtattctcgtaagatgatacacgctagctaaagatccaccgggtgcgacgtcataagcacattgggaacgtaaataattgtaaccatatacatataaaatgacagcaatggaatcccaatcctctgcttttatttgtaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttctgcataaagagcccctcctaattcactaatttgtaggaagatactggacttttggattttcaaaaagttgaagaagatatgtctaaagtagatggtgattgatagagcaattcttgctcgtaagttccagtatgagtactgcgccgaacataaagcttgtgactggtagtaaaacatcgatttctcttttgagatagagttcgatcctcaactatttctcgcgatatcttcttatgaagttttgttagggcatctataaccgcctccggtttaggtgggcagcccggcaagtagacatccacaggaattaacttatcgactccccgaacagtactataggaatccgtactgaacattccccctgtaatagtacaagctcccatagcaatgacgtattttggttcaggcatttgctcatataatctcactaaagaaggagccattttcattgttaccgtaccggctgttaaaattaggtccgcttgcctaggacttgatcttggtttggtaccaatccataacgatcaaagtcgaatcgcgagcctgaagcaaattcaatgaaacaacaaccatatagaaggggccataaacaggagagtcttgaccaattcgaaagatcatttggtgtagttgaaataacggaattggaagttgttcggtcaagtataggaaattaatataagaatgaataactttctcaatggtttattttctttcttttatttatcttaatattcattccattcaggccattccaatgctcgcaagcaagcacgaaaaagcttatatttctaaacggaaacgcccaatacatcgaaactcattacccatggccagtcgagaaaaaaaaataaaacaaacatggtttagcgtattcggaattgtaaccaagcatcctgggttctataccagattcaacactagagcatgcagccgatcctggatacagaactatataaagtgtgcagtgagggatctttattggtagccagtctttcacttccgcctctccactcccatgcctttcttggtcggaccaacccaaccggcgatttccgacaagtctttctgcttagagcaagaagcggaaccaaaatcaagctttctttattttcatttatggataaccaatccattttccaatatagttgggagattttacccaagaaatgggtacataaaatgaaaagatcggaacatgggaatagatcttataccaatactgactacccatttccattgttgtgctttctaaaatggcatacctatacaagggttcaagtttcgatcgatatttgcggagtggatcatccctctcgaaaacgaagatttgaagttgtccataatttactgagtactcggtataactcacgcattcgtgtacaaacaagtgcagacgaagtaacacgaatatctccggtagtcagtccatttccatcagccggccggtgggagcgagaagtatgggatatgtctggtgtttcttccatcaatcatccggatttacgccgtatatcaacagattatggtttcgagggtcatccattacgaaaagactttcctctgagtggatatgtggaagtacgctatgatgatccagagaaacgtgtggtttctgaacccattgagatgacccaagaatttcgctatttcgattttgctagtccttgggaacagcgtagcgacggataattccgaatctacataactagtctagtccaggagacaaatcaataggaaatgctatttgcttcttaagaagaagaacttttttgaaatgaaagagtttccacgggcgtcggatatcatttcttcaaataaggaagaagtgttatcgaaggatttccttccattcttcctagtatggaagaagtaaagaaaaagtactgcgtctcgatctatacgaaagggcactggttttttctttcggtttcattgatagcagaagagtacgctagctagcggagcctgaaaacgcttgcttgcgccccaccccgtaagctgactctattgcctatgcttgctgctcgctcagtgtcagtagaagggaagaaaagatggtcacttcttttaggaacacggcgagccttacttacgactgttgcacttcactcgcagctcgttcattcacttgctcatgaactcgctgcttcgccagaagcgactagtcgcctcctttcctccgccgaaagatgcttagccagaagcgacgaaggaggggagctggggaaggccgacgatggcaatgagggggaagctgtcgtagaagctttgccccttgctttacagaaattgttatgaacttactaaatgaccttatttattctcccggaacgctagcaaatctaatagttcccatctgctcttcttaacttaagaacgaaggtccttcttattcaggaaccctttgtttgaggggggcgtatccccggggaggggagagtggccgagcggtcaaaagcgacagactgtaaatctgttgaaggttttctacgtaggttcgaatcctgcctctcccacttgttgtagacttaagagaagagaaagtaggcggaagcctaggagggccaaccgagcgaagctctttctttttttggccgtgccgtgaagtgcaattttctcgtatgcgttttagagaggttgtcgaaaaaagacgatctatagagattccccatctatatccaatcgagaatagaagcgagtcgcttccggcgtcggcttgtagtctctgcagtcggcacacgcacgcgcccgccatcatgcctccttggttcgggacgaagccaagcgaggcatacgatagacgaaggaagcgcccacccagcaggagggctaaaacctgtagttttgaagttgcaaactccagcttcgaagctggagtgctttagccctttagttttgaagcaagaatcaccgtcttgagcgccttgcgcgctcaagaacaagcgatgagcgctttgttgcgcctgtgcggatacgttttcttgctggggaaggctagtttgatcgaggattggggaggagaggtggaataaaaagctcgggatggattttggagtctttgtgcgagccgtatgcggtgagagtcgcacgtacggtaaggaggggggttcgcgtctatacgtgtagtgtggtggttgggcctacccaccctatttgttccatgatctatgggtctactggagctacccacttcgatcaattagccaagattttgaccggatacgaaatcactggtgctcaatctagtggtatttttatggggattctttttatcgctgtaggattcctattcaagattactgcagttccttttcgggcggctgtaggacggacggccccctataggtagtagggtaggatgggtggtaccgctcagatagcggccaatcctcctaactgcgcgcgggccgggcttagagcgcgtgaaactcatcactacctcgtaagggcgttgagaccatagcatgttacacaaaagcgccgctttctcaggagtgttgtcacacagctgcccgactagaagagctactcgctctgtagtgttgtcacacaagataagcacgccgcccgcctgctggccgggcgaatcgaagttatcttccggtcaactgtccacccagtcaagtgcaaaaaacacagtggaatcacgcaacgcacgctgctggtgtgcttcctgcccacgaggaaagaagagcgacaaggttcagatttgactgtttgcagcatgggagctgattacccaaaaaatccctgggaaaaagaaaagatatctcggtaacgaaaaccataggaggctgtattggcgagatccaagggttcccagcagcccaaaagaaaaaccgcctggaagtccgaggacctttagtaccgtaccgaaccagcagccttcgcgccaagcgacgaccgcccttgtccctttcctttttccattcagcctacttcttagctttgttccgtcagtctaaggcaaagcttaagtggttcgcctaccttacccacttgatgaaagggaacgaacttcgtttccttgacggttttatggatggattcagtcagcctcactccttccttttgaaaagtgacgctttgcgtcttcgcttccgagggttagggtataggccgtttcgagcaagctttcgctttttctcccggctttctacaactttcgctttagcttcgcgacccctttccggaatttgaagtattcgtcgccctaccctaagaaagaagtcactataaaacagcttgccctcctgaagtaccaaaggtgcgcggagcccggtgaaaatgaatatgtttgctactgaaagaagcctgcctattgactaatattcgtctttagaatgaaagtagctatgaagcccaatctactgtcgattcaaaagagggcatagtcgtatgggtggggtgtttgtggggagctgccttggatatgaggaattcctcaaatctaaaaaaaatagaacaaaggcaaagtccgtgacgaagatctttcttttctatcaatagatagaaatgagtgttcgttataggggataggatccatctgctctctctctattttctttgatgcaatttagagagaaagagcagtgcgaactagaaaaaaaaagataatcgggagatgattaaaaaatagatacatagacatctaaagtaaagggatgtatatattattcctatatatatcatctatctatgaaaaaagtaaacagagttcgtttttgggttccccgaagccccgaatggattggatcgtttctgcttctgccaacgaaatgaaggcctcgccccttccgaatgcttctccgatcctgaagttctcgcgaagagaataagatgcagctccccctccctctgtctttttccgctttgctaatcttcccctctaacgcgggccgggccgggcttaggcgggcgcgggaggaagaaagaaagtcgaagagcgtcttctcctttgtccttttttcagtgcaacacaggaaagcaccctctttttgtaatccctgcagcttcccagaggcttttttttgtattgaacgcatggcgtagctaggacccctccaatcatgtttgagcctatgttcacccggggcccaaaaaggagaattccggaatgcctgccgacgttcagataaagtgcatatcccttaccactaaaggaaaggctcgacgaagggggggggggattttccgggtaaggaaaacgctttcggagattgagatgtcgatttgtttttcatcgaaaaggaagaaggccgaggggatagctgccttccttcgggctttgcctgccgacgttctaataaagaattccggctcggcccgggaaagcgctggcaacaacataaagaaaggggtccatgtagctgctgcgcccgcccactgagcagcaggttcggcatctactacaaaagagagaatccacttcagataaccacgtctctgctaggcagcgtgtggaatggccgggagcggaccaaatggatatataatccaagccgagagtggagttacgtgaacagccgtctgatggaaaacaactttcatgttcggttcagagagcacttttttcgttgagaataagtccttcccttttgtgtgaattccccagcggcgaattaacaacttgtggggccctatctattcaatctctcgagccccaagaaaacccccctctccctcggactcaatctctcttttgactctatatatgtgggcacctgatatctatgagggttcacccaccccggtgacagcattcctttctattgcgcctaaaatctctatttctgcaaatatgtcacgtgtttctattgttgcttcctatgggggtacattacaacaaatcttctttttctgcagcattgcttctatgatcttaggagcactggccgccatggcccaaacgaaagtcaaaagacctctagctcatagttcgattggacatgtaggttatattcgtactggtttctcatgtggaaccatagaaggaattcaatcactactaattggtatatttatttatgcatcaatgacgatagatgcattcgccatagttccagcattacggcaaacccgtgtcaaatatatagcggatttgggcgctctagccaaaacgaatcctattttggctatgaccttctccattacaatgttctcatacgcaggaatacccccgttagccggcttttgtagcaaattctatttgttcttcgccgctttgggttgtggggcttacttcctagccccagtgggagtagtgactagcgttataggttgttgggcggccggaaggttgccatgagtaaggttgggagaccgaaggcagttttccgtgcaccggacacgtagcttaccgaatcagttgcaacacagatgggaatgcatgctacgaaagacagggtcgagtctgatacatcaaccgtcgactccatatccttgtacgagtccacaatcactacacgagatgaacctgggtttggtgaatggaagttggccttaggtgtaataggactcccagttactgcgcgcgatcgtatactgaggtgctccccgtcggttgttggaacgacgcgagccgggccgggccttgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggcccaaagcagtgctttgtttcctggccaaatcaaggatttggggctgattgcaaaagatatctgaatatcaagatagatccatccatctatccagatatctaaaaaagaatcgatttcgatttcataaaacctttgattcaaagaactgcgcttagcccccccgctcatgaaacggctctgctgcaatggatggcagagggtccgtagtacccgaagcactggagtgatccagtagccgggaaggggcctagaagtgcctactactacaccacactacacttggctctacacatttacagagcttacccctgtccagtgtctggcagaacgttgggggcttcaatcgtcgactcgttatccccatctcagcccaggctaacggagcctgacttattcaggggagagagtggagcctatcgaagcactcttgagagtaagatccttggctcctcttcattctctacaggggtctctgcccacatggaagcggggcagagatggataagatcaaacacgggaataagaagcattttaaatgcctttttgatcattttgatagagggggatggataaagtgggcaaaacagactcacattttgaaatcgaaaagacctttttcgtctcgacaaagaaagaatcatcttgaaaacgctcctaaccccttcgtagggccgtgtatagtaagtgatccgaacccgcccggagcgagccccccttagaggcaagtgaagttggtgagccgtatgatgggcaactatctcctgcggttcggagaggactcagctgttagttagtacccccttggtttcggggtggaccctttcactctattttattatatacgcttagtgaaaagaatgttttttgatagacctaggacatggattctatatgaaccaatggatcgtgacaagtcgttactactagcaatgacttcctctttcattacttcatcctttccatatccctctcccttgttcgatcttactcatcaaatggcactcagttcatatctgtaaattcgatcattgacaaggttcaaagaaagggtggactgcaggtaagcactaattaaaacctccgcatttccgtgattcaaaaacaagaagggcgtacaacgcccaggtaatatttctttgctttcggatatgcttttcaatatcttcacttgtgaaaatagaaacacttgcactttctcgcttggaaaagaaagactatcctcgaagtaaatcaatctatctcgtattgcccaatctggatgctaaaggctcgtcaccccgggaactcgcagcccatcacaactactcatactaggagcaatggccactaggaggactgaaacgaagacttctatacaacaggtaagaaaatacttcaacggaaagtcaatccctgccaaccgtaatgacttacttcttccgtgagcttcttcatgttcggtcggtagaaaaaggcttaagagctaaatagagaaagtaagtttgaagtctggcttgggctaggtaaagtagtcaaagtagcttgcttgggtttaagaagtagttgaccaatctttctagctccattgcgaaaccacgcccaaaaagcaagatgcgaaccaagaacattcacaatttgatcccatctttcttcacttgcttccttcctttctactaaactgaattttaccctatttcagtaccacttgataagcccggatctgtctgaccaataggagtgaaaggtatcaagagatgtcgtattaaattcgaaaaggcattcgaatctagccaaactaagttcgaaatcggagtacgtgcccagcccggatgaaggaagaagcaaacagggggattagtcacatcaattatcattcatgccttgctcaactagatcttgattgcctgtttcattgataccttgaggaagtacaggaatgcaagcaagcgaggccagaacaaggagagtcaagaaaacagtagccgtttactcacaagctaacacgaagcacgaaacacatggattctctgagaaccggactgacccaaccaagcaatcacttgagccattcacaatccatgataggagaacttctttcactttatatgattaaacaagtgagtcttccgattccgtaccctctggtgaagctgcatttacgcgagtcggagtatgctattccaagaacaatcacaaaagccgtgcttgtttatggggaaaagaaggataccgatgattgttcaccactgccgcctactccttcttgtctgtcaatcaagaattgacatagataaagagttgatagttgatgtgagtgatgcacaggggaaagcgctactatgctccattaatttcgtatgagttagttattggctggcagcctgtgctacaatgctcttgctagtgtgcttcagcgttgctatccatcttgtacaagggtatgaagcccgaccagaaggcacgggtgaatggagttgagtttggaggtctcctgaaaattgggtcgcacaactctacctgctggtttgagcacttttctcatgaataattatgatgcaactacttcagaacttgttctccctggtagaggacgtattgctgtgagcgccgacagtgttcatagggtgtttggtctaccgaatggtggtgatcctgtcccttatgagtttgattccactgcggatgcctttattgattctccgtacggacttacgggaaagcaggtaccaaccatacagggagccaactaaccacctattgtaccccatagaggcagcctaattaccacatttttgagagaagaaagaactgttgactgccgaacatatctatttgcattttgataccatcttccaccggctgcatcttgatctcttagacgtctatcttactcttgatttctgagtgcctatctcgattcttaaacaacctctcccgtccggtcgagtcaagcagcaggagcgagcccacaagagcttttactgtaccagttccgaatatgagaaggggctcgcggattttaacaggttaggcttaatctacccaattggaaatctcttgcagtagcttttactagaaatccatttcttccacaaagctcctgtgacctaaccatctagatagaagcctcgcagtttgcaaagaaatcaagcttctggcttcaagttcacaagtatgaaaagacctgagaggaaagagctgcgtagagagctccggattctttagcaactaggagagcgacagagcttcttttttgaaaaggctaaatccctttcttcaatcccaccttagttcgatggaatgcaactagatgaaattactacctttcttcattcaaggactaaatagcggttcatatggctttctttaggttgaccggaagggctctattgaacaaaagcacaaaaaaaggtcttattatttattcaaagaactgaacaatattgtttgaatccacctagttcttgcttactatctgaattaactgatgggacatctttcttggtcgtagtaaacctttgaaaaggtcctatccaaattttacattataaaaaaccctgtgctcataaaaagttatgtaaacccacatacatatacataatagtaaaggaataaaaaaaggataaaaggtactgtacgtaggcgctgctctattgccaagggtaaagagctcttttatatatagcgaagaccttccattttctacgtgaaagcgtaatctgtttcccgaaaagcggaagggtaaagaaaggcaggagctgcagaccatggtggtcaaccaagagtcgcaggagatttttatggccaataagctggaggcatgatcaaatcgataccaacattcaagagctgataagggtaaaaaagagaaacgaagactgtaagtcaaatgaccatcagtcttcgtttctcttagactgagtgtctctacctggggtgggtttaaccccctctaggaaaactagagccgagaccggttgctatctattctttcatgacgtgaatatgtgatagtatactttataccctaaatctggaatctaatctttcatgacgtgaatatgtgtggtgttagtggactgacagagtgagctctaaagctagaaaaaaaagatccatctgcgagtggttcgactttttcctaagcaaggacggagccgtcgagtgaggattggctgagcgtgctttcgctgctcgtggtggagtactctcagaattattcgctctattattgcctcaggatgtgatcgggattaagccgcgtgtcgatacccggggggggccggactcaagggattcattctttttcgcactaatggaggacatgaattctgggcaaattatctatgttacagtctattaaaaaaaggacttctaataagaaattcttctgctaaagaataggctcgcctataaatagaagcttcggcgcactctatattttgcgggacaagaaagaaagagtcaaagccatggatatcgctgcaagactatcagcgattcctcaagaaatcgctgatatagaaaacactaagctcgaactagagcaaatgctgggtgtcctcggggagcctttatttctggctttcgtcgatccagcagtgatcatacaagatgatatagttcttgttcagaaccaaatccgcattcttgaaaacaggaagaaggcgctgctggaagaacagcaatcgctcatcgtgatggctgcccaccacggtgactaaaatagaaaaaggtagttactcgtctatctcaacgtaaatgaacgaagtcacttaaggcttcctactactactgctccttcttacttattttcgttttttcaggatctaaagaagaagaggttttcttagcgggcgtgaatccggtagcttctacttctgttctgttgtctcacttatgaggagctggtacttcctgatcaagagtgtagtgagcataagtattgtcttgttcagtattttcttttcaggtgtggtgtgtagagatatctcatgtattgcctttatgaataatacttatgtattgcctcttcttcttgttgtagaaaaatactgatgtattgcaaagacctgttgttgttttatttctttatgtcccaaaatgacaaagacttgaaggtagtcagaaacaaagaactactaaaatgttggtagattttatagagcgtatagccaaactgggatctactcacaagggcgtgaaaacagtttacttttcgaatttctcacgattcgatctcttaatgaagtttttagccagtcatatggtcgagtacaccatcaaaccgctgatgaggaacaagaagctttaccagttagaaattttgaggaaaaaagggggaataagaaattggtgttccatctacgagattcatacactctactccctaatagtatagaaacattggctaagactttatgtccgcacttaggttcaaaaggctcaatagcacatgacgaagttcaagtgtcttctcttcaggagaatagagcccaattgttggattatatggagctggatatcagtcttttaggtgatgtgatgcttcgggctaaatcaatttattggactagatacaatgtggatatcggggtatgtttgacattgtcatcgctagctataaaaatatatcgaatgaagtattacgatcaaaatggggcctatctatattccaagtagtaaccaggatgcattcattcggcgtggttactatggaggccatgctgatacgtacaagccatatggtgataatctgtattattatgacgtcaactctttatatccctttgctatagaaaacatttcacaggctccaatccatttgtgatctttacaacagatatcgcaagcaagtaaaccggtggtcaaggcatttgggctgtggggatctgtcaaggctctctgagtacctgatggggatcgtcatcttcgtcccggtggcggtgctggcatggttcccatttgtctcggagttccagacgagattgctattcaatcaggccttcagccgagggcttcaaagctgttagagaatgcgctcttatcactacagggacgcgagagaaattcctcgaagggagtattaaagggatgcggcattccctcaaatagcagttttttttgtctaaagaaaagttgcctattaataagcagtcttccctctttcataaggctctaacttgcgtaaggaatcaaggagctacagttgtttcccgccccttttgtatttttctgaacacaagttcaccgcatcgcgcctcgtgcaccttcaatttcaccattggacccttctcaaatgccatctacatttatccccaatcctccttcatgattcgtctcctcaaccatctgtaggcagtcgatcgcctttacttgccttcgattcttctggaccgccggacaggtcagtcaacccttgagctgtactgaggggttggactggaaagcatactttatgtgattcctccttccccattgtcctctcctacccgcctttcccacatccatcaaagggatgctcgcttgtcaagctatgtgctttctttcctttcaaaactctatgtattcatttgctttcttaccaggcctacccaggaaaggggtatagatagaaggagggatcctccgaccataggtctattgaatcgaaaaaacactattttttatccagcagctgcttttattttctctacgaagagagtggctagctagcttctttgccaacttcgagtgactgtgactactcttactggccgtaactcacagaagaggcaggaagactttttactcaaaattgataagcgatcaaaccctttgttgtaaccttctcttgcacccttaggttctttttccaataatgctaaaaaccagtgaaattcacctcttcttgttgtttggttaaggatcgagtgtggactttcgtctttatcaacctgcggctaaggagaatcaagcaccatttagtggtttgttcttagaccgactcaagcgattgagagtaagaacaagaagctacgtacggctataaataaagataaaatcagtcttgggaaggaaatctcaggtttggccatgcccatttatgagcaataaatataagaaagagcatggagtgcatccaagggtgctacaaggctacaacacttcatcgccaccaccagagttcaaaaacaaagctggggaatgccattgattcagttcagtatcatggtttctttttttattgtattgaaaccattgaacagaaaatgggtagaaggattgcgggaagacagtgaaattcctattggcaggttggggccgggcaagatcgcagtttcctgatggattgccaaccacttaacgagaagtcccatgacgaagaatcacatttcactgtagagtgagtaagcgctgctatgaaggcagcaccggagggatgagataaagaggaaatagtgtatggtttgagtacaattaattcgtttcttacgcgtgttcctgtgtctgaatgacgcagtaaagccacacgaagtggctcgctattgcaagccgtagtcactaacaacaccgatttggagaggttgaccttccttggtaaaagagcttcattagtacctttaataatagcaatggcagcggcttcggatctaggaaaatgagggggggcatcatccgcatagagaagacatggcttaatgccctggagaggtgatctcagcagtcccgctgtgctaattctttcaagatcggattcaggtaaagtaagaaatccatcacaagaatgagcaagtacggggaaagcaggtcttccagccgtagacctcttactcttcttctggcttattaacttgtctttccgctttgtcactctcgtattctgaataggaatcggcaagcaggtacaaccaccctcgaaaaatcgaacttccctccttaccttacttaccttagtgtcttttacctaacctactcgctcgccgagctttttttatcttggttattggctttttgactcaagttagagcttttctttcctggctttttcactcgagttgtttaattgttcgcttggctttagctcatttttttgtccatttcttctctttacagatcccctcgaagtaggaagaagaatggcaatgaaaaataatagcaatagtcgtctcgtaggtgcaggtgctggtgaaagaatagcttatggggctggagtcaaaggagctttcatagacatagaaatcataatagaaagagcaggcctgcgagcagcgagtgccctttgtaagttgcgagcctgtcaaaccataggcgccttaccgccccccctttcttttttgaattagaaagaaggggacggggggatgaaagacaaagaaagagatcaggttatttatgatcggagaaaaggaaggggcgtggttgatgtgtcactggggaacccgtaggaaggggagacgcccggcctcattcacatctgaaatcgccaacatgaacacaaacgaaatcgtcgaatttcgtatagaaagaaaaggaaccacttctattctcttttcttaggtatatgaagaattgctttttggtccctttcgtccagtggttaggacatcgtcttttcatgtcgaagacacgggttcgattcccgtaagggataggtacttattcccggccggcggtatcattgctgagtgatcgctcgctatctggcttgaaaaggtggtccgggagctttcggagaaggccgaaaatacatttatcctttgaattactctggcattccatgtttatcatgttttctgcaccgagagaaaaaatcaatatgtccatagatttagatgatttgattaattgtttgcacaaagagtacacgtttaagtattcaaaaattgtgcataaaatcaagcaagaaaacggatgcgcgtgctaacgctttcgcgctagtgcgctcaatccgttgcttgtttgaggaattagtcaattctattaaaaatggtaattatgaaatgaaaaaaatagacgacttggttgatttgacttttccatctcggcgggagggcccaggttatgtaacgaaagacgacattctttgttttccagtcttagaaggtgatcctacttataggcgccattttgtgattcccctcgaggatcgtattgtcattgatgcgttatcggatgttttattaataaaagcgcaaaagtttatcgatcctaaggtccatatttatggaaaaactgtgatgtctggagttggtaatgatataggtcctggtttgcggaatgaattcaattcttggaatggtgtcaactcagtagcagtcttcgatattcatgaggttctttcacgtgtggacctaaatatgcttttttgaaacctaaaaaaaagtgtaaatgcagatcctaaagtgtggaaatgttttttgagctactttgatgtagctaatgagctacggcagagtatgtccgaatatgatgcctttaacgaacctccttttcgtggattgccgctcataggttctcttccggtcgttttactaagcattttgagttctctggattcgtacgtgaaaaattttataggtgattggccctatgttcggctcaattacgagttgattttaaaaatatttggtgccatagatgaggaaccgtacctcgaattatatgatttttttaaaaaaaacgcaatccaagtcgattgggtatggctttataaccattcagggattcattctctacgcactggtttcttgcatttgcatatggaacaagtcttcttttcggaatttttataatcatagataggacgtagtcttgctcgatcaggaccctagctttattgcgagccaaaacagctgcgctattctgttctacaggtagtatgaaatttccccttcctccaccactttactagtctcggcaggttgttcttcctctaggtctctccattcccaaggaagcttgcttcttcgtgggctataagacattaacaactggctctcgagtattcctatcatcaagtttttctatttccattataaagttcgcgggtataagtcaaaaggttagctcgcttatttggctaaaccatccaaacaagaaaaagaaatacggcaccgacatttccaatggtagtcaagttcactggaataggttctttgagctatgatccaccactgtcgaatcagcagtaacgaagtaagtgaattattcatcgagaacttcctatggcattcagccttttccttcagcttagcgccctcactgctacttctctctattaagctgctctctgggtccgtccataagcatgcatactggcgctctcttattggctaggcccctatctaattagcgggttattataacaatataaaaataagataatgtttggagttcaataagctctttgcaaaagaatagttcctgctagtgaagtacctaaatagtgcaatctcttgcatcgagaatcatcctactggataaccttcttgctttgtctttcccttatcttgctagctctataccagtgcttgaaataggcatttctttcaagttcaaaaggttgaaaaaggctgtagctcaagtatgcatggaatagcacagatagcggataaagaatagtttagagaaggaaagccagtagagtatgccttggtttaagagaggaggcatctggtataaaaggcagagcaaggaggtttgaactggtaagctgataagcgagcgtcggtattggctttttgatagaggaaaagaagtatgttgaaaaggtccccggatatgcattactttggtagtaaaggaatatgcgtgagaggactatttcaaagaaagaccggcctatggtaattcttggcaaggacgtagtaccggtattagagatcaggaaagtagttgggagtatgtatgccggcaaaaaagtacccacaccttcttaggtggtaaaagatctttttatgaaaaaaatacatacattcttataggtcaatttatctcaatcgatgatattgtttctgaatagttgacctaaccaatcaaagctcccttgactagctttccagcatgcgctactactgcctacctagcagtcacctcttcctcctctattccatttctagtgcaatatctgacttcagtagaagaagagtactccccttcataatgcttccttcttcaagtctttcgctagtgaagtttgggaaagctagtagggaactgcaaccagagagagagttctagtgagtccagactctttctttcgttcatcaaagcgaagcatggctgcaatcccaaactcatccttttttcttcttatcattcgcaatgctactatggttttgatgtcttcttgtgtcgctatctgaggtttgagatcaagggaatagctaagcgtgtgggttgaagtgagtaaagatctgaagctaaggtaaataataggttgaaacagaagaatgataagaataaagtacctctctgaatagctactttcttacttgactttctgatcaatagaaaaagacttgctgtcctcaagttcaaggccttagagtgagaagggaattacgtggtacctctcttttcaataagcattctaccactaactatgtgcctggctatggtttgtcaactcttaccttttggtatgagaacggatgctggaggtaaatggatacacagctactgcctgacttctcagatttcagtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagatagtcaggaaccttcttttgacttgaccagcttacttgtatagtatagtagtaggcctttgcttctgaacgaccttacgaatggatcaactagaaatgaatcggtgtcataaacgaatttagctaaccgtagtagtaaatagcgtgacaccaagcaatcgatcaaagccaactcaaaagaaagcccatcccttcatccaacgtgaaaatattctcaagaagaagccaaaagaaagagaggtgaaacagagtagagagaatcgggtgcttccagtgattagttatcagaaagcactgttttccagatcggattcgatcacagtcccataagcagtagggaccacgagtgagcatgagcctatttcgtgatcggctagttgctcaaaaaatcgtataaaaatcaagcaagaaaacgtatgcgctttagcaacaaagcgctcatcccttgttctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagtagctaaaggaaggaaaatcaaccgagaccccgtt

SEQ ID NO: 70091 - DNA, 8897 bp, Oryza sativa
aaagaaaatgtactcctgcttctgatgatattctgtaatgagtatattcttgcggttgcagtatactagattaaatttatattacttaataatgtgcgttgtacgtgcacttactagtacacttacaaaagagcgaacctgtttgattacacccagtcgatgcatacaaatactcgaactaacacaatcaatcaaatcatcaaatcgttcctttacttactttcagtcatattttctagtttaccatatacctaataactagttcatccatctttatcaatttggttgtaaatcgtccatcttttttgcaagagcatgatatcctttgtagttttgttccatgaaccttccaattcgcttacgagaaagttggttatctacaaaccagtctaaatcgggctagacgtcagtttgatctctaaatcgtctctgcttgtcggttctaatcttttctaagcccatcttaggttgcgttcggaatcccctcttcccaacatgcacaatacttacggaaaacagagcaatccattagcacgtgattaatcaagtattagctaatttttttcgaaaatggatcaatatgatttttttaagcaactttcatttttacagaaaacacaacgtttagcattttgaaaagcgtacgcgcagaatacgatggggatgcactactaggaaatcgggcttatgcaacggcaagaattgttgcaatatgcccaaaaccgttgcaataggtacaattgcaatggatttttgtcgttagggctcatggcgcaaaagtccgtagcaatatggtttttaccactggatcactttgtcgttgtaaataaaaactcctgttgcaactgaatgaaccgtggcaattaacagataaggcaacggttggttggtggtaatacaacatattgcaacaccagatgtcgttgtcgtaggaactagtcgcatcgcaccaaagcgtggtaataagtgctaatgtgtattgccacagacctcaaacgtggtaataggtcgacctttattgccatgctcacagtttggttgttatagatagatcccactattgccacgctacacatgtctctttgctataagcaggccccacctatcagtgactaaggtcgacgagcgcatagtggactaggtcctcgcatgcaccggccgtgggcgcaccatgtggcagccacatggcggccacggtggaccagcgtgggaggtggcaaaatccgagacctggcgaaattcgacctgaactcggactcagcggtctgactggccacgagcctctggttagaccggtcccacgaagaaaaccaggttcttttcaagctttggcaatgtgttcatatttcgagtctagatgtcaaattttagtggtaacactagtcttccacgtaaatcatataactatgtaaaagttgatgggaacatatgttgtgtacacagcttcgtgtacacatcctacacaccaactaacacatatgaccgaaaacttctgacgaaattttgtttttctccttggtctatgtatgatgattttgtaagatatgactttatgcgtagatgtaatactactatatgtactaattttttaagttttttttggtatttattagttggtgtgtaagtgaagacttgtatgcgtagaatatgttgtccatgtggaaaccaaataaaaatgaaatagttttgcatgatagaaatgtcgaaattacgaaatggccgataaattaaaatgaaaagcatccaaaagttgaactcgaagaggggaaaaattagggtactcccatgtacggtcaatattctttcggtgaaaaatgatgtatccatcgacaacgagtcacccgcgatgactttgttactctaaagatatgtcaacctagtgtttcactacgtgctcacaaggataggacgtgtatatgcacagcttgaatttgcgcgtgttataagcgtatatgtttcttactgttcaagaaaaatcatacaaattaaagcaatacaccttatgtgttgtgcatatctatctatctatctatctatctatctattatctatctatctatctatctatctatctatctatctatctatctatctattatatactaaaagtccattaatctttctataaacgctcctaaaccgccatgtggcgtccctacgaacgctcctaagtcgccacatggcattttataatctcaccgttgattttcatttaaattaaagggcccataattttagaccggtaaattagatctatttgcttcctgttaatatcccgtgcttatggttaaaactagcgtgcctacttatgatggaaaaagctacggaactgttcatttaaaaaatcaagaaccgtacgtaagtacgagaagaaaaactataaaaaaacctactaaaaaaataaaaacatgcttacgtatgtaaaagaactataacgcacttaaaatttatatgtatgcacatcagaagaaaaaattagaccatctttttaaaataagattttctatactataaaaacacgcaatatgttagaccattagattagcccgctttctcttaataaatactccctctgtttcacaatgtaaaattttctagcattgtccccattcatatagatgctaatgaatctagacacatatatgtttagattcattaatatctatatgaatatgggtaatgctggaaagttttacattgtgaaacggagaaactataacaaaattcgataacccggattatgttattgaattattgcatcaaggaccataatttataataatttaataatattagataatttaataattttgttttatattaattgttgaatactaaaagtccatatgaactttcttaaaacgctctcacactgccacatgccaatccataaaacgctctcaagctaccacgtgacgctaataaaatccatccctcaatttttacttaattcagtgggtccaatatttttagccgtccaacttaattgagattaaaataacctagcgccgccggaaccgcggctaagggccggacggagggaaacttccctagggagtcaccgtagtcatcctgctcttgctcgtatgtcccgccatggctgatgattaagggggtgtttagatttaggggtgtaaagttttggcgtgtcatatcgggtattatatagggtgtcgcatggggtgtttgggcactaataaaaaaactaattacaaaattcgttagtaaaccgcgagacgaatttataagtctaattattccgtcattagcaaatgtttactgtagcatcacattgtcaaatcatggagcaattaggcttaaaatattcgtctcgcaaattagtcgcaatatgtgcaattagttattttttttggccgatatttattatttcattcaggtgttcaaacatctgatgtgaacatggtgtaaagttttggcatagaatctaaacatggcctaattcaattttggcttttcaattttgttattcacatgtacgtaatgtacgtactactctgtcccagaaaaagataaactctagctacgaatctggacaaaacaccttacttttacttttgttgacatgttttctgaagaaaataagtctaccatattttcaaatgatgaagaatattacaaataattgcttataaatattatttaaatatgatataatataaagctaatgggtttggagaattataaaagcaattaatgccgatgaaaaaaaattatgaagaaatcgtggcataacacaaatatgatatactataaagctaatacgttagagaattataaaagcaattaaggccgatgaaaaaaaaatatagagaaatcgtggcaaatgtttgcttctataagtgtctcaaacttagcgtacgacacaagcccacgcgaatgcgtgggctatcttcagactcaatcacgcacgaaccgtacggacatacgagcgatgcaacaaacacatacatatgttgaaaaagatccgatccaggtaacacatatgtattaatttctcatatataactatatgtatatatgagatggtaacacatatgtatgtttggtagatcatttggtggccagcttgaaggagctgagttggtaggtggtcgccccgaccaagtcagccacaacggccacgtacaactccctcgtctttttgcgagagctagcagcatcgatgacaaccagatagttggacccctgcaccacctgctcctcggctgcgaccacgcggacgaactgcagcctgtcattggtccccagctggttgtgcttccccaccgcccacgcgccgacccgctgaatctgattgttgccggcaacgtcctcgatcacgttccacccgccgacccactgcgcgcggctggtggtggcaacggcagcaacggctgcgaggaggatgagcaggagcccggggtgtctcgccatgtcgattcgagaacgatttgggacttgggagcagctgatcagcaggctagggtgcagtggagacagctgggtcttggaagaacacttgtgctagatgagccatttatatagggctagttagcatatattaattctaatttatgggacatatcgaattttttttacagttcgtttgatgacatggtcaaatactatcagttccaaactcgacattttgtacaacacttggttgtagttgaaagctacggatcacgttggggacattcaacaactagtaggatctatatatacctttggcaattaacacgacatgtatggttgtggtttaaatactactctctccgttttatattataagttcgtttttagttaaacttttttaagtttgaacaggtttatagaaaaaatataataacatttttaatataaaataagcatataatcaaaatatgttaaaatttagttttaatgaaactaatttggcgttaaaacttaaaaaagtttcagtaagaaaaaaaatcaatgtggattgcaatatgaaacgaagtgagtataactttgcatagctcagcagcttagtttccttatagtagaaccagattaaattcctaaatttgatatgagtgctctcacatacggctaattatttttctagtggtcaacattgtcttctaggtgatcccaacatatactggccagccactcggaggcactcaacaaagggattgagagtctcttcgagacgtcatgtgtgtgtgcatccatagtggtgggtgtgattcttttttatggcatgtggtgatatggcttcaactttctctgtggtttaatatcattccgtctaaagagaatagggatggagattgtctattcacgataaacccgtcacctgcctctaagcacgaccccccatgggttgtgctcatgacgcatctccatcgagcccttcagcacagccccctacgggctgtactcggtgcacatcttcagcgagcccctgtggcatgaccctccatggacggtgtttggggcatatatatagtaagccccgaagcatggtttccatcggttgtgcttagggttcatcgtcggcgaatccccaagtcaggcccttctatgggctgtgctcggggcacatcttaagcaagtccccaagtcccccctccccccctcttgtgaactatgctcgaggtacatcctcagccagtccccaagccactgcctcctgtgcttggggctacactcgaacccaaagtgctcgaggagcaacaacgcatggaccccattaagcctcacattcggtgtgaaactacgtataccaacccaacatataatcaatacaacatgcgataacatagtgcatgctgaccatgcaataggcccaatggataccccttttgtccgtgtcttctagtccaaaggcacgtgtcgaagcaatgagcaaggaggcagaaaggagctactccacgtccctctagctcctctatgataagacagtcatacctaacccctatattggggtctatctataaaaaacaagccactgttgcatccgcttgtagctataaaaggaggaccaggaccatagaaaaaaaaggttatgattttcctgtttcattcatctaatttagattagaatcctagttgcaactcagtgaaaattagtacatcctctcccactcagaacaactccaaaaaccacactgtacacatcctctcagctagcgagaacacaggagtagggtaccatgcctcttagcggcccgaacctgtttaaatctctctcacacttttatctctcccttttttacttcgacttcatgctaaatcattggctccgttttgcacacccgtcgtagccgaatcccaaaggtggtgtcactcctccccagtataagagcttcatttctccgatagaggttttcgatttttcaaccatcgagcatgctttaagagtcatgctagcaggggcgaggaattaaactcaagaccggggtttgggtgcatgaaagatagacgcactagctgctgcatccgccttcgtttttttgtcatatatatacaagcttgcatatagaagttacatcgtacagtgcaggatcagtattgcgacaatttaattatactataattattaaaactatattatacttatgtttagttatgtttgaaatttatttgaaggattttatttgcatgtttttatttatggctctatcggccaagtttgaaaatatatactaacatgtcgctgcccgaaatcatttgaaacactgaaaaaatcttttcataatagatctcaaaatttgaaacgcatattatattatgtagacgatgccaaatactccatccatttcatatttcatattataagtcggttgacttttttgctagccaaaatttattaaatttgaccaagtttacagaaaaatttagtaacatctaaaatatcaaattagtttcattatatttaacattgaatatattctaataatctgtttgttttatgttaaaaatattactatatttttttataaatttggtcaaacttaaaaaagtttgactagaaaaaaattcgaacgatttataatatggaacggatggagtaaaaaggttatccacttttaagttatagatttggttgacgtctacaacttttttatttagagaatgtctcaatatgaggttatttggaaaattcaaaaaatcatttttcagaaaatgatttaagaacttgcaatgcatatttagagatgtaaacaatctcaaacaaataaattgtcaaaattttacagattgtggcgagaaatatgagtttgatatagagcacgtctttattcgacttcatctaagacacctacaaaccaacttgttttctcccatattacagacgtgttttctcactggtgaagtgtgttgattggctagcaaaggtccagccttgacctagcaagttatcacattttgcgtcggctttcgacacgtctatgatgtgattttagaaacacggttgtgtccaggatgctttcacatctgtatccattatctaaaaaatgacttatatccctggctaagtgtttacatttagaagtatacatgagtgaactggaaaacacttttggcaaataaattaattgaatgctatggttggagccccccttgcatatgaatcgatctcaccctagtcagaaacagaggcaagacggttgcagatttgcggtaaactaaaacacaacacttgaaactacgctgagtctgaccaattcgtcccttgcctatgccgctgtgcaaagccaacaatccagacaagtatccggattctaaatccactagccaataacttcacggtcaaatactttgactcagcaactaaatcaccgctgctagtttatgttctcttcttcacggtcaaatatttttattaggtacggtcaaatactttgcctgattaatccgtttcaagacatagattccctttgcttactgaccgtgaatagggatgtaagtgggtcaacccacatgtccatttatggtcaaatacatgataactcatggattttcgtgtcgtggcccggctgacggtatctagagatgcaagtgggtcgacctataaacttatttatagctcaaattaagaggtaacccgtgagtcaaacctgtaggttacccactaattttatctataagtcggttcgcggatcagcccgcttataccctggtccatgaaagatgcagtacagtttgcacattgcacacagttggcacaaggaacaaatgtgttgtggccaactaatccaaccaagaagtccaagcggacacaggaaggatggtatgatcaatctgtccaaataacagcgcgctggactaagattattttttttggaaaataatgtaggggagtatcttgcactgtatgtattaaaaattaattataaaaattacatatgtacattcatgagttgaggttttgtagccattgtgaaataagtggaaagtaactagcttttgctctatggatagccaagaaaagttatgctttaagcttgtctttactagtggagtagccagaaatttcttttttctgggtagtcctacttcgagctatatccatggcatcagggactccggtcagttgttcgggctaatggggtgtgtgcaaatgaaatttgaatgtttttcagtgaattagaaataatatttatagcaaacacttgatacaactagaaaggtagcccgcgctgatgcgcgggcatcttatttagtggtgtttaaaattttgttatgaatgtttatgtatatatgattttttttaaaaaaatttctcttctaaatatgtgtatatcaataatttgtttgggaatgttttgaaagttagtttcgatcattggacgtacggacgtgtgctaaaagggacatgtttctcgacatttgtctatacgcatgttggaccgatggggatgtca

SEQ ID NO: 70092 - DNA, 8528 bp, Oryza sativa
acaatttcaaccaatggttttgaatcgtgatttatacggttccagggcagtgtgcccaaaaggcggttagtaacatcacaacagccctcaatttttcattccacagccaccacgattttatatacacatgagcttatcatttgaccaccaaaaaacatgatagcgccatgacagcccctgatttgaaaaacactggttgcaagtttcaacatcttgtttagaaagctgtgtgccaaacatgcttcttagttctcagccacaccgcaagcagaaacgtgcacgcacgcacgcacgcactggtaacagagtgtcatcatcttgtcccaaaaatcactacgtatgcgtttctgaactttgactgatcaaggttcattcactttgggcagagcctggattgagctgatgctgaaagtatctggcagaacattcccagcctgaaccggaactgaagaaaaggatcagaggaacatggcctgccggaatccggcaccgatcgccacccatgtgaaggagaagaaggctggccgcatcgccgggtggacgcatgtcgccgcagcccgcatgtgttgggtgcagggatttagctttgcgaagatttcaaagtaaaaaccgctcctcaccggttttccaaaatctgataaaaaacccggtaaaaaccaatgactttgggttgacgcccgtgcgaaaaccgtctaataccaatcggttttcataaaccaagacctagcggtttcacgaaagtcgatcggttctcgctaaattccatcggttgggtgcataaaaaaaaaacagaaggcgaaacagccatcagcagggaaacctgattaactgacagctccaccccgttttgctattccaggggggccctctgcaacaacacaaggtttgcctccacctctcttgcatttcctattctctcaaatactaggacgcgcaccccgcgcgccattccgcttccccctcccctcctctcgctctcgcttgcggccgcgcgcgcgggcccccggtggtgcgagcagtcgtcgtcgtcgtcgtcatcgtcttcgtccggggccaggtggtcggggggcgaggcgatggcgtacagggcggaggacgactacgactacctgttcaaggtggtgctcatcggcgactccggggtcggcaaatccaacctcctctcccgcttcacccgcaacgagttcagcctcgagtccaagtccaccatcggcgtcgagttcgccaccaggagcatccgcgtcgacgacaaggtcgtcaaggcccagatctgggacaccgccggccaggagaggtgaggtcccttctctctctctcttttcttgctcgcgttctcttgttgtgccgcacgccctctgttctgatcggttcatcatccagcattgcttggttcggcactgcggccaattaggttgatcacgcttcgtttcttcaggaaattcaatgtttttctgtaggattcagtctgcgcgatttgtgcgtatagtttaggaaatgcgcaggttgtttctggtgcgctctcttctgtgtggttcaggattagtaggcacagcatattggtttaagattgatatttctttgttttttttttttgccccatgcattggatatgtggatagtttacatcacgtcgtgtacagtcagcaaaactatagcctttcttaattatgctctctctcatgcgtcattatttttgtttttcatgtaaaatcctttatttacctatctttgaatgtgagccagtggggcatgctatcttcctgtgaaggaaacgttgctctatgacttatgttctgagagagattctagtttattttctagcatcgctatcgtgcagttttattctacacctgcattggtgatgtcctgttgttgccatgtactatttggcatttgataattcgtatggacatttacatgatttcaatccaactgtctcctcacattatttagaaaattgttctgctgcaacatctgtttgtcttatggctctaaataaaaccttttctggcagttgaccatccatccttcaaatagtaaataccatgagtggtcgtccaataactatagaatcactaggaatattctttttttatttacagctctatgctgatgtttacagtattactcttgtgccatttacaatcaaattgctgtccctagtgtctcaaagaacttcatgcatttgatatggagtattaggcatatcctttgggatcaatttctttggaatctgctccatgtatttgatgacatttcagtcatgttgatagtttcagtgctcggtatggactttgaagttccttctgtactctctcaacaggtatcgggcgattacaagtgcatactatcgaggggcagttggcgcacttgtcgtgtacgacgtgacacgccatgtcacctttgagaatgtagagaggtggttgaaggagctccgggatcacacagatgcaaacatcgtcatcatgcttgttggcaacaaggctgatctgcgtcaccttagggccgtatcggttgaggacgccaagggcttcgccgagagggaaagcaccttcttcatggaaacgtccgcgttggagtccatgaatgtagaaagtgccttcactgaggtgctaactcagatctatcgcgtggtcagcaagaaggccctcgacatcggcgatgaccctgctgctccaccaagaggacagaccatcaatgttggtggcaaagatgatgtttctgctgtgaaaaagtctggatgctgttcatcctaaatccattatgtccatgagaaggaaccatatgctcacctgattatatcatgagtaattaaaaggataactttcttttgctgcctaacctggttgcctgtgagattttagtgttacatcaagaaggttggggctgttaaacccaggttgggaaaaagctaactttgaagtgtcagtggttttatggtttgcatttgtggtttcttcattggtgtactattgttccatgtaaattgacaggatttgagatcctccccacctttcactgcataacatatcccagtaaaatgttgttgtaattggatatcagactgtagctgattggcagcaagagttctaattagaagggctattatattctgtaactcctactcacaaatgtacaaaagtttgcatccttgaacttcttaccagcctgtatattacggtactgaaagattgtttaagataatttcttctatttcagtagatgtgcgtaaaggcgtaaactatagcatttatcattttctgcatatctctgttttgcaatattactacagattgtgactgacctacaagatgtttcctttcattttatcagtattaatagagtgaaatgatcagctttgaatgtctgttgtgtaggagtactacattctggcagatatgaacaggttgcactggttaaatgacctttcgagagggcagaagaagagggtatcaaggtctagttgcagtggttaaatgacctttcatgagcagtggttgcaaggtagccttaatacaattcaaaggacagcaacattggttaaagcaagttcaatttagtggaatatggttggtccggtgattgcccatgttctgtagttacattgccaagtgtaaggtaggatgcaatgcaatggttatggcatgacaaacctaactgcattgctttagcaaaaatgatgaattcctgatggccatgcctggcgccatgatcctgttaaagaagtaacctatctccattttgtgaataccgttgcattttttttgaccgatttaagcagcactgatctgacatcatgttatcagccaatttctgaagccatacatttttctgtagcaaaatttgcattttttagaagcacagatcttgagttctttgacattaaggacttgttcacattgttaccactttcaaccatagtaaattttggtattatcaaattttagtactgctaccttgccaatgctaacaaaccaaacaaatccttgccaatgctaccttaccaaactttggtaattataaaagttcccactcttaaaaattctatcaaattttgataagcattcaaactaaacacaatcaacgataccaaaatttggtagcagtaatgccaaaatgtgctaccaaattttaagcaaagccagtgagaattcggtgcttccgaagaaaatgcaatttaattcttccatggtcattcagctccacgcaattctcagctacaacgaaaatcaccaaacaaaaaagaaaaatctccacacgattttcagctaaaacgaaaatcacaaaaaaaaaattgtaagatgagtcatggaaactatttctcactatcagcaaagaaatgtagccgtggagaacgccaccgtgttgccattgcctgctctgcctccccttgccacggctgatctcgcggcggccaccggcgccgtcgccggcgacgcgtccgtgctcctcgccgtgaaccggtggtggtgcagcggcatggagttggcgtcgaggcggtggagcgcggcgacggtgagcacggagcaggcgagcatcgggacggggccgaacacccacatgagcagcgccgtggcgaggtagagcgcgcggagccccgccgcccagaagttgccgccgcggaccacggcgcgctgcgcgtcgcccaccggcggcgccgcgtcgccggcgagcgcgctcatgaggaagctcgcgtgcacgaagtaccgcgccgactggatgaagcaggtgaaggaggcgaggaagcaggcgaggagcgcgacgcacttcaccgtcgccgtcgcgtggctgccgtcgccgtagccgaggacgacgacgcccgcggcgcccggcgccggcgagctgctcacccacgcgccgatcagcgagcccagcgcgatgcacagcgacgccagcgtcgtcgccgccgagatgttgtccgagatcacgcccagcgccagcgccgactcctccggcgccgccgcctgcaagaaaccactagaatctttcgtcaccattgatcagttcttgaacaaacaaattgaattgatcgaacaagatgatgaacctgcagcatgcgctccacccaggcgagcttgttgtgattctcgtagccgatcacggtggtgtgcgggtggcggagaatccggtggaggagcatgaggtggtagccgaccatgatcgccagcccgcatgggacgagcaccaaatccatggagctcttgtcaacaagcatcatgaactgactacctcaatttctgtctctcaatttctcaacctatatatcaattaacctctacctagctagcttagctctatagctaatttttagttgctgaatcttgctgttcttctcttctactcttatcttgattcgatcttgctccctttctctggcatgattgcaacacgatggacagaatgtgtacaaactgtacttgccattgcttagattgttaggtcaattaatttgtgttaacttggtaatgggcactctcgttttcattctgtccgtgatacttgatagtagttgcttgtgggtctcagcagaaaaaaactattgttgtggctttggatgcaagagaaaatgacaagatgaaaatttcatcctatgcaatgtttgcaccatctcaaaaggaggaggaaaaaaacaaaaactgtactttgcagttaggagagagtggcttttgcttgcacttaaaagcaacatgggattacaagaaagaataatttcttaatggacttcctcaagctaagccagctgcatgaatccaaatttggtactttttttcgtattttattttttttctcgtgcatgtgctgcaatactttggctctaaaattagggggaaatctcacaaaggggggtatttgtgcatggataaaaagtttggggctgttcagattgatgccattttcaaccataccattttttttgtaaagttgccaaaaaaatgcttacgttttgtttgttactaaatcctgccaaaattggtaatgccaaaatttggtaagatttattttggtaacaatctaaacaagtcctttataccttgcagttgtgcatggtttgggctgtccggcccactactgagctgcatgcctcatgatcaatcgcacctgtatcccaaggcccaatgcggtcaattaaacaagaggtttttcctacattacagcgattttgctatatatttatcgataaattttcttcctaaaatttgacaaatgtaaatatacgatcatagtgtaattacattataacttgtatgtaactttcacataattttaaaccgttatatttgctttaaatcttatatatgcaagcgagaaagaaaaaaatcacagcgtgcgcacatatgataggatttggtcctccactttacgaaaataatatgttaatgaggtatttttaaaagttatatacgagttatatgcaagttacaatataattacaatttttttagggaaatttgtcgacaaatgtacgagcaatcccacattacaatatttgggtttagtttttctaatatgcaaggacttaggacagttgaagttattaagcaaattaatttaatatagtttacctttcaaactctacaagcaaacatttttttccgattgcacggatgatgcacagatgcacacctatgatgttgccctcttactctcgcaagaaggggccagtggcaaatctatgacggcttgatttaattggatttttgttcctttattgcttccctgagccttttaaaaaattactatttgaatggaaatgtctgttattatgaaggacaattacgttcttatccatgttacgttcattcaccaagagggtctcttcaagatttttgctcatatccatgatccatccacagattttgagcttgtttctaaaaagggacatcgagaggaaatggattaaaatttggaagtacatatactgatattttatacccacatattggtacaaatatactcgagaatgtttggaaaggaacgagaaaatcgtgaattcagaaaagatttctgttgtattctactagcttcagttgaagttcggagacattggatgtagtacaatttgtgaaataccattaaagatcccggttggtcaggagacataataatggcccagtgacaagaacagccggatcataacaagaactaagcttctccagtactgacatgtgactgactcgctttgcatatctgtcgcctccgttattatctctagcggtatactcgattcatttcaggaactttgtgtgggaagcagaaggtgtgttatcacttacctggtatatatgtgtaaaattaagattggttgtatttcagggggggtatttagttgttccacattctttaagttggtcatcaccatgcaatgaaatataaggaaagtatattacctctgttgatcaaaatgattgaggctaattgaacctctcaaatttctatatacatatattcttgcatcctatatctataattttgtacggcactaatgcagtttaccttttaggcgtccacatgttcagctgtatatagaaactagtagaaagcttcttgtcctgtaaaagcagtctctggatgttgcagagtgtgtatgttcacttatggagttcaggagaattgtatgttccagttattccccttcttgtagatcccggattactggctacctcgatgaatagaaaggcaagaatgtttactagtaacaatttaccaggtgggaagtccatgacagatatgttgggaacttgcaagtctggaccggaaaatgttggcgtgagcaccttgttgagatgtcggaagcactggtaaactgaaagatttttcaggagtttccatgcaaggcacaacatgagaacaccacaacctggaattccaggtttctgcattgttcaggcactgccgtttatcctagcatatgtcatcagattaccactggtttgttctgacgcacctcaaccacggcaacaaactgaaggatatggacgcagtctgcaacttacacagtagagttctcactaacagatgtaaatcggactgttcagacaagcggtcacactgttcatcgtacagcaacaaaaacatggtaacaagggatattattgagattaattttgcgcagtccttaatccttaaggcatagtggcacttataactgcacctgatctgaatcgtttacctagtatagcctactacggtgctcctccccttaaaaaataagtttatttttcatctattccacacatactactttcacaaactttaatataatgattactaaaagataagatttattttaaacaaataagatgaaacaaaatgaacatgggagggtaccagatacccttgctacttggaaatatattggcacaacgttactacctatccttgtgtacaaatagcggtacatttcgatcagtgtgacgctcagtatccctattgagatcataatacatactgatcagtgtgtgaatttcagtttaagtatgtagattagtacacgtcgaacacagcgtgacgctcagtatcagcagaaa

SEQ ID NO: 70093 - DNA, 2938 bp, Oryza sativa
tttatactacatgtgtttctttttaaaaaaattagcatcttaatttaaacttttaagtaatattttttcttgtatactaaagatgtattaataatttttaggatatattaagttaagaaatttcatattaaaaaatatggtaatatgacttctttatctaattaaagacataattacatacttctatttgcttgtactacctccattcataaattgaaggattcaaattttatcctaagatataaaggattttaatactactcgtcccatccaaccatccattattcaatttttatccaacagtactctatctatcttctaactctgcacatacctcatatttaatgagtcttatttagagaggggaatcttagtatatttttttcattcttccttaattccaataaaattttaggattcaatataggatggacgtaataattaaaaagaacttcattcatatacggatttacggatttatttgtacgtttgtagattgatttagctttacatatttataggtaaatagacctcgtatatatgttgagagatacaattaagttagtagaagtcgttagatgtataatagtatgaagcaatgagtccaccatttttattaaaaaattatgaagtactgagtccaccatttttattaaaagattaaggtggatatttttagggataatttttaggattttcttttatccggtggttaatttaattgccgtaagggaaaaaaaaaaggaggtgagagccggtgggttcgtctcatctgtgaggagggaagtggatatgttcattgtacatacggattttgacggcctggtcgatcgataagttttatttttaagatatagatctaacattttaaaataaggtccacaggtttgggtaagatgatttctttttctcaaaattttttatattaagatatatggtgatttaggaatgtttataggaagctacgtggtagctcgagagaatttgtaggacatctaatgaacttttaatatataataatagataattcatgtcatattaattaatatatcaatcaataattaaataatttgtgtgtgcagtgtcctgataatctttttatgggttcaccactgaaaacaaagggtatatatccaagtgatgtcttgataattttatttttgagttcgcccctggaaattaagggtatatatatccgagttatgtattataatttttatataaaaatatatgtaccaagagattatttagctatctaattaatttttatactatgcatttggttgttagccagaaaattggaaagatggaaggggagggttagacggggagagagggagtacgtacatacatgtgcgcattacgtgaacttgtgttcggagagggggaacgtacagtttttttttggaagataaaatttaatggtgaaaattaataatctaataatttaaaatattgggtctaccgatttaaaggaaagtgtcacgtgacggtatagaagcatttgtaggagtgtcatgtggcggcttaggagtatttgtatgaagtttaatggacttttagtaaaaatacaccttgttccgatcacatataaattctccatttatcataacaactcattatcactattataaaagttgattacctattaatagatgaaattgcatatgtgcaaataaaataagcctaatatatcattaatgcactacttagctaagtctcatgtctcacttatttccaaatccatatataaatattctaaaagtatcactttctaccgactaataggataacaacctttaagttaaatatgaatgcctcgctaacgggtgatctattaccttgaaagttgggtacctcatcgatgtagctgtgtcccctcaagatcagcatgaagcacaattctaatgcataatttactataacatcctcatagagtactgtaacatacttgggtcacctcaatttagccatttttatgccacgtgatccaccaatttaaatagaaattgacagtgacattatatagtgccacataacgacctaagagcatttgtaggagcaccgcatagcaacttagaatttttttaggtagtttagtagactattagtatataatattattttcttgctgcggacagtactaccgaaactttatttccttttcaatcctactgttttttttaacagttactatgtatacatatgatctaatggtctaaacaggtgcaccaatttaaacaaaaatcgagagtgagactatacagtaccacgtggtggcctaggagcatttgtaagagctccatatggcgacttagaagtgtttgtaggatcacaatttttttttagaattacatagtacaacgcagacactcacaacgcatgcgcattcacccatatgaacacacgcacgcaaccctacccctaagagcatcttgggccggcaaattagatatataattttaaaataattttaaaagatgaacatttatagatggttgatttgatatttgatatttatattatagatctagtttaacactacatgcaatatatttcatctttatattgtagatagttctattttaaaggccatcgatttttttcagatggtactaagtacttatgttttaatttggctctatctttatagtaagtacgtgcatttgtttttgaaccggcaaatattatgtacatgagaaaggtgttacatatttaatagtataaaataaaaggtccactaatttgaaaatcaataacacatatagataaaataatgaatccatctcaatttaagtgaaaatcaacattaaaattagttcaactgcatgtgtatatttgtgggccaatatatttcaactttatattgtagatatttgctttttgatagtactaatcatgtatgttttattttggttgtcgtatggggctgcaggaa

SEQ ID NO: 70094 - DNA, 11642 bp, Oryza sativa
ctccgagaacgattctccgacgacaatgctgggggctagggagagtgtataactcaacaaactgactgatcgaagtcggtaaaagagtagacgctcatatacaaaacattggtctgtaagtttaattcattttcggttttccatacatattataacatgttaccctttgagcgttcgctcgggggctatttctatctaatattcttttctgagtattgatttcaggaaaattctatttgacattatcgaagattccatgtctctatggttctacaccaagatcaactaaggcgagtatgataaatgttgacaaggctccgtcgcagactctacgcctactcgattactcgagaacggttggtggatctcgacaaggaatacggaatgaagagatggtgtaccgccgagataaaatttcttgacttcaatccaaattctcgattacagcaagacgggagacttagtcgtatgctttgtactttcttggttgacatcggagattgactcagacaaaccctttaggtgtccgcacgaggctgataaaggaagtctaacgttatctctgaactcaccgagaacggttacgtgcgctcgataacagttcctccaaggtctgcggttgagaatatgaacttgttcatttgcattgaagtcgggggctactgtcagggttatggataccacatacctaatagtagttgactaaatctcggcaggacccactacataccatgtcctatacggaagcaacatttggatataggaggagttccggataaggaaagacaaccacagttctacatggaaacgataatgactactcggattgtatctatattagtttccctagttctacttggacaaggggacacctatgggtataaatacaagcccccctaggaggagaggggggaggatgaacacccaacataatcgacatagaagccacaacatagaagcctacatacgccaagacacgccgccggatatcgacttcagggataagcacagctagtaccctacggtgtctccggatactgtcaggagagacgaaagcgctatatctgatctcgccgggcacggattcgaggagaaatgctaccctgttgtcgactacgggtcagatcgtcagaccgccatgtcgacaatagttagataggctaccccaaatattatactagtgtgattatcatgaataagagcaataccggcttcggccaacaggatgtagggttattacctgacaaatcaggggcccgaacctgtataaaaatcctcgcctccgtctctttacctcagtcgcgcgtacatcctagtaccaacgatccccataccatgcaaataccgtagtcgagacatcaaacgtcgacagtatatgattataaaataaaaatcatatacagtcataaaatcactgtataaaaaaatactagttatgggttttatctagtagatcttgtacatgatccatactactaattattactttattcgtgtcaaaataagtttatttttttcctcccatttatcttaaaataaatttatttctaagcaatcgtcatattggagtttataaaagtagggtataaatatattgaaagtacataagagagtaagtttgtgtccttttggacactttgtcaactcttaaccctcatttttcgcacattttttaaactgttgaactgtgtgatttttgcaaaaaaaatataaaaatctaatttaagaaatatttaatactaattaatcatgtgttaatccattgctttatttgcgtgcccatatgaaagggttaccaacactggctatcgaacacatcctaatgattgcataaaatatgtagtcttttcgatttcatattggtatgctattgaacacaatccaatagttgtatcgagatgtgataaaataaagatattatagtatttttaattttgtattggtacgtgtagaatgtgtgaaaaataaacttattttgggacgaagcgattacgcaatgatcgtattgttcaagttagagggagagaccacgagacaccgtgttcagaacacaatagtctcgcaggactcgcagtgaaaatggttcaaaacggcagagaaagtatacggagataaggccagcagagaagcacggggcatgtcgagtctgagattcgagaaaggcatggagaaagaagctgagcagcagggtttacgattccaatatgaacttcagtttcgggctctggtgaaatgacggttttcatgaaatctggtgaaaagccggtaaattctgaacaaatttcataaaccaaaatttgaatacaaataccttgagtttatcgataagcttgcgaaaaccagtcgactttagccaaattccgagcgaaatcatcgaaatttaagtgttttcctttttttagtttgttattcttttctttcctactataaatttcagtaaatacacagaatacacctttttttcaaaaattacgaaaatcatactatttataagatttcaaatttgaatttagtcgtgtttagacacatgtatggagcatcaaatgtggacgaaaaaaccaattgcacagtccgactgtaaattgtgagacgaatcttttgagcctaattacgccatgatgtgacaatatgatactacagtaaacatttgctaatgacagattaattaggcttaatagattcgtctcgcagtttacaagcggaatctgtaatttgttttgttattagtctacgtttaatactttaaatgtgtgtccgtatacttaaaaaaattttggcacacgaactaaacatagcctttaaatgaaactcatcaaaatctcaaacggcttctactttcgagtctcgtcaaaatcttaaagttttacggaattcgatcggttttcgtcgaaattgagaaccctgctgagcagaacaaggatttccaattgtaacgccccgattttcatttgggataaaaatcatttaataatgcattttctagaaattaaataaaagttaaatcaatttaattaagtgaaataatgggagaattaaaattttccattaaaaatcattggccgggaatattttgtaatattctttgtgccctaatacaccctccggatttttccgtgaattttcggagctcaataaataattttaatgccacaaagttcactaaatcaatttaaagaaaaagaaaaaaaaacaaattaaatcctccttcctcccttttcgagctcggcccaatcctctctccttcctctaccgtggcccggcttgcctccccttttgacgcaagtctgcttttcctccctctcggcctcccctctcactcaggccgacaggtgggacctgtgggccccacctgtaatccccgagatctagccaggccggcaactgccgcctgagccgctcccgcgtcctgccaccaccgcagccttcgccgccccgcgggcaagcccggagccgctcccccattccacccccgagctgccctctccacggtgaacccgagccaccgtcgccattgccgcctctggccgccaatcgctgccgctctcgtccgtcccgcgctacaccgtcgcctccctcggctccgcaaggacgaggagaacctcggccacctcttcccattgccgaaaactcactggacgtccgttttcccgtacaccggtgagaccttcctcccttccttccctctccggccggccatgtcgccgccccgtcctccctaacgcctcccctcccatcccagggtgcagctgccgctcatccgcctcttcccgagcgccgcccgccgtcggagacgccgtttcgccgcctcccgtgccaccgccggctgcttccccggtgtcatctcgtcgtcgccgccctcggggagaacccttcctccctctgtctccccttcaccggccgccttgcgacgcgccaccactgccggtggccgtccggccggttcatcaccaccgcgccgctgccggctatgctgggcagccggttgccgcctccccttgctgcgccgcgccaccgccgcccgcatgcgccgctgctccccgcgccatcgccggccgtcgtcgccggtggccgcgctgccgcgcgccgtcgctcggtcgggccggcttgagccgtgcctgtgtcccggctgcgccgccccgtggccgcccgatcggctaggaccgatccgggccgtcggttcccgtggaccggcagtggaccgcctcggtggtcccggtccacggtggaccggcgcccttgtgtcgctgaccggtggggcccgcttgccggcgccgcccctcccccttgatgacgtcagcgcgtcccttttcctttcagaaaataattaataattgcgcaataaatcagtaataattctagaaattcatttaaatggctcgaaacttctaaaattcatatctaattcatatgaactccgaattgagccattcaacttgcaaaattcatctaaaattgagctctacatgtttgtttagtttttatgtactttttcgttggtttttattagagtttttcctcgttttgcgtgccagtgtgtagaatccgtcgttttgaaagttcgcggtcgcaaggataagagttcggaagattgtttgaagaagcaatgcaagtcacacattccccttgagcattttgatcctaatttacaaatattttatcgtttgcaaataaaattgcatgtcttgctaattacatgggatccgggtattacgtgccatgtttacttgatatctgtactttgtcaacattgggtaataaatcgactagctcatgttacttatgtgacctagctagaactttatgcttagccatgcttaattaccactagctcagttgatgcgataattacagtattagacctttttagtatcagaatgagctgcgtgctcgagacatctggccatgcttcatggtcgtaattatccaactaaaatgcgactgaatggtgggctgtaggtgtatggttttgctagtcgcacccatggcaattaaggaccggttcgcgggatgccctggaagaacttatcgtacataccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgcggtgtggtgtgcttggttagagggagttatgcgaagggtcctgtcatggcctctttccggtatgtcatggtggcatgtcggcgcacggaaacgtgtcgtggggctgtgtcttgtgggaacagttgtacacctctgatcagagtaaaactattcgaatagccgtgcccgcggttatgggcggttgaccagattcaccgtgaaatagtctcacccctaataaatcgacctaatgcactgtagttcaggtgggttgggcctgttcaatgtggtgtagcgttgatcagtggagatctaatttactttaattacttaacagttttactgttttgctcaataaaatattttacaaccgcctttatgcaaatagccacaaaccgtccttgtgttccccttgcacgtctgcatcgttggtgtggcttgctgagtacagtggttgtactcagccttgctattatttcccccttttcagaagtgcagtgcttctgagctgaagacgaagttagaggaccaaggctcagaccctagttgagttttgcctgtggagtggagctgaagccccgtaggatcgtctttttccgctgctgtcgttctctttcgtgtgaggactaagtgcctcttctgtaagtattttacgctttatttacgtttagaactctatattacttgtcgtttttgtgtaccctgactggttctggatatggatttaaaatttgggttaaatttctgtgagtgacaccatttctccatggtcctcctctctggccgagcctttacctttgcttccgtctcttcgagctgctgctgccacctttcgcagtgatgtgagagatggccaagctgctgctgctgcctgctacggggtagctgtctttcacgtcagcccgttgcatgcttgcttgctgccctctctttagggtgtgttcggacccaagggttcccaacccttctcaattgtatttaacgtacatgctttttaaactgctaaacggtgtgttttttgaaaaagtttatgtatgaaagttgcttaaaaaatcaaattaatctatttttttaaaaaaattagcaaatacttaattaatcacgtactaatggaccactccgttttccgtgttcacttttccggatgggaacttttgtagcgaacacagccctcacgtttgtttttaccagcacagttggataacatggatgcacgtacgggatcaaagacagatactccctcgtaaaaaaaaaacacatgtgtccaagtacaaacacagtatccaagtacaaactcaggattagatattttttgacagaggaagtatatacctaccagcaaggaacacgatgacgggaacgagggatgatacactcgtctctactataactaggtccaactcccacatatacactatccgtctcaaaaaaaaaaaatcaacctagcaggggaggggatatacccctcctaggatgatccctcctaggtcacatctccgcctagattttctttttgagacgtagggagtacaacttttgtttttatcgtaaaatataatagattttattcaccaaccctcttatttcaaccaatcacatatacttccatctaggggtgaaaacggttacggaaattcccgatcgaccaagcgccgtttccgtataagaggtacctttttagctatttttaagttttgttttttcttatttctttctgtatcatattaatatcgacactgagtagtttaaatgataaatatgatcaattatctttcttcttttcttctcttatgaagtcatatcaccttaattttcctttagatgattaatgtatattatcttccttattttccttttctcattgagacacattactttagtattgcttttaaatgatcaaatatattatttaaactgttataaaccaaatcattttaattgtttatagctttttcaatagtgaaaattatataaaggatataaagttatgtcgtgtagctatcttgcaggttagttttacatttggatgattaatctatgttatattttttccctaatctcattgagctaatacattactttggttttgctttttattgatcaatcataattgtttatagcttttttttcaataactgatcaaagatgaaaatcatataaagttatatcgcatagctacatttaagttatttctactattatgataaaaaaattcccgcaaaaatttctagttagaaactcctatttcgtaaaaaaagtgtaactctagactactatgggttcatttggttccactagaaaggctaaatatttggaaccagtaaaaagacatgcttttaggagcaagctagccttacagggtgagaaaaatcccgctggccagggagagccgatttagctcgccttccatggcaaaactccaattgcaaaaacaaaagagaggaaaagctctactcgcacgaaaaaattaggataagataagaacgacccaggcttctctgaaatcagaaatcagagatatttctcgacaactcggcccaatctcataggcctcttctcccacctctcgctgacgaagtctttccctgaaagcatcctctccacctactcataaaagtcacagccatctggagaaaaatcgattagggaagaggcgaactcatccgcaaactcgatctgaggcaaatctattcacacggccgctcctggatcttgtttctctttttagaaacaaaacgagaagcaaaataatcatcggcagagcaagaatttcgtacacgatccaaacagctacccactatttcttgcctcaggaagcaaactaaacacaggaggtacgacaaggcaagcaaactgacaatgagatggtttaacctcaccgagctaggttacttgcgccaagatccaaatataatgtaccctatctctccctttcaccaccccttgttcaatttttttccatctgaccactaactaggggtatgcattagatggtttgttttattttaaacaaaattggtcatctaaaagactaaaagtgtctaagaccgagtaattgttcggtcttttatcaaaacagaaatggttgacagtttcataagagcaagtttaatagtatagcccactattagctccaaatcatctatagccaatgcaatagccaattcatacaataattgtttactatactattaatacatggtcccacatgtcatatacacattgcgtcttggagtccgtgctgcagctggctacagatctgtagcccgctacttttctctctcatcgtttatcgtattaaaatatgtttatagctggctaatagcctgctattgtacctgctctaatgctctaagattataattaaattttggcaacacttctcttcttttaagatttctttactgctctcttgaaatgatcatatatatatatatatatatatatatatatatatatatatatatatatatatatatatatatatatatatatatatatatatatatgtatgtatgtgtatatatatatgtatgtatgtatgtgtatgtatgtatgtatgtatgtatgtgtatgtatatatatgtatatatatatatatgtatatatatgtatatatatatatagacacacacactgcatataggtaggagtaggatgcgacactgtaatctgacgtggataacaagatggattgggagcccctttcccatagattttgtgagcaagcatagctgcatgggcattgggcaagctagcagaattgacgtgtgtgtgctgcctgctggctaatgaccggtggtctcaactctgaagagaggcgtggcagaaaggggtatggtttcagttgggattctttccaagcctcctgcaagattctcaccaaaaggcagcgatagattcgaaaggcaggggatactctcgtgaccattgaggtctttgacgagagccttgatggcgtgaggatgtcacgacatttttcttttttttgttaaaaggaaatttggtcttgaaggattggaatgcaaacttgttctaattaatttgtgtttgggaagtacattaacagaaaagtgaagcacgaaggtacttaacatccaacccaagaatcactagggctgtgctatcgatcgaccacatcatagtttaggacaggctttccttgaacaaggtatctttacctctatatgtttagactttagaggagagtcgacagtactaaaataatcccttcaaattgtaattttcaaaaggctcagagaagcaataaaggaataaaaatccaatgacatcaagccgtcaaagggcttcatctttttcttatgcttatacttatcatccaagatttaaattttcaaccatcaaagtttatttttcagtcgttgcttttagatcgctaagaacacgtatataaaagttttattcataatttacttttcgtttgcaaatacgccgtttcgcgatggctccgaatgatttgccactggccccttcctgtgagtgttagagcgcaacattcataggtgtgcatgtgtgcatcatccgtgtaatagaaaaaaatgttcaaagagttttgaacggtaaacaatatcttaacaacttaaaaattgataatgttccattcgtcacatcattttttttccataagtctgatggagcgatggcctccgtttccacacgcgcgagtaacgcatcgcataagacggataaagcacaaattcaaagatagatcaattttttttcagtccgtcattctcgcatcattccgagcccacatcaaattagatccggtcgggatttcacataatcagtttgtgttacacctgtcctagaaaaatccctaatttgtagaaaccctaattttcaaaatctcctcaaattagatcccaaatacaagaactataaagaatggcaggcaaaaaaaaaaacctaaatcatggtcacaccggtttagatcttcggccgcaaatatggcatgatttcagaaatccgattctcgcccttgactaccgtgcacgcaccctagccgtgcaacactcatgagtagaatgccagcagcagcagtgaggatgggcacagccatctgtattcgggcacgccggttggaatcgggatcaccattccctgaacatagcccacatcggaatcgggcacaggccaggattggaagattaagaacaccccagcagtttcagatcctgcaattgtgcaggcacctgaccagaaagctcattgttcggcaaatcaagcgtgctcatcttatccataccatacccccaaactcttcaggtatactaccattgaacccgtcgaacaacggataagatgagcatgccggtagacgacgtactcgtcgatagcgagacgcctatgattacttcatgaaccacaaaatatgccggcccagccttccagatgtgctcatagcggtagtgcgcgcgcgttatgagcatctacgtttctattgtgtatccaaaaaagaaaaaaaaaatatgctttatttattagggtacactgtcccgtgtggacggagcgatttaatttgtggttgcttaagaggaagtttaatagtatagtcaactgttggctccaaagtatatatagccaatttaatagccaattcaaacaatagttgtttactatactattactatctggtcccacttgtcatatacacattacgtcttataatccatgctctagctggtgacaaatctgtattccgctgttcttatctctcatattttatcttttaaaatatgtttatagttggcttatatcctgctattgtactcgctctaagagcaagtttaatagtatagcccactactagcttcaattcatctatagccgatctaataactaattcgtacaatagttgcttactatactattgatatatagttccacctgtcatacgcacattgcgtcttgaagtccgtgctgcatctggcgacagattatagcccgccgttcttctctctcatcttttatctctttaagatatatttatagctgatttatagtatgccaatgtacttgctctaagtcagcgtttgggcctgggaaatgcgggaagcgtggttgggctcactcgcttggcagtagggatgaaagtggttcggatactttccgtccgtccagaccaattttcggattcggaaaaattcggtcggaaatatccggaatttctcggattcggaaacggattcggatttttttctcggatacgaaaacgaatacagtaacggtgatatctgacggaatcggaaaacggtcggaaactatccggcatttttcatcagatatccggagatatttttcagcaaaaaaaaaccagaaaccctagccggctagccggtcgcgctagctgcccgctgccgccgccgcccgcgcgagcctgccgcggctcccgcccgccgacgcccttgccggccacagcttcc

SEQ ID NO: 70095 - DNA, 2304 bp, Oryza sativa
attcctgcagccccatctgccacgatttctctataattttttttcatcggccttaattgcttttataattctctaacctattagctttatagtatatcatatttgtgttatgccacgatttcttcataattttttttatcggcattaattgcttttataattctccaaacccattagctttatattatatcatatttaaataatatttataagtaattatttgtaatattcttcatcatttgaaaagatggtagacttattttcttcagaaaacatgtcaacaaaagtaaaactaaggtgttttgtccagattcgtagctagagtttgtctttttctgggacagagtagtacatacatgtgaataacaaaattgaaaaaccaaaagtgaattaggccatgtttagattctatgccaaaactttacaccatgttcacatcagatgtttgaacacctgaatgaaataataaatatcggccaaaacaataactaattgcacatattgcgattaatttgcgagacgaatcttttaagcctaattgctctatgatttgacaatgtggtgctacagtaaacatttgctaatgacggaataattagacttataaattcgttagtattcgtctcgcggtttactaacgaattttgtaattagtttttttattagtgcccaaacaccccatgcgacaccctatataatactcgatgtgacacgccaaaactttacacccctggatctaaacacccccttaatcatcagccatggcgggacatacgagcaatagcaggatgactacggtgacgccctagggaagcttccctccgtccggcccttagccgcagttccggcggcggtaggttattttaatctcaattaagttggacggctaaaaatattggacccactgaattaagtaaaaattgagggatggattttattagcgtcacgtggtagcttgaaagcattttatggattggcacgtggcagtgtgagagcattttaagaaagttcaaatggacttttagtattcaacaattaatataaaacaaaattattaaattatctaatattattaaattattataaattatggtccttgatgcaataattcaataacataatccgggttatcgaattttgttatagtttctccgtttcacaatgtaaaactttccagcattacccatattcatatagatattaatgaatctaaacatatatgtgtctagattcattagcatctatataaatgtggacaatgctagaaaattttacattgtgaaacagagggagtatttattaagagaaagcgggctaatctaatggtctaacatattgcgtgtttttatagtatagaaaatcttattttaaaaagatggtctaattttttctactgatgtgcatacatataaattttaagtgcgttatagttcttttacatacgtaagcatgtttttatttttttagtaggtttttttatagtttttcttctcgtacttacgtatgattcttgattttttaaatgaacagttccatagctttttccctcataagtaggcatgctagttttacccatatgcacgggatactaacagcaagcaaatagatctaatctaccggtctaaaattatgggcccactaatttaaatgaaaatcaacagtgagattataaaatgccatgtggcgacttaggagcgttcgtagggacgccacatggcggattaggagcgtttatagaaagattaatggacttttagtatataatagatagaagatagatagataatagatagatagatagataatagatagatagataatagaagatagatagatagatagatagatagatagatagatgactattgttccctgttagtggtgcgagaagatcatcaacaacaatgacgccgatgactcctaccagatgttgtggcgctctcctcgaccgaattgcatttcctgctcaagctgttgttgcagttccgcatatggcgttgttgcagtactccgaccagcacttctgctaccaccagtggtgcccaaccaccattgcggagggcggcaaactgatgagggccaacgggaagacgatgttggtaaaggccgccgctttccacaccttgccattgctctgtgccaccactcgtcgtcgcgttgcgctgccgcttgatgtgaaaggcttgcagccacatcaggttgctatcgctacccagctccctcgagctcttccgacacgtcaccccactatcacctatcaccaccctatcctgatatcctcaacctcccgacgccctacaacca

SEQ ID NO: 70096 - DNA, 3362 bp, Oryza sativa
  unsure (1)..(3362): unsure at all n locations
ctatagtgctataaaaaattctccaaatattgggccgtatagcctggccgagatattcgcaaacagtccagctaatgttctgtggtaatggcccggtggaccgatttatgcaatggagtcaagcaaataatctggccgttcattttctatcgggagtgactattcatttgtcgtcgggtgatttctagtaaaaaatcacccagattttttttacccttagatttacatccaacagactacaaaagaaaataaaaattatatatttacttacacaacatttttatcaaaattacagtacacttacatgtcatatcaactaaatttacaaatgtaattttagttatataggactgtaattttatattttaaagaaaaataaaaattacatatttacttacataacatttttatcaaaattaaagtgcacttatatgtcatatcaacagaatttacaaatgtaattttagttatataggactgtaattttgtattttattttttactttagtttcaaatgagagtgaggagagagaacaacgcacgtgccgattttttagagcaaataaaaaagagcgactttaaccgtccgacgacgctgttacacgcggcccaactgaatcctatgcgggtttcccagcccaatatatacgcacgaatcttggtacacatcgaatggccgaaaaaacgtcaaatctgagagaaaaaatcacacgacaaatctatagcaaaatcgttttctatcagacacggctgataatcatccaaatgaactgcacttttattctgcctttatgcccatgaatgcaggacaaccaacgtaaccaaacacccataaagtaatgtaaatgtgctccaagaaatttaaatggaactgcttaagttggttttaccgtcaaaacaacaatcacttccattgtgtttgtgctttgataaatgctgaggttcagataagacaagatcatgtgatagctgtgtttctgcaaaccatcatatcatgtctttttcagagataaatgtgggctccacccaagctaacaatacctggaaatacttggcaacggatcagcatccatctttaggccaattgcagaagcaaccctatggatatttctttagcccatcaccattgcaccaaaatatcatttcagagaagcacatgatgtaagcatttttttcagattatttttaccaagtattcagatgattttttagataatggatcaatagctgactctatatccaaaaaggatgcatagtcaagtattcagaagaatgactgtccaatctccaatgtattaaagataattactttttatgtctgtgataaactgtactacattcgtttaaaattaattgtttatctatatttgaccggtgcatcttgaatcaaaggaattaggaggaatttcataggatataaatccttttttttctatttggccctttgatataaagggttggagcttttcaaatcccgtgaaattcctacggaataacttattgcgtgtagattttaaagaaaacttagcaagatctccaacttttgaaaaaaaaaactcttttgagctatatcttttcatgtgattcccatgtttttttcagactaatcgagcgaccattcctgcgtttttttatgtaagtaatcctctgttttgtacttaaatccctatcaaaatcctgtgtttcaaagaagccctaaatttttaaaatttgtgtagtttaacaacatccaaattatatctattattctaaagctggcagtgcctgctgccatttgattggtccgattggaatcacatttatacgtcgacacatgtccagctaaaatgcttagtcgcgattcgtggggaagcagcgcgagcaccgagcaactgcaaagatggttggcaggctgtcgcaggcctaccgagtcgagcacctggatgcccaataaccacacatgcacatgaagcccagccaaatacgtgaatgctttttgtgtctatgcttgtgctatatataaaaatatttaatttagatgatcacaagattttattcacataccaaacttattggtgtgtatatattagttattatgcacactaggcttgtgcacacaattttctttttaaaaaccaaaattattgattcgtcaatcaattgataatttatttttcaaaatatcaaataacaaatacaagtaaatgtcacatcatgccaaacgtatatatgtgcgctcaccgttcatactatgtgctgccctcgcttacactcatttttaatttgtaatattaagggtacttgttttggtaacataaaaacatgagataacacatggaataattagtggccaatngttggtttgcataataagctgaataaaaacaaacaaggtaaaaaaaatatttgcctaaggaaaaaatggatttatcagcttttagcgaggctaaaaagaggtataggtgattcagaaaagaattggcattgggccacacaaaaacgctatatctggattcttattggacaacattagtactttcggctcaatttggagcacttaaaatgtaggagtttatagatcctgtttgcacagcgccatatctaagacaaaagttaaatttgaagtttgtatgataaataatagtgatttaaaattttatattttatctaggatgggaacaaaataattcatcgaaacgttatcgagataatcttaaatctgaagtagtgccaaacaaatgccataatatatacgggctaaaattagttagcgcgtcaacggacgcgcctattttctagtattataaaaatacttctaatgacgaatctgaaaatatgaatcttgtcatgttaaactatatgatttataaaatttgatcaaaaattaaaatgtttgagtgcaaaccctcttcaagtaatttcaaatggataataaggttcagtaatcagtgtactccttttcatcggtcaagctttcgtccctttttttttctactagttgagaagaaggtatcacttgtagtgaggtagattccatttccaaagcctgaaaccgcaatcttgatttatcatctggacggtgacctttcaagaaaaacacccgatcagatcctaaatacctctgaactacaaagtttatccaattcattacatatcaaacagcagagagatcgaatctacatccctcgtacagctcggttacatgtggatccgatgaagatttacataaaaaatattacccatggtccgggtatccatggatacccgacccgatgagcacgggcgtgggagtgactttttacctatgggctcatccgcccaagacccgaagacgtcatgggcaataggcgggtttcattttttacccatggggctgcaggaat

SEQ ID NO: 70097 - DNA, 765 bp, Oryza sativa
taccatttctcttggttcatttgtgatgctaacggatactaagttgtgatcaacttgtgatgtaattcaaattattgttgataaccgataatttggtaagttattgattttatttctctttgttaaattacatatctttcaagttattattcatgtgagatccatagggtacccactggatatactcgcgcccgccgggcatgggtacgggcatggagttttgcccgctaactctagtaggcagtgttcgggtgggcaatgtcgggcatggttttgctctacccgtgtctgacccgacccattgccatccctacacttgacactacaaaattaacctatcagtcacatggaggcaaagcctgaagctaataaacattcagacttcgtgggctattaatatttctggggtcctcttcagagtaagttcagagcgagcaacaagaaggaaggcgatcagctcgttcttcttctccctctcctccagcgacggccatggcgagattaggtcttgccgtgtgcgccgttccttccacctctgccttcttctgtcgtcgacctcctcgctccggctaaaccccacgacggaggacacagccaaccatggcagaagaactgcttatcacttccagctgcaaagaactggcagaatggtaatcaaggactaatctttttgattaatcgcttgatccagttacggattcctgctgattagccaaactaatcccttttcctgtctgatcggtgccgaactctgcgggccgcagg

SEQ ID NO: 70098 - DNA, 913 bp, Oryza sativa
tcccaccccacgtctcgcatcgtgcacccaccattatcagagtaaataatttacttcgataaaaacaacttctctactggcggtatatattctatttttctcgtacccaaccaactactctcgcccccactctgttttttcctttttttttcggatctgaatcgatccaccatcccagcccacagatcagcgacacaccatggaggaggacgacgacaccgtggcggttgatggtggtggccggcgagcggtggccggcggcggttgaggcgaaggcactatttcgagcctcgctgccggacgctaggcaacaccttaaccagcaaggaggtgttcacctgggctaatagcaacaaccaacgactgctccacgtcgacgacattgatagaacaagcaagtaaggaaataacactctgatttgcatctgcatactttccttcaacttcacacatgaagccctaattttttttgcaaatcaaattaacatgcaatctccaatattacctgatctcaattgatgggctgcacaggttctacatttgcacatcgtgctccatgtggctggccgcagaggatagggtggagtccactggtgatggagattgtttgctatttttcttttgctcatcatctgtattacatgaacgagaatgtttttgcattttttttgtgcttgctagatgatggatagctgctattgcgcaacgtcgagctcatctctataccacaccgctacatccttccatgattccataatggattttcggctgaatcatttattttcttttctagtttgattcacctgtgagtaattttatagtttgtgtgtgattgagcctgtaactttttcattcatacgactattttgtgatacagatcaataatactcttagtactagtttttacatatta

SEQ ID NO: 70099 - DNA, 6543 bp, Oryza sativa
ataagcctttttcatttaactcggcactccacagctatttcagtgtaagtagcagtttcatgaaggaaacaaaatcttatttgtttatcaagcacatcattattaattctcaagtatttggttgtacaggcttcaatttctggtgtttcagtgaaaggtctcaaaggttgtaagaccctaaataaggatcccgatcccaaaaaccctttggaggggaaagaagagaggtcagttttgcattttgatcagtcttttgttatttttgtttatattttgttcttctatactacagtaacatttgaaactcccatggtcccacatttttccaataatatatttctttccctgaattgttcactgcattggtggaaaataagagctatattctgaatttctgattcctcctaggtgtgttcattcttggttttaacgggttgggaaaaaaataacatgacgtcatttatttgttcctagatcacatatgtccaatcttggagggttatgaaaaaaatttaatgagcaaccctagttcttgccttgtcttatcttactggatttgtcacttttctagacggtgggcactgttagcagcttggtgctgttggccattgcattgcttgtctttttatcctaccctgtgttgaacttgggaacaaatgtgcactccttttaattgtgtaatatgttgaacacaacgtaaatattagatatacttctcagccacttcatatgatacagggaagaggtgacttttccaggatttgtcgattgcatttaccttggtgcaccgagtgagctcaccctggacaatggattgggtgacaaaattgtgatatcaaatgcgaagtatgctaaattgatttgttacaagaggaatcgtataaactctgtaaagattgcatcataaaattgtggttaatttttaaatacagttggtcagatgcagtgctgtggaatcctcacttgcagatggaggcttgttacaaagattttgtctgtgttgaaaatgcaaaggtatgacaactaatacaacaaatgcacatgaagtttcgctaacaattatagacaccacaaatgaaaatttaagaaaaacatgttgataattagtatgtagttttctctaatgatatgatcaattgctgatgcagattgaaacattacaactggggccgaaccaatcttgggtggcagagcagaaaattgaactgatatgaattatgaagctaaactgggcaaaacaatagagtacaacaattatgttgcaaaaatgaacttctctttttctttacatcatgaaatgcaaatgtcatagcccctaatgtatcatctagtaggtggcataagtcatatttttgaaattgttttatgtaataaataagtaaataaataaattcagttctcccattatttcatcctctcctttttattaatgagcggcctgctaagttttaagtttcaagctctgtttttcgcatatcttgcagtatgcaattggaggctttgagcttcagatcatcttttttttttccataagatgactgttgaagtgcactggaattagcattttgttcatgttttgtcgtagggaagtgttgcaatcagcttattcttctctgttccagttttcctggatgtccatctttaagtccgtgaaatcttttataagttcattacaaacactcttgcatgcagtgtggttttaaagtgaatcacagctcataagatccttaggttcatagattcagccagtgcaaaattgttttctgcactctcataatcatatatcaagactccaaatgaaaattaataatgatatccagcccatttggaaataaaactagttgtgtttctgttaatttcctttctgaatgctggttcatattcttcatacgattcattaccaggagatacttactgcaagcatggacatgctatcatacaatatttattcagcaaaatgtatgttacacttacatcccagctctcaaacagccaaaagtgagagcaacgagcgataaaaaggggaaaaaaaagtaatttacaaaggcaaagtgaagcaagattacaattcaggggattcagtagctaagccgtaagctagtttcgctgagtcaagtgtattcgcaagaagcatcgcaatggtcaccggtcccacaccaccaggaactggagttatagcagaggccaacttcacagcttcttcgaagcagacatctccagttaatcgatagccgtaatcactggttggatcctatgaaagagtatcatgagtactaaatgggcagaaataagtagtgtaaaaaaaaaggggaaagtgcattgatgcacaaatccagaactgcactcatgaaaaaagttcagtaggaggcatggttagctgtctatatcaattcacattcaggacatatcataggtagagacaaattcatacatagaataccaactaaaccggaagggttcaacaagatgctattaaaaatggatgtgctaaataataacaccaataatgcagtaagccagtaatgttgtaaatcaagcatttctgttctcggcccgaactactataaacaacatttcctttacctcaattgggtttgttccaacatcgatcacaactgcacctttcttcaaccagcttcctcttacaagattggccactccagcagctgagatcacaatatcagattgacgggtaatctcttctggatttgttgtgaaagcatggataatactaacagtggcatggtgtctctgggagaaaaaaaatcaaaaatactattagtttgtcacaatactggccttgtaataatgaagaataatcaaggtaatagcttggctttacctgtaaaagtaaagaagtgggcaacccaacaactttgcttctcccaatcacagtgacatgtttccccatgagttcaatcccagactggagcaataactcaaggcaagcctttgcagcacagggcacaaataaaggcttccggcttctgagggcaagattaccaacattcaatggatggaaaccatcaacatccttctctaggctaatagcgctcagaatcctttcttcatccatatgctgatttagccaaaaactagcatgttaaatagctagcttgatgttcattatgtcaatattgaaaatgaaaaaggcaaagcttggatgtaaagtaaactgaatcttaacaaaacatactaaaatgaaaacaaaataaaggatagctgaagttggctgtctattacaatgacaacaaaagtagtttgcattagtcatcgaacaaaacaatcatctaattggtgcaaatgaaaggttttcataatataaatctacaaacttaatccaacttcctgcagctgcaacactagaacactagacagtaattacctgtggtagaggtagttgcacaagaatgccatgaacagatggatcttcattgaatcttgacacagaatccaccactacgtcttccgtacagttcccaggcaactccgccaacaaggactttattccaacctcctcacagcccttaattttgtatcgcacgtatgactcagagtcccttctatcgccgaccaatacaacagctaggccaggcacatgccccactgcatttttcatttgacgaacttcttcagcgatctgaaaccttatgtcttccgcgacagacttgccatcaataatggtcgcagtggagtcataatcaactacaacaaagacaaaagcacaagtacagaacatcaaatcattaacataagaagctaaacgacaataacataaggctccctgtatgaccaatcaatagtgaagaactgaagcttcacagtcttttcatggaaatggaagcgtccacaagcatgaagggtatcaacctagaaatttccctacaacctttgcaccaactaaaccaaagattattgcagccgccaaataaaactactctatactctacagcatggtttcaggctttcagcttggcacaagtaaatctataatttttttccccactgcacctttccatttttcagccttacactagcattcattccatttgaattaacattctgttctaccaatagctccattctcggatgtcatcattcattagcaacaacagcaagtctttcgacactaaactgctacaggatctggaggtgggttcagcaccactaagctgctaatctccaagtgggttctgcaccaatcaagcgagaaccactgaatttaagtatccgcagcacgctctcaaaacccatgtactaaaccccaaaaccatccgaatacttcgaatggcatctcccggcgaaaccactggtcgacgaagcgcacgcctagcaaaagcttcacatcagcaagcccgccggttacctccggcgccgctcgggggagacggccgcgccgcggcgcgcgggggcgagtcccaggtgtcggggatgtccggcccgagaaggcggctgctgctgctcctcctcctccgcctcctccgggtcctccccttctcctcctccgccgccggagcagcagcctcgtggagccccgcgcgggccgcgcgagggaggaggaacgccagcgggcccgcagcggggcgccggcgagtggccgcgagcagggccacggcggcggcggcggcggcgccgcccatctccgtcgaagcggcggcgagcgcaacgtgtgtgaactcggaagcgatgtggatgtgtggatggaggatttgggccttttgggccctcgacaaaaagagatatttttgtcatgattgttttcccttttcttttctttttgaaactttttttgtcacatttttgggccacaggtttgagtttttgatgcattttttctgaaaaaaaaaagatctaaagtagcaggaagatactgtgcttgtggaagatgctgtttctgatgtcattgtcggggtatattctgatgaaatctttgcctgatacttcacaacaatccatcgaaatcgttgtcgatgtatttattttgaatgaaaaatccttgctaagaaaatagagaacactggattgaattgtaaatttaaaattatgttttcttaaaaggttttgaaattaaattaactcgaaaaccaccatatactttatgctcggaccaaaagaaaaaccaaggggtaatatgtttggtgaatgtccaccatgtcaaccatgagtcatcttttgcgtttcaacttactagtcacaatcaaaattcaaaattttacagttagttgattttaatgtttctttattttaatttaatttctaaaacacaaatataaaaagttttatgcacatttttttcccgccaataagcataacggcttatgggcaaaacgatggaactgaagtcatgtacaacactaatgtgaccagttgaggtattttgttgtaaatcatgattcattgatttgaagtaatttattttagcactttattttgatgttgttttctgtatggaaaatgagataattcaacatctttttatggattgtcattatgcaaagtttatatggagagcagttcagttatcttttataccttcctattagcatatctcatattttttatgggcggctgttggggtgaacaataaaaagagtaaacttatattagtgggagcttatgcaatatgttgggctttgtggttgagtaggaatgatatggtttctgacaaatcatcatctattttatatatgcagataattttcagggcaacatatttgctctggttttgggcacaactacaaaggtgtgatgaactcgaagagttcttaaaagttgcacgtcgtaagcttgagacaacggttatgcaacttttgccaattatagatggagattcacaaatagacttcaataatgtgttctccttatcttatattggttaatttttatatttgtgtggtgtttttttttcttatttgaactaaactcattttagagtgttagattgtaacaataaactgtaactctcctgagcagaggccaggacgttatattccattattaaaaaaaaatagatctcaccctctttagaatttattataaccccgtcacgattggatagaaattaagtaatccggctagggctgagaatactcgttagtacaaacagatctcaaagatggtctgaattttagtgagtactctacatgatacattcaaagtcgctcgtaagaataaggtgcgcgcgtgttacgagagtttctttttctcgcctgtctttggaaaaaaaaagttcacccgtatatattctttccgacctgggccctgcaaaattccttcgaagcccacacaacaaaatacgacaacagtcgggccactccgcgagttgggcctagcagcccaacctcttctccgccccactgccggtcgccgcctctcgccgtctcgcgtcgcgcgagctctgcctctgctccggcctccacgccccatcgccgccgccgccgccgccagcctcgttttgcgccaccgccatcaagaatcggtgacacagatgctgtttcctacggagtttgaactttgaaggcgccagccaaccatgctcccttc

SEQ ID NO: 70100 - DNA, 6189 bp, Oryza sativa
ccccccccccccccccccccgcgcgccgcctcggccggccgccgcccggccgccctgccctgcgcccactgtggataagaggaagtgagagagagagagagtagaaagtgtgtgagagagaggagaggaagagtcaagaggataaggttggggttaaaaaaatggtggatttttttaatgtaaaaatcaatttttattttacatgtggctctttaaaacgaatttaaaggcactaacttaactcatatgaaaaaagttgttaaaaacaaagttgtataacttattgagatctatcatttttactttggtcatttctccgtccgagtttgattaaactatataaaatttgaatttaaaaatataagaaattcaaataatttttcgggtagtaaatgatttcaaatgaaaaaattgtcaacaacaaagttgtataacgcatcaacatctacaacttttgttttggtcatttttctatatgactttgtttgaaccatttaaatttgaatttcaaaatatgacaacttcaaataatattttgaaatactaaatgatttcaactgaaaaagtcatcaacaacaaagttgtataactcatcaagatctataacttttattttggtcatttcttcatccgacaaagtgatagtagtattgtttacaaaatttacatctatatcatttggttctataaactataaaggagatatgtaaactttgtgaataatactactgtcactttatcggatgaagaaatgatcaaaataaaagttgtatgtcttgatgagctctacaacttttatgttcatgactttttcagctgaaattaattacagcttcaaaatattatttgaagttttgaaattcaaatttttaattgataaaataaagtcacaagaaaaaaatggctaaaataatagcagtaagaacacaataacatgatagagcatgattttagaaatatttagaaaaaaaaatcatccaatttagagttcatatgagtgagataaattagtttcaaattttctaattttatttttgcatacggcttcttaagtcaaccgtatggaaaaattgatttttccatgcaggtccttaaatggtccacaaacaaacaaatgaaaaaattcaattctgaaaaataaccactcaaatttttaaaaactttcaattgaaatgttcaacccaaaatttaaaatattcaaccaattttcaaaaatttcaatgtgcttacgaaaatttcagtgatacacattaatttattgtttcatgataacataaatttgtatagaaagtaaacataacattctctatctccccttgcccttataaatagagacaaaatttgagaatactgatgttttgtttttgaaaactaatggctacatcccttcctcgttttaagaaggttattttgaggggtcttgatattttgataattattcgttaccgtattcgtttcgattcgtattcgctccgtatctgtattcgataatattcgattccgttttcgtatccgggtttctgattccgatttcgattccgagaaaaaatataaaaacgaatatgatagaggtagtttccgactgtattctatccgttttcatccctacttgccagcgccgcgcgcctcgttttcctgcgcttcgtcttcttcttcctcgcctccctgcagttactgctctctgctcgcctgcacgcgcctagaggctgccatgcacgccgcaactcgcaagcaagggaccgtccgtccaggcgacgcgttcagctcagctatatatgcatcacagcatcagcgttttcgcgttgccttcctgctggccaggtgattgtttgttgcttgcagctggctctgtctggtgccgtttctttttgtcctgcaccgctgctctgctcgactcccctccttttctctatctctgcctcggccatttctgccactgaattgagaagtgatgcagggaaggatggatggctaggtactccaagcagcgtgatgacgactgatgaggaattgaggaggaagacgacgacgtacgacgcctcaagctgttacatttttggatggttcgagctgcagcagcgaagcgccccggccgcgcggcgtgtgagcgtggcgcgtggtggtggtggtggtgcgagcagtgcagtgcagggcaagggcgcgcgcggttgggtccgggttttccgcgcggcaactggctgtggctgtgcctgcagcctggcaggctacaggagtggctgctcctggccggtgggctggaaaagcgccgtgttggtgtgcgggaagcttgcattgtgacagatggaccgcatgccacacgcgcacggcgcactgcactgctactccctgcatgctccatatatacatggcggttccatacctgtttggcttcctcgttcgtatcgtatgctctttcatgacccaaagaagacaatagcgtatgataaatggaatataaactactgtctacgttttaaaatgtttgacaccgttaactttttagtacatgtttaaccgttcgtcttattaaaaatatttatgaaatatgtaaaactatatgtgtatatgaaagtatatttaacaatgaattaaatgatatgaaaagaacaaaaaattgacgaatggtcaaacacgtactaaaaagtcaacggtgtcacatattttgaaacggagggagtattacaaacttaaaaaatgtttttttaatttattttaaaataagtctttataaaaagtttttgaaaaaaaaatcagcagtttaagattcatgcttaagaaaaacgagatagtaactacgaataaagttagtgtagcttaactacactctggtggtgaaacatattcgtatgagttcaaattctaaacttgacacggctgttcgtatttacgggtaattattctttcagtgatagacgacgcatctgtgtcaaaaataagacttctgtggtgactttatgatactcaagatataccggcataattttcagatgtgtttacagaggtaataggcacatctggtgacaccatgaatatgcgcgcgtttatatgagtggatatgtttattgtgtttcgaagaaaagaaaggcatgggccaaatcaaggagctgattcatcgaactgagccaaacatccactactaaaaaaaattcgttgacggttaaaatgggtttttgttggtggctgattgtatcgctagcgaccaaaggctagtgaaaataatgcatttgcgctgacagggcagttggccgctagcgaaaattgatttccgctggcgaccacgctaagacggccgctagtgaaaatcgatctttgctggtagctaagctaagatgaccactagcgaaaataagattgtgttgacggcaatgttaagatacctgccagtgaaaacttttttctaagaacaaaatattgaaaatccaagtccggaacagctaatgagaaacacaaattccaatcacatatcataatcccccgtcacaaatccctaatcccctagtcgccagttcccgtcgtcgagctgcagacgtcgccgtggctgccacgattgttgtcgtcaccacccgccgaagcccacgctcgagccgaatcgcagtcaccgggtggccctgacccgtcgcttgccgaatctaggagagaggagggggttggaggagcccggttgttgtcgtcgtggcagccgcatccagatccacctccttgaccgctgtggaggactgctcacgcccccgccacctgagcaccgtccgccgccggattagcccccacgatacctcccaccacgacgaggggaggggagtggggcagtcgccgccgtccgcgagctgcatgcacaagtaaacctttcatggatccacgcacgtcttgaaaccacaacactgtctatacacgtaaacctttggtgcgtaagcatggtgtgataggatgtcaaaatcgcttcctcttattttcatcgattaatttgagtaccagtataccaccaatcgagccatcagctccaagggcgacgacgtctttacaccatgttgctaacaatctagtatactatatgattccccgtattttgctgcggaaattacaaagcaagttttaaatatattttttcaacaatcaatctaggagtaaaaagaaaaaataaaacgtcagggtttataagtacttattgttaaacaaacaaatgatatctacactttaatgttgaacatgttgataagtaaatattaaatactataaaaaataatatgtatatttgttaagggcccctttgaatcacaagaatgaaaaaacggaggaataggaaaaacataggattctgacaggaatgtaagtgtaaaacagaggattgcaaaacacaggaaaaacataggaatgaccgtttgattggaccacaggaaaaacacaggaatttgaggagagataaagactcaaaggatttcttccatgaggttctacctcttgttaaaattcctccaaaacttgtatgggaagaggcattccataggaatttcatatgattccatagggttcattcctttgattcaaagggctttgtaggaaaaattcctataggaatgaaatcctctaaaattcttatgaattttctttgaatcaaagggggcctaaaatattatggaatgatatgataggtgatgattggatatgcttgcatgttgatttgtagaattaaatagattgtagatgatgttgcgtgcttgcatgaggttaaatatgtattattgctagcaggtgatcttatcaaaaagaaaaacaaatgatacctgcactttaatgtggaacatgttgataagtatatgttaaatctctactattactttgttggtattttggtacgtcatccgtatttgagtcagtttttaaattcgttcgtttttaaaaatacagatctgtgtatgagtaggattttaaattcgtgtagttttcgaaatacaaaataagtcgtataagaaatttctttaaaaaaaacttgcatgctaacttgagatgaaagtcagactcctaattgtagctcataattttctaaaaaaaaatatccaagcgaatttccatagtgaattttatcggtttttaagttcgttcgcttttgaaaatacaaatctatgtatgagtcagattttaaattcgtttagttttcgaaatataaaagaagtcgtataagaaatttctttaaaaaaaacttgcatgctaacttgagataaaagtaggactcctaattgcagctcatgattttctaaaaaaaaatatccaagcgaattaccattgtaaatttcatcctagttaaactgtatatagtggaaatgatgtgataggtgatgattggatatgcttgcatgttgatttgtataattaaatatattgtagataatgttgcatgcttgtatgaggttaaatatgtattattgctagtgggtgatgatggcatggttgcatgttaagctttggagttagtgggttgcaactttatagaaagtatagattgctaagttctagtagtattataacgtacttccaatcttccatatctatagcctataggctagctagtgatccgcaacgacaacgaggagttgtcgaagcgaaagtcgaaggaggagttgtctattggtatcaaggaggagttgttatcaaggaggagttgttcattgataagcagtgattcattttgagcaacaaccccagccaccccctcgtctttagtttcggtgaagacgagtatgtcggctgtgaggtgcaaggggacggtttatcggagctctaagttgacatggacaaagctatcgaggaggtgatggcagaggccatgaattccatgaacgtgaaggcgaccgagcaagcggtcgccgaggccggcgcggaggcagaggcgaacactgtagtaggcttggatgccgaggtcttggagacggtggcggaggcaaaggccttggagacaatggcggaggcagaggccttggatacaacagtagagggcgacatggtgaccatcgtctctcgcccgtctggctacccaaaggctacaacttcggaggaagcatcactagagaagcatggtgcgtaggttagggcaaataggaatgcattgcatgccatgggcagtgaacgacacctttagttagtattcgtaccggtatactactactagtagtaagtcatattagggctgcaggaatt

SEQ ID NO: 70101 - DNA, 675 bp, Oryza sativa
tcgtttggtaaaacatgagctaccctattcgctgacatacgaatccaaacgaccctaaactcctggaaagagctcagcaagattttcaaatcttgaatcatcgtcctataaagcgaacgagtaaagatcacatcaactagtatttgttggactaccattggagcctctagttcactcaccaactgcactgctcttcgacaagccaatatttctgacattgtggcattacaaactgaaggacataagtgagaagttggtactaaaaactcacctatgtcatcccttacaacagctccagtagcaccctaaaaattttcgtcctgaaagctacatcggtctttactttcaaccaccccattggaggtttctaccattgttgtgtcggttgctggaccttagatgccttcttttcattcaagttcgcccattcttccaattggaacataatcctttccactacacaagaaggattctccggtgtgtcaacatgccaagcatcatttctatcaaattttaatttttaacaatccgttcccaaaacatatatgctataggtcatttttaacccgaaatatcacaaattcgtactagtctataggaggagttgacaaatgaatttcaaaatcttttcgaaacactttggttctgtttgtaatgattaataagtggtttcaa

SEQ ID NO: 70102 - DNA, 699 bp, Oryza sativa
atttgctaaggggtgctagctaaaatttatgtggtcatgtggtgaaaatttatcctataaattaccatgaatttcgggttgttggaccgccgttgtcgcgggatgaccttcggcaactgcctctgtggctggtgttggggagggcgggtttgcgccgagcgttgacatggtttaactttcgcgaaaaagattataaatttcctaccattagactaaatagcattagagccaatgtaatacggggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctattcttatccataaagaacaagagtagaggtatataaccactgagtcaatcatgcaaatttaaaaaacagcccacaataagggtacagataaactgttcttattgagcaattcattacttattgagccacaacaggggcaaaaagaagaatagataaaaaaatgaacaagtgtagataatctgttcttattgagcaattcatcactggccatttaacaaggaacacattgggtagcagaagcaggggcaaagatactccacaggggcagcaacaacataaaacaaggaacaggtgtatta

SEQ ID NO: 70103 - DNA, 3851 bp, Oryza sativa
tgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacatagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagatgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctactgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtactagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcatatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttactttaccaaatatttggtcgtgaagaaaaatttggcactaacaatccaaatatgccctaaaaattaataaaatatttgtacggtaacaaaatatttgtacggtaacaatccaaatatgccctacaaaataataaaattgtattttaccagtcttggagattttaatcttgtatagttttcaatataaaaagatttgataactattgatatttatacaaaaatatagagcacagtacaaaatcgccctagcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcccatttgcaggcggccccccgcacagtacaaaatcgccctcgcggagagcggcaagggggccgcctgcaaatttcgttgacggccgtcgcccgagagcgaacggccgtctgccacgtcattttcgccgccctccgggagggcgatttttaaaaatcgctctcccagagggcggtaggcgactacttccgtcaattttcaaaatggaaaattatttttgtaaaacttttaataaaaaaaattaaaaataaaaaaaattcccttccaagcaggtcacggtcggactcatgggtgtactgaactgcaacggcattcccacatcggggatgcgtcgccgccgcttctaggtcttcttcttctcggtgaccggcgaggcagccggcggcccggcgcggctttgccggcgagggctgtaggttgccggcgcgtgcgacgtgctccgcggtgagcgcacgggggctgccgtgacctagcggccgcaccacgcg

SEQ ID NO: 70104 - DNA, 10322 bp, Oryza sativa
cctcccagcaccgtcgccatagccatccctgccccctaaacagttgtcgtcgtcgccgccttccgcctccttacgccgactcccgccgccccgcgccctccgcctccctcctcccagcgccaccgtcatcgccgtcgccgccttccgcctccccacgctgactcccactgccccgcgcatgccgcctccctgcgccgcctccctcctcccagcgccgccgtcatcgccgtcgccgccttctgcctccccacgccgactcccgccgccccgcgcctgccgcctccccgcgccgcctccctcctcccagcgccgccgccatcgccatccctgctccccaaaccgttgtcaccgtcgccgccttccgcctccccgtgccgcctcccgccgccccacgcctgcagcctccccgcgccgcctcccgccgcccagcgccgccttccgcctcctcgtgccgcctctccgctacgccatgcgtcggccgcctcgacgggaaggaaggggaaaaagaagtaaagagagaggaagggggagagagagagaggaagaagaggggggtgaggctgacacgtgggtccgattttatttcggagaggattaatagagagtctgttggagtgagtatctagtttgactagctaaattagatggaaagttggctatatgggtgtttggagaattcgatttggagatgctgttggagatgctcttagagcatcaccaacaacctctccatcccactctccaagccaaattttagacattctagttaaaaatcatgctccaacagcctttccaaccggatgctggccaaaaccctccctccactagccaaatttggccactctatttggctggccaatggcgggccccacacaacccatctcctccatccctagttccccacaccacaaccgcaaggaaggagcacgaggaggaggcgctcgccacaaccgccgccccgctcgccgccgccgccggcccccgcgcggcgcggccgctgtcccgcgcccacggtgcggccaccggcctccgctcgccgtggccgcccgcccctgctcgccgcggccgccgtccccccgcgtggcgcggcccgccgtcacccgctcgccgcggccgctggcccccgctcgccgcggccgcggccgccgtccgccgcacgccgcacccaccgcctccgctcactcccagcttgtcggcgccgcctgcttccaaccaacgcgagaaaaaagagaaagaggggaaggaaggggagaaagaagaagggaggggctgacatatgggtcctgatgtcatagagtcaaagtagaaagggtagatagagaggctgttggagtgaacaactagtttgactagccaaatcaaatggagagttggctatatgagtgtttggagagttagatttggagaggctgttggagatgctcttagaaaatactacaaatcggtagcctgtggattggacgaacccctgtcactgtaacagtgacatacatgcctagccgttttttttttcattctttcctcatctctttaaatattttttctcctaaattatttatccgatctatgaaccgatcacaccgttgtattcgttgcaattaaatctttacaataagatatcacatgattatattatgtcaaaagaaaaacatgtgtttcaaaccgttataacaaaatgtttcatacgtgatgaagcatctaggcccccggtgttaattttggtaattcatgacaagcactaattgtggactaactgttgtctttgagctatatattttaagttaggttcacatcatgtgtgcgcatggatgattatcgatgaattaaaattgacggcacaaagcaaaaggaagagaagacgataaactagtgttttcatttttaattgatcgatgcgttgggcgatcaaaattatggtagtttatttatagctttgccgtactattaagaggggaatgacctagcaaagagatgattttaattgccacattaggtcattatgcattaagacgtgtgctcgcatttagactccccatatttcaatttacgtattcactgtgtggcctgaccagagccggtctgaccatggcctaatggctagtctgaccggcctatgcagccggcctgaccgcagggtcactaccggtctgaccgctgccacatagccggtctaaccggcaggtgttgcccggtctgaccggccggtcatatggccgggatggcatgctctgggatggccaatcccgagccgccggagccgtattcggtcagaccgagctggtggcggtctaaccgagccgaggccggtctgaccggccaccccatgtcggtctgaccagtcgaggcagtggggcccaatgacaaccctacaacggctagttttagagcacggtctgaccggccacatacctcccgtcagactggcagagcactgagttgggggatttcgcccccaacggctagttttggttggtgggagtataaatactccccctccagcagcaaggggactctcttggcacccaattcaattgtatacactccttgcacctctctcacacacctttgagcttagtgttcatccattgtagtgattgaggttgttctagccaagagtcaagtgcattgtttccatttgtagagctagtgtggcactcgattaatcatctccacgccgggtcattgtttgttactcttggagattgccgcctcctagacggcttgtgaaggagttgctcggtgacctctccgagaagattgtgaaggaggcccggtgccggtttgtgagtggtttggagttcaccaccttcggagtgaagaaagaactaccccgagtgatcgaggcttgggtagtcctctccgtgggccggctcccgccttgctcaccccttgagaagggggcgtgcggtggcttcgtggttgagcggtggagttgggctcgcctcaacggggagtaggaaaccggcgagtttccgaacctcggtgaaaaatttctggtctcctttttctcatttgattgtctcatttacatttgtgcaatttacatttctagagactttcttgagatcatatcaccctaggattgctaaacattgatataggagtgtaatttactttactagagatataattgagccactatcaccctaggtttgcaaaacataacttagttgcttagttagagttgaccctcaccgagcctaccatcttaggttagttttgattaggtgtcatttaattttaaatcgcctattcaccccccctctagtcgacatctcgatcctacacgtgatagtgatatgtttcaatatgtgtcttcagtgtgtttcacaaaattcctgaaactacctattactactctctctacctcatccatgcatacatatatgtattttagcaagtttcaaaatgatttttctcttaaattacttatccaatctatgatctgatcacattgttgtattcgttataattaaaagataaacgcatgtttcaatccgttaatatttattgtttcatatgtgacaacgacatgtttcaacgtgtatcttcaccatatttcataaaatatataaatgtttcagttgctgattttttttgtttcaccatatataacttaacgtttcacttgttggtcaactgcaacatttgaccgtcagatatttttcgaggcatcggacatccgatggatagattcctccggcaaaactcttctcatctatcccttcaggtcctatttggtagagctccaactcctaaatttagctttaggaattgggtttggagtaaagttgtgaagctgcctaaacccagctccacatctctagttcattttgtgaaaaagctccactcaactctgcttccattttaggtggagctgaaactgtttggctgagctctaactctaggagaggtggagctggagctggagctggagctgtaccaaacagaccctcaatatatgcatatgagattcactcatatttcccatatgcatacattaagggagagtttttctcacttcttctcattcaaaattaaatttatactcattaagaggaagcgattttgacatcctatcacaccaagcctacgcaccaaaggtttacgcgtacagacattgttgtggtttgcgagacgtgcgtagagtcgtgaaaggtttgcgcgtgcgtgtgactcgcgcacgtaaacacatcgagcctatgaatctatgggtctttcaaacatgaacatatcaattcctaccgtgcttcgcgaggggcataaatggaaagcgagctcaacccatcaaggtccatgtcgctaacatatgtaaacgattttgttcatagtgcgtgcatgcagaagtggggggcccatcccacaaggtggtcttatcgctgtccctccaaacaaaacgaccagatgtgacgggctcatgtaccagctgacatgtggaacaggggatgcaagtttcaatttaactgtccataggcccaactgtcagtcaccgcacgtgtcccgccacattgcttcaccgccaagtctaagcaccgggccctttggtgcatggcaaagttgctttaacaaaagaatttcacttttccaacttttaactctctcattttatatagaaaaatggctttaccaaatcattaattcatttccaagttctttttcccttactccaacacctaattctagctatctatctagtatagattcatcgttaaaagtagtcatatattatatcatattccatactacttagagcaagtacaataaaattttagctagcgatagtgcatccacgctgacgttatcgatgaccaggataggagagagggtatgagccggcgactaattagtcgccgactgcacacgagatccaaggcgaaagaaacaatagaaaagagcaggacgaagcgatggcgacgggagcaggctgtgacgcgacatgccaaattaaaaaaaatgatatattaatccattgaagcttgtgcttatagccggctgctgtatgtatctagctttttgctgtctccactgctgacgtattcctttttaccaccaccagccatctgttgatgtaaaaacacgaggcctgggagatctgcttaactccagtgcaggtccaaagcttgcttttagatgtatgagcgtgccagttgatttgatcctgcaatcaacaagaaataaagacagagaaaccacggttaaatccataaacgatagtcgatcggctagttgccgatgttgtatcatttatctttgagccgatgtcatatttagatcgatcggcggtcatgaataagtaagaaagagctaaatctactcgatcggctgtagatattaacaatatataatccttatgtcgatatatacttaaatcaagtgattgggatagattggtcaccatgccgagacagtataaatcacttagatcgaaatatatactaacaacgagactatatatgttcatactatagccgatcaaatagatctagcatgtatcggctaatactccgataccactctatattaagatattaaagcaagtagaatatatcaaatgaaagccaaatatacttaaatgcgacaagatcttaacataaagggcagatttaacatgtcaatcgagcatataagataaatatagttaaatcagataagatcggctgaaaccccgatactaccctaatcggcaaccaaaagcaggctagagattgagactctaatcacgacttataaggtcaaactcaactgatgcagctataagtatgaaaagaaggacaatatctagacaatcaagccgttggatgttttatagagtggtagatatcctatgtaatctaagtcaatgtcggtatttaacctaatcggctgtcttctagtaacagacgttagccgattgacggttagataacaatattgccagagattacataagatatatgataactcgaattacataaacaagattagagtatcataaagatggaagcactaatcccgagaacgcaagccgccataacaagttttacctctagttgaagatcgaaatcgatgcagctcaacccaaaagtaagaactcgtcgaaacagaacgaaagtaaaaagggtggcgatgcgccgagattgtattgaacgtgtgttagattgattacatggggctcagggtctatttatacccgagattacaaaatacgtccatgtcggacacgactcgcatttctaacaaactctaagataccataagtctttgcggcagattttgcccaaacatatctctaaggaaatcttatattatattatatattaaaagtccattaaacttcctacaaacgctcctaaaccgccatgtggtatcctataaatactcctaaaccgccatgtggcactcaacaaataaccattgatttttttttaaatttggtggacccattacaaccattagatttatctttttaaaaaaatccacctcctaaatcgatccagccccaccaagcatctaggtcgtaagtacgttaaatatgtataggtacgtacgtatatgtataagttacgtaccttctcttccttcgattccttccgtattccaccaattcctttttaaagcaaaagtttatattaacaaaattaagtaacaacaatatctaaatcatacaactaactttttacccgcgatgtctttgtgctcctagaccactgtggcattctacaatcccattatcgattttcatttaaatcgatggacccgttattttacaccatcaaattatatctatttaaaaagtatatgctttctatactcgagataatccgtttaccgaaaatatttatgtacgtacgttgaataagaaagatatacatttaggtaatgtttattcgaagagaaaaaacaaagaacatagtacatacgataaaaaaaactgtaaaagcaaaaacaaacattaatatactgttcgcctagaaaaaacaatggatatttatcatctacacacgattaaagctctaaaggaaaatatatatatacaacgttatataaccattgaggccttttaaaataggatcttatatactataaaaataaaatttattactcttacaaacatggtcatttgctgcttctactagcgctcttaaaccgccatgtgacactatttaatttcaccatcgatttccatttaaattaatgtaccccgcattttatacctttacattacattacctcgcttccttttaatctcctttttatccgagtgaagctgtttaccggatgtttgaaaaaaaaaactaaagtaacatacgtacataccattaaaatgcatatatatatgttcgtacaaccatcaaaaaaaatatagacagttctcaagataggattttctacactgtaaaaccaaatttattactctagaaatatgcaagttaaactagatcaatataaatatcaaataaatatatttaaacacccattttttaattatttttaaatttataagatgaaattataatccattgtattcaaatgttgatgacttatcatagttatattatgatgctaaatacattacaacacatggagataatatataataattaatattataataattttcaaataatttaggtgacatataataattaatttcatcataatctttgaataatttcacatcatattttgtggtgtcaaatatcacttggcaaatatatagtacactaactgaaatctacatgtgtgaaagcgaaacaacattatgttttgtcaattatatatgatttaattttaatttatggagactaagattctcaaatgttttgtttcagatttttcaaaactatttcattggtatttctaggcaataattttgctataatacgaccccttaatccatacctttttccatattggtttggtaaaaaacgaaaaatcatataacatgtgcattaaactactcatgataatatattttttttatagtcgagtaactctaatatatcgggcataagtgataattgatagatgtatgctatatacactccaccgacgtgactgcaagtgccctccaacaaattagttattgtaaataattttgataaataaataaattttaaaaatagtaaaggtgtatgatgcaattacgaacaataagtgacaaaaacaaactagaagctaaaatataaatcttagtcaaaatataaacaatgatatgatgatatgatacattgaagatgattacggtcatatatctatttagcgatacattttttaatgatcaacctcactcatttcaaaagagaatattgtatctataccataaaaatttgggcagtactgattaataccataaacaaattatgactacacaaaacatgaaaacaactattttttatgtgaagaattattttcattacatccatttattcttgctttctctaaagggcattgagcagcttttacaagtataggaggggcatacatatggttgagtcgaggtagccccagtggagaccaccgttgacaatagtgctcaacttcctacttactaatgcaatcgtctttgagggtgttgatagtgaattaagccttaaaattacattatacgctagccttgagaggcacgagtatgtcgatacagaacccatgtttcaaggcaacaaagaaaaaaaagagttggtagctccacctgttagagacgacattcatatctaattggtaacggtgatatcccattaaccaatagaagcatcattttaagaatattatttatagatttagaaataagtgttgacataaacaatgttatgtagtggagacaaatgtgttatgtattaataatgtattaggtttattttggtggtgaagatgcaatttcatttattaaaaaggcatctagcgacaatgataataagtaatggtgacaataggcgagtttacataatttggacaaaagtgattttttaatataagaaacattcgtttcgtttatattaaagtatgtagtatatttcacggcatagatttttgttattatgaggtaaaatatacaatttcttatatgcatatggtgagacatgatttaattctccaaacacataataaataagatgcccacgcatctgcgcgggcttccttcctaattacatgaaatatcctaattaatatatacaattatcttctcaggactctatacatacatggcaatccttatgaagcacattaactcaacccgacaacatatgtcgtgtcatattatcggattcggctcaatcagctaaccttgtccaacttggactctgtcgatcctggtcgcagccgattcggactttagtccattcttactctgtttgcggaacgatctccatcttgaattctgcttcgactttatcaccatctccgatactcagattaccaaatttggttgttaacaccatcgtcattattaatcttgctcttagtccaattatgatgataattaatgatgtaccctatcctactatattgatgttcatttgtccagaggtgcaacgcattgttctctgtgtcgcgaagtaaaagtctaatcaatgcctgcaccctacaacattgcaactcatttgattagacagtggagtgttgcgacgcatcaagcttgattcgatctgggaggttgggcaccagcactagtaataatatggttgtttttcctgatcttattgttgtggaagcttctctctcctactccacacacgcagtaatttatactcctatattgccacgtacgcatgccaaaaatttaagggagaacgtcccagaatgaaatactctgaagagaactactcccgcttcttatgtcagcttaactggctaggagtagaaaattactcctactccaataggagtactttagttgcgggaggtgaattgtgatttgtcaaatcagtaaaatcgtgattattcgaatcaaaattactcacatcagcctacaccaaatcacaatcgactataatacagtcaaaaacccaaacaacgtactatacccacagcgactattgcgtaaatgacgatgtgctcgattcggcaccaatatatacgaaccgatgtcacgtaacccatgaacctctcgatatgaacagtgctagcggcaatagggtacgtaaccatagggcaatcatgcgatacacatgatgtaaaataaagtacgataaatacactaccaattcatcttcaaggttaagatttaactaaaatccaaatttggcttataagcaaaagcataattaccatggttgagcctatcatacaatgtattttaaattagagtagtagtagtacaaaagagaagggatatcatcgag

SEQ ID NO: 70105 - DNA, 539 bp, Oryza sativa
catcgtcgaggtcctcgccgcctccccgtccgctccgtgtgccagttcaagtgcgtgagcaagtcctggctgaaagaccaagaacagctatagagggggtgtgaatatagcaattcaaatcttacccccgaaaatactcatcaagccggatttctcaaaaatccttactagaaccgcggctattagagaagccggatctagaaaagaagagagaaagaaattcccgaaactagaagagaaagagaaaaggaatttcccaaactagaagagaggtgaggaggagataacaaaactcatcatcgcaaagtttaaattgcaagtagaatttaaattgcggaatttaaatgaacaaggcaaaaacgaaatccttcaaatcatttcattcaaaggtgatgcaaaataaccgctcaactaagagcaaacatattccttcagaggaacattaacacaaacttaaaatctctcggacaaacacactccaaactaatcctaatacaaaagcctctcgggcaaacacactccaaactcacaccgaaact

SEQ ID NO: 70106 - DNA, 4728 bp, Oryza sativa
  unsure (1)..(4728): unsure at all n locations
agcgatactaaatgaagaccgctttcttggccccagaggatggagcatgtctgaagtctcaggaaatggacaaaccaagtcactgaagggtcagattgtagggctcatctatgccacacagttcttgaggatgccgttgatagcgcttaatgttcttatcattgttgtgaagttggtatctggctgagactgcaggtttcagttctggggtttgatttaatttctgttacagcgtaatgtaaaagtaatcacagtaaagattgctgcagttatgttaatttgtctctaatgtatgctgttactgttctagtaaattaattctgagccgcaaactgtttctttggcacataaaccatgagagtatgtggtctggcgatgtgttgtgagggctccttttccttatttctgttctgaatcaatcacacatttgtttgcttgttggtgtgtgttatgctcaggggttatctgacattcagattttcagccttcaggtgccgtttttaatggaaatattacctactatggtcatgccttatgtccggccttaattgagtattatctttgccaattgtatacatgattcccagagatgtatttttatccaccctcttatattatgtagtttattttgaggaatgttttgtagtatatggccatgctcaattagctttaacattgatcaatgatatcactgccatctgttattaactcatcatggacttgtttaacttttagataactagcaaatatgcctatgcgttgtaaccggtgaatataaaacaaatacagatggttaagattgcatgtgtacttataagttataacacatgttcacaaaatctcgaatttgtacatatctcgcaaatacaaaagttactgcaattttatcttaaaataatagctcaaagtgattaaaaattaattctgtaaataataaatggtatttttggcaataaagggaaatgaataaggcccgaaacctggcggtggcccaaaacagtgtacgccagtatgataattcacgaggcttggtcggcgcggctcgttaagcgaggacgcccttcatcgcgcacggaggcacgtgtggcccgtaacgcgtgcaggcagtcgagtaggccacgggcgagcgcgatggcctagacacgagcgaacgtgcgcgtaggcctattagcctgtgtcgttggattgtaatcaacggccaggattgcttgcggcagtgtgagtaagcacgattgatgagtttatacatgacactaatttattcagctcatgtcattttgaatataaatgatatttttttccagtggaataataattgatcatctagggaaaatgttgagttctgctgattgcatatgttgagttgttgcttctagggaaaatctacttgttgtcaaaatcataaaattctacaagagaaaatgatataaaatacgttagtactgtattcttttatcttttttatattcaagtaattgcatggtattntaccntgnacnaatcctttagcggtgtttgaagaggtttctgaattcttgtagtcctccatgcattggtagaaagtttttaaactattttctgattattcttttaatattttttgcataataatacatacattattgccttgcaatccaatgcaacgagtttggcctacatgttgcatcatattgtgtagctgagtcccccccccccctccctgcccccggaaatgttcatattagtagtacatatttttgaatttagttacactagcgaataagttttttttttctttacaagccttacgtccgaatttagtaagccatatttgtcagggttatggataacacatacccaataatagtcgactaagtttggcggggcctacaatatacaagtcttatacggaatcatatctcgtatatagaaggagttccagatagagaaggacaagtagagttctacatgaaaactataagtactattcggatcatatctatatttgtctttctaattctacttggacaaggaaacatttatacaagaccccctaggaggagggggagggagataagccagcacagaccaacacgctcagtcagaatagacaccaatacgtgttgccagatatcgacatgagagattagcctagacatacccaatcaggcgcctacagaggccgacgagggatctagcgttatctctgatttcgccgagtacgtattcaaggaggaagactaccccgtcgttgactacgtgttagtgttccatgtcgtcaagtcgacgacgactagataggttatcccaaatattgtacctgtgtgattctaatgaataagagcaacaccggcttcgaccagtaggagtagggcttttaactgccagttaagggcccgaatatgtataaaaatccttgtccctgtctattttacctctatatcgcacgtactccggtaccaacgatcctataccatgtaaataccgtagttatgatctaaaacatcgacaatattcatcatatagcatttgtccaccataagaataagatccttgtaataccgtagttcctgaaatatcatatgaactcaattagtagagcaaatccctgtctcctgcaattgaaaatgaaataatagcctatcaataagtatacgaagagaaagagaaagagagagaagaggaagaagaggaagaagaggggataacatgtggaccccacataatcagtgggtcctacaatttttctttgtgtgaatgaaaaatggatcccatatatatttttttaattctaataccacctaaacaccacatcaacgccacgtgggacaaaaaaaacaagtcaacaccaccatgcaatctccatgctagccaaaacactcaccaaaactaccgaggaaatcaaattacaccgatttcaatagttcggggtcgagatatgtggtaatgtggttcatggatacgaatcggacccactagttaagggagcaaaagtggacctggtgttggcccagtgaattttatgtcttgtggatggcccattaaatcccgtccattcgttcgttttgatcctacggctggatgatgtgaaaccctaggaagaaaatccgtcgaaagataaaaagtggagcagtcgagtgtcttccccttcctacattccctcggcgtgaaagaaagagagaaatcttccccatctcgtcgtctcctccgctccttgcgcccaagacgagccgcggctgagcaggggaggggcgcgccgatctccatccggcgagcagagcagggtaggggatcctggtgagcacccacatcctcctcctgatccatctctccccctcccaccgggacttaacttttgtctggaatttgcttgcgttcgttaaccctagatctggaagaagctcttctcttaatttcagagccttaacctgtatagcagtttgtttgttcgttcccccatgtcccaagttggatccgcccttgcttttaggaattctcatggtcaaatctcgtcggatcgaacgattctaaggcttggaaagtcatttgatagtactgatttttaatttgctagtaatgggagtttgggggaacacaaatgcttgtgtgtgtattttgcgtctattatctgtgtgtcagctcggtcatgtgatgttgggtggatgattcatatactcaggctcaggctgttgcagttcatccaacttggattgttgtgcctcgtgtagttttttcagttaatactgttgtacttcatgctgctaggatgtgttaaacatgttgcgattgcattggttaccatctattggttagattttactatcattaattattgttgtgattgttatgaaacttatgactgttcatcgaatgtagaactctgcaaaagacttgtgtctcctatatttcatagtatgctgaattagccagtccagtatttagagagtgatctatcattgtgtaaatgaatcttgtagtagttgtactggtacattgcgtttcatcgtgctaatacaaccatttcccagttactactgcaatggtttgccatctgaaattgtttttgccaattgctatcgtgttccttatttgctatccttccttttgtattcatttattccatgatgtcatcaatctgctaggctgagtttatttatggcattgtttactatgccaagtgtgcacttttgatgttggccagcaaaatcccagttttatttgcttatgcatggttacttctttactcatagttatgtcgcacttacgagcttctgttttctatttttcctgagtgatagtctccttgtctatttagctatggttacacttttgatggatacggttatgctatttgttaggtccatagagtttctcagtggtgaaaggtttgatattacagtagtaagcagttgagctagatgtcacattaatccagtatatgctgaatgcgacaaatgtgtaatacgtgcttcagttgtataatggtacggactgtttgttcagtgtgtctgatatattagagctttcagtatgctttgtggttttcaacttttgctggcatcgtaatgttcactatcccaatattttatacaggatcatgcaagtaaaataaaaatagatagattgtttactttgtcgatggagtgaatatttatgtgattaagtgatttatagtatttgtttgaactttggtatcatatatgcatcagatatgttgtatattgtatattttacttgcatttgaattat

SEQ ID NO: 70107 - DNA, 1921 bp, Oryza sativa
agctccgatttctggactaattatgattggatgatcgaaaatgatgtacctctgagttgaatgatcaattgagctctctgaaaataaggatactgttgtttttgctttggaaaactctatgaatcatactgctcaatctatgtatggaactggagtatgtcttttcatggggttgtggattagaatgctggacattttttgaaagcattttcctggtggcctgcccggaatccaggcaactacggtggctgctactctcggctactgggcacccaaactgtctgccgctcaatgaagtctccttccatacttggctatgcaagtatcggaagaccatatcggaaaaacagcggcgaggtttcgacactatcgtcactctaggagcatggtgaatatggaaggagcggatttcccgtgtgtttcgaacatcaccagcggaactagactgatgttgccaaggcaatgacggagaaagcaagctttggagattggcgagggcagctgtccctcatctaaagtctaggtctaggtagcatcatgtcgctgggagaataggattgttttcctcccttttttttttcttcttttaccccgtctcagcccttcctccttttctttcttcctgtgactatcttacatttgttttacttctcttcatataaagatgcacaagttttttgcgtattcccgaaaaaaaaagacatttctccctctgaagattaaacattttctatggttggctacaggattcagtgtacagttcagttgataaggagaaaatggggagattctacttcaggcgtgtttgtgtgctagatatgaaaatgcaaaactttaaattggtgcaaacctagtggcttctctaaattattatatttgacttgcacactatcctttctccaagtacaaatgtaaatttcctcaaaaaaactgtagtaattaccaatttaccagtaatgcgctgtaacctttctcaaatagacaacatcttataattcataccataaatctctaaaatatggaaaatatattgatatatattatgtgaaaaacaccattactagatttgaatatttttgaaatgtgcaattagaaagcataatgaccaaatatgtactttagaacgtattgatatatcctagaagacaagtaaaaaccacataaatgaagttttaattaattatacctcaataaaaataaagtatccctctgtctcaaaaaagaatgtattttagtttttggttttgtatttttagttgtggggtccattatacctcttattatcactttatctttttcttcttagtttagccatctagatcttgtttggcacagctcgagattagaatatcttagagttgggtattttgaacttcataaatcaatggatctggatatgtgattatgctgataacattagataaatcattttattcttattttatttgatattgaaaattttaaaccactatatttaacacataaactttaaatctatagtagatctgaaatttgaagctatggagttatgccaaacatgacctttgtactacctcctcctcatttttttttattaatgaagggtatagcatttttttaggaatgctaccagactccattcggacaggatgaaaccttagaggtgtcacctgatacctcgacggtatcctgttcgtacgggatgatacctcagagatatcgtctgatatagatctcttcctgaaccaaacatgaatctttcaattcatttggctctcacgctccctttttttctttttctttttttgctatggctacttccattttttttatgtaatgagcctatcctctaccctctcttttatgtttacatttcaatataccgcaacccatataatactagataaatattaagaggataaaaatctatcatgggcaacaa

SEQ ID NO: 70108 - DNA, 652 bp, Oryza sativa
gttcccgctgctgtagaagatgaaatggaatgggatcaaaaccaaagttgttcgtcatggtgagatgagaatggaacgagtatgagttagagatgaagagggctcgacgacggttggcgatgtccctcttcttggcggccggcgacgaaagagaggtggagagggagagctggagcttcctccctcggttggatcggcactggaatggtgggtgaagaatggcgacgcagctgggtggaggtgaagcctcggttcagcgctgccacgtcgaggccacgcgtcgtacacagccggcgccaatctctctctctcggctgtctttggtccggctggaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatatcaagtatttaatttgtgggtagaataatttagtgtggatttttctgaaggtagatgaagatacctagattccattttctttggttgcactcaaaaatatggattgattactcacagacattacaggaatatgggttctttggaaaatagctcgaatttttaggag

SEQ ID NO: 70109 - DNA, 22483 bp, Oryza sativa
cgccttcgtcctccctctcggcatctctcccgtgcagcgagttggtgtgggcacaggagccgcagcggcggctcctcggcgcggtggtggcgcggcagctccactgcacatgcagcggcggcgccgcggctcctcggtgcagtggcggctccttggctaggccgtgcctcctcggcctcgtcgtcgctgcctgctcagtggctccccggcgcagcggctcccccatggctcgggacctccacgacggtgaggtggcgaggaggaagttgggtgaggagcagcagaagcctcccgctcacccctccttcctcctctgtgatgttggattatctcctatcctggaattttttttttagctgatttcgattggattgggttagatttgtgatgatttgggattggtcgtgggatcttcagagcggatgaatcagagggaggaggtgcgcaatgcatggactaagacggatttgtgcggtttttattattcttctcgttcgatttcgcttcctctacgttctatgtttggttagattttgtattcgattgaatttgtgtaatatcgatgtgtggcgcgtgtgggaacggagggctcgattccgattgggattgtgggggtgggggtgggggggaggggattgcgatggacggatgaaaaggcgaacgttcgaggtgacgaacggaaaaatccaaatcttttaattagttaagatttaggttacatgcaagagggttggaaacactttacctttttctagaatataaatagaatagtatatactcctatatcgtatcaatagtaggatattaaaagtttcattattaggctctgttcgtttcctggagttcccaactcccccatctcattttccgcgcgcacgcttttcaaactgctaaacggtgtgttttttgcaaaaagtttatatacgaaagttgcttaaaaaattatattgatccatttttgaaaaaaaaattagcaaataattaattaatcacgtgctaatggactgcttcgttttccgtaccggagggatgggttcccaactcaaccaaaagaacagagccttagtgtttttcacgtattttggtaaaataataggacgccctgtaccaccctatccttcaaatctgtattagcgcactctgcataataattgaggccatatttctcatagtagcttgcttatatgaaagggtacctggaggtaaatctatatagaattttcatgtagtggcggagccaaaaataagatttttgagcccagacaaactttaatataactagtatttgagataaaaatttcaacgtcaatttacttatcaatctaaagttgtgttctcaccaacgagcctgggcggccacccggactagccactgttttcatgtgggataaacactcggacctaacggtttaaaccggaaccggaacataaattaacatgctgaggtattacacgtcccttgaacagatcaaagttatatgtacatgcaccatttaaatacgtactggttttcaaatacatagcttcctaaaatccgtagtcaaaccttaaaatcttgaaacattaatatgcaaaatccattatactgaatggtcttaatagatttatcatgaaaaatgataaggactaaattaaacctgtccattaaagatgtgtccttgcgaaagggcctgtagcctagtggttacaagagcctcagtagcacctgaggtcctgagttcgactcctcctgggagcgaattttccaggatttaacggcgttgtgctttcagtggtaggcgacgtacccgtcgacagcgaggcgcctgtggtgacttcgtcaatctctccaggatttgccggcccagtcttcgaagatgctcgtaagggtagagtttgcgtgcgtagagtttgcgtgcgtgcgttcataggggtgagtgcgtgtgcgttgtgagtgtctgcgttgtactgtgtaattctcaaaaaaaaagatgtgtccttgtctaaaagaccatatctttacctattataaaagtttaaaatgtttttgtctacttttgcacgtcgttccagtccgattccggttttttcatccggctttccagagtctgtcgcgagcacgtacgcatagccgtccgaccgccggccaatctagcatcactagccgatctcctcaatcggagcttcccttcctattccctctcaccaccagctccgccttgctgagaagaacctatttctctacgtttcccctccatctgccgccaccatgaaccacaccggagcctcctctctctcctcgggacagagcttttgccgaccgcgttcccaacttctccctcaatttcactgtttgccgccaccttcccagggtacacagcgagtgggaacacgttttgcctccgacgtcgccgcctcctggctacaggagcgccgccgccctgctcgcctcccctctccctcctctcgcctctctgaaagaagaaagaagaacggagggaggaaggagcagagaacgagagataaaaaaaaatactgacaggtgggtctctggacagtgcattttttctaaatttcatccgtcttttttttcgccgtttttccttcttcttttttttccatttttcttttttttctccgtttgttttttttcctttctttctgttcgcttttttttatccgtctatttttttctttctttctgtctttttttcgccctttttcttttttttcttattttctgtttgtcgtccatctatctttttcgctgttattttatcggtcttttttcacttctttttctgtccacgttttttaaaactttttttcgtcgccttttttccgggttttttcatccgcttttttcttcgaccgaatttaacgggaggatcgattttggcatgtacggacatgagattatcttccggtggttgaagatggcaatcgactatgcgagttggatctatatcacgggggatcgctaactagcgattgattgtcccaggcaatcgtttttttcaccactttttcttttcttcaccatatagtttttttagtttatatatccaaagtttatacatatagggtttacacatcttttataggtcaaaagttgatataccgatttaaatttgaatttgaattcaaatacaattaaagatgaatttgaatctgatatataaacttttgacttataaattttaggtctacaaactttaggggtataaattttagatgtgtaaacttgatttattgaaatttgaatttgaatttaaatacgtttaaagatgaatttgaatctgatatataaacttttgacttataaattttaggtgtacaaactttaggtatataaattttagatgtgtaaacttgatatgtataaagttagtaaaacagaaaagtagagcggtgcaaaaaaaaatatcgcgtggggcaagggaaccgatcgcgccataggagtttcgtatagctccacttgtgagttgggtcaagaggcaggcttgtggattgggtcaagaggcaggccaaataaaacgatgtagcgggctcggctgagattgaaaagtaaggaatgaatgaatttttggttcaaaaccaaagagtaaaatgtacgataataaaaaaaaggatgaaataaacttttggtctaaaaccaaagaataaaatgtacaagtaatccaaaaatattttacccgtgcaacgtatgagcatgttttctagtactacattaatcttcaaaggagtggcacactggcacaatacacggacgattataatttctcagtaaaaaagaggccattccactccagtataatcttcaaatgagtggcacaattcaaacgcacccccatccttcattacggctccatttgctcaagaaacacgcgttcaaggtcaccggccatggcagctcgtacggatacgtcactacaccaccggcgtggtgcttgggctcatcgatcttcatggtggcgagctcgatggagatcacccgccgccgccgccgccgcttgtccacctccgccggcgccaggaggacgcgtcctgctccggcgtcggcgatcaccgcattattaccagcgatgatgaagctctccggcgccgtgtgcgccggtagctggaggcgcttctccatccaccactgctccctgcgacgggcgaagaccgaggggacgccgctcatcaaccaggcaatgcgcacgtcgccgtcggcgccggcgacgacccggaacgccgacgacgtgccgtcgtcgcgccgccgggcgcccttcatcgcctccggaagcgccacccgcgagaacgtgctgtaactgtaagtgtaacaactatgaacaagcatgcggtcgccgtcgtcgtccatccgccagtagaagccgcccgatgcacgccccacgaagtggacggactccgcgccggagatgtgcacgccggtggccctgcccgcgagacgccagcggctccaggggcggtcgcagggccagggccacctctcggagccgaagacgaacgccgtggcggtgccgaggtcggcggacacgccggcgtacccctcttagagggcgacgaacaccttgagagtgggcacgggcatccggctgcagacgtggtggtagtggtcgcggcgcaggaacgcgccgatgcagcggtggtgtttcatctcctccaggcgagggatcagccggtaccgccgcgtcaggggctcgcagacgacgaggtccgggaagcaatggcgcatccagccggacttcctcttggcgaggaggaggaggctgccgctgctgtcgacgagccgccatgaatcgctgtccgggaggaagccgagggagaagtggcggccgtcgacgcggggctggagggagggagaggccgacggaacgaagactgcgccgccgctgccgcgtccggggtagtagtagtggccgacgatggggttgcggccgcggcggtggaactcgaccgcacggcagggggagccgccgccggcgccgatgatgcggcgccaccgcttgcaggtggcggccgcgcggatgaaccagtgcggcgacgcgaggcggacgaggacgcgcgtgaggagagcgtcgtcgaggtcgtccacggtcgtcgcacggcggcgcagcggcctcctcgtggacgccgccgccatctcgcgacgccgcccctgacctcccgcgcgtggtacccggggggttttggtgcgctttgctgtaatttccattcagttacgcactgatcacggagtctttgttacaggattttttttgtggtttttagagagaaactgatcaaatttggatgaacgattcgattacaacgaaatttatttgaacctccgagcaatgaagattgaaggaacaaaatctgatatcgacaattggcatttctttcattgatgcaatggttaaacttagagtaaatttcacaaaactacagatactatgaccaaactatcacaaaactatagatttaaggagtggtatcacaaaactacacatttagcaccaaatttatcacaaaactacatatttaatatgaagtgtcacaaaactacatgtttagtaactaaattataatacaattataggtttagaaccaatttaatcacaaagtaataatgtttagagctccaccataaccatagtgcctagggatttaaactctaaaagttgtagttttgtgataagttcaatattaaatatgcatttttgtgatacttaacctaaaatctgtagttttgtgataaatttgatgctaaatgtgtagttttgtgatacaactccttaaatctgtagttttgtgataatttggttaaaatacctgtagttttgtgaaatttactcttaaacttaagattgcaatgatcagtactatgccttgggtggagaagtgcgttggatatctccatatttgcaggcatcgagttcagccttcgtttgaagtattattcggcatctgatcaacgagtgcgaagacgtcttgtggatcaggcaccaggatgtgatgtcttttcgtcgtttattccttgtcggcgtctggctactagacaggggtgaagccatttatagttaagagggtgtgggcagggcgaaaaagtcataagtaagagtaagcaatgctaacgataaaacaagacatcatgtgttctgccataaaaaaagcttgaatttagctctttagttgtatcatttgatatttgacagtttgagacttgagacaccatgctcgacagcgagacgcaatgggaggacggagagagtgtgaagccaaagcaatgaagacgaggagttgatttacgttgtctctccgtctctttcttattaattaattttctatatcatgtttattgataatggactaaaaaacatgctaatgtgctagttagtacagcagggaggatggtcggataggggggtgttggccccctccagcaccctccgtagctgcgcccctgctcctatagattacttgagagtttgctgccttaggaggtcctcgagaaaatgatgtcgtcagcaccttcctcttagattggttgagagaggtagtcgactgaggattgttctccgtcaacttagtcgatgctatctcgatctcagtggttgttgggtaaggagagatcggcacgactgcgtagatggggaagatgatgatccgacttgcattcatgtaaatgcatgttgccttggatctcccaagcttggacggttgcggatgttctcgtcagaaaatcttgagcttgaagccatcttgtccaaaccttttgcaccaaatcctactacttggcgcactactgtcgatgggttatatcgcaactacgatattcagaagtatcagggaacgatggtgctaaggtctatatgaaactgtatcaagcaaagaaggacaaagatttatattggttcagacccctcgtaagataatagccctaattttgtttacatgcgattatggatgagaattccaaaaaaaaattacaatgggaataaactaactaccctaatccgtcgtctaggatccgccgagaacagcttagcgagatctagtagacaaacacggcttcagcttccttcggtgtatctcaatgtggttggtggctacggcttataattcaatgatcctccctgagcaaggggtccttgtatttatagcatggactgtcttcttctctaagtagaactcggagagtcgcggttgaacacgagacgaaggagaccttatctcatccgagtaggactttgacacattctactcgcgaagataatttccttcctatcaccatatttccttactataatatcaccttgttgatgcgaaaaacacacactggcctggaagatctgcttaacttcagtacaggtccaaaaatcttacctttaggttcgtgagtgtgccaattgatttgatcctgcaatcaacaagaaataaagacagaaaaaaagtggttaaatccataaatgatagccgatcggccagtcgccgatgacatatcatttatctttgagccgatatcatatttgaatcgatcgacagttataaataggcaagaaagaactaaatctattcgatcggttgtagatattaacggtatataatacttctgtcgatatatacttaaatcaagtgattagaatagatcggtcgtcatgccaagatagtatgattcacttagatcgaaatatacattaacaaggagattataagcattcataacatagccaatcggatggattcagcatgtatcggctaatactccgatattactctatattaagatattaaaacaagcaaaaatatcaaaaaagaagcttaatatacctaaatgcaacaagatcttaacataaagggcagatttaacatatcaatcaagcatataggatataaagtagttaaatcaggtaagatcggctgaaaccccgatgaaaccctaatcggcaacaaaaagcaggctagagattgagattctaatcacgacttataaggtcaaactcaactgatgcagctataagtatgaaaagaatgacaatatctagacaatcaagccgttgaatgtttcatagggtggtggataccctatataatctaggtcaatgttaatatttaacctaatcggttgccttccagtaatagatgttagttgattgaggattaaataacaatattgccagagattgtataggatatatgataactcgacgatttacataaacaggattagagtgttataaagatggaagtactaatcccgagaacgcaagccgtcatgacaagtttacctctagttggagatcgaaacgatgcagctcaacccgaaagcaagaactcgtcgagatgaaatgaaagtaaaaagggtggcgatgcgctgagattgtattgaacgtgtgttatttgattacatgggtttgggtcatatttatacccgaaatacaaaatatgtccttgtcggacacgactcttatctctaacaaactcttaagataccataagtctttgcggcagacttttgcccaaacttatctctaaaaaaattacataaaatatcctaattaatatatacaattgccttttcaagacccaatccgtgcgtggcaatccatatgaagcacattaactcaacccgacgacgtgtaccgagtcacattgtcggaatcggctcaatcggctaccttgtctgactcgaactctgctgattctgatcagagctgattcagactttagccgattcttattctctttccggaacaatctatccctgggattccgcttcgattttatcttcatttccgatacttgaattaccaaatttggttgttaacacaccttcgtgtatatctgtaggtatatggcatccatatattaccacgaacccacgtataggagttatgccttatccatatcctgagaaataaaatgatgattcaaatgtaaaagtaaggtaatgtggtatttttgagccaagaaaaacaggaagataattttaacatagattaatcatctaaggactaaaaacaattcaggtgatatgatttaatgagagaagaaaaggtgagagataatttggatcatagattaaatatctaagggataaaaacaattgatgtgacatggcttaatgagagaagagataaataacattaaggaagtgaggataaactctataggtgtataagatactaaaaaaataatggagacatatattaaaatgttatatgacttatgtgggataatgatttaacatgcttttattttaaatctctaaaatttaataaattatagaattattgataatatagcatgctcgtatgttatttaagatgtaataattgttagtggcttatgatgtggcatctttacatgttaagctttagaatttagtaggttgtaaatttataataagatggaattggtacctgagtagagattatgcttgatgatccaatttttcatgaaaaaaataggtgaatagctaatacgccctgaagttccattataggatcagtttagtctctgaggtttcaaatcgtcccaacaagtttctaaaattaattgtttggcttaacatagtctttggacaaacaaaaacaccatataagcatgccacatcatcctcgcatgcaagggcaatgatgaaaatgagcattctacgttggtgttgccctgtgccgcggcaatgcgacttaactggagctatcgtcgtgcaatgttgcgatgacgcggccatcgcttgccagtgcccaaaccctagatggagaaaacaaaccgcgaatgggtaataacgggccgagtttatttctgttgtctcttttttttcatttactttttccattttatttccttttaatatggtatataagggtagaatggtcatttcaaccatatccttgcatgcgaggatgttatggcatgcttatgtggtatttatttttgggtttaaggactatattaagctgaataattaattttgaggtcttgtttagattatttgaaacctcatagactaaggctcagttagtgtcttctatagataaagattaaaagcgagtatgcaaaacgagaaaaccattaacgcataattaattaagttttaattattataaacttgaaaaatgaatttatctgatattttaaagcaacttatatatagaaggttttcgcataaaatgcactgtttagcagtttgaaaagcgtgttaacggaaaacgaggaaaaatatgtatcttacaaagttagaaagggcctaaactgatcttggactgaattgactattaaaaaaataatccctaaaatagattagttctcgttctgttatgcatagaggtgcccttgtaagattcaatgttgcaaaaagcagaacatttctgaaatatccactaaaaaaatctgaaatcgggaattttcaccatatatcgtgtagaaattttgaacatttttttctatatgattaaaatcatatatttttggttaaggaaatggggaagtatgtggagtaactttgataaccacaaattccgtctcctcagtgaggaaaaactaaaaaaaaaagagagacaaagtcgcatgtataaagtcttctttctctgttttaacttgtataggtgaatttaaatatggatgtttactataagtgatgtacctcatcctccttccgttgtaaaataatttacaacaggtactattaattttctcacttaaaccactcgttttttatttcaaagctttccaacactaaaaaaggtgttgtacttttaaagtgtaatgtcataaatataagcatatattttttttcaatttagtgtaacaatctaagacgaaatagtggttaaaatagcaaagttaaagctgttagttattttaaaatggagggagtaattatctaccatttctgtttcaaaaactatacaaaatagtacttctccatccacaaaagttacacatatttcatattttgagtttttccaaataagttgtttctatttgtagtctttatgtattcaaacttaagagataaattaagtgttttattagaactcaaatagtcatctaaatactcattggttacatgtatgtattcacttattgattttgtaatatctaaggtgatttaatttttttcttaatcttagtgtcaaaagtaatatatgtaactttcgtggatggagggagtacgtgacatggaaataacgagtgtatttaagggaatcaccttgatactaatatatacccgtggaattaatttaccgtgtgctatctatctatctatctatctatctatctatctattatatactaaaagtccataaaacttcctacaaacgctcataagtcgccacgtggcactcctacaaacgctcctaaaccgccgcatggcacttttaatctaaccgtcgattttcacttaaattggtggacccactattctagaccattagattagatctatttagaaaagtcccagcttcatcgaaattatttaccagaaaaattcaaaaattaatgtacacaccggatataaaccttccgtattgttctcttaaaaaaaccaaacacacgtgcgtacgtacaaagattaaaaaaaaatcaaaaaaccatatgtatgccgtaagaacaatacagtctttcgaatatagtgtagtacgtattgtgtatgcctttctctgtcttttatttatcaacgaacagcaagtacatacttaagacttatctatctatccacggtctttaaaataggatttcctatattataaaataaaatttattactctacaaatatgcacggttaaactagattaatataaagtaccaaatcaactgtatttaaatgtttatcttttaaattatttctcaaatatatatctaacttataatcctttgtctttctttaattaaataaaatactaatcacttataatagttatatggaactgctaaattcattacgacacatggtgccgacatataatacgtaatgtgataattatttttcaaataatttagctaacatataataactaatgtcatgatcatttttaaattaatttcacatgacaaaaatgatcaacttggtgtcaaattcgcttgacaaatatataacactaattcaaatctacatgtagaaaaagtgaaacaacattgtggtttacaatcagatttgattttattttaatttatgtgatattaagattctattttttttaaaaaaaatagaactatttgatgggaatttccaggcaatgaccttgctatattacgaccccttaatccatcaggagaattacggtcatatatggtttttctttgcgaaattggtttggtaacaaatgaaaaatcatttgcatcaaactattcatcatatattttttatagtttagaaattctaatatatcaaacataattgataatgtatgtcatacaccccactgaagtaactataaatgcactccaacaaattagttactttaaataattttggaaaatatattcttagaataagtaaagatgtcgcatgtaattatgaacaatacatgaatgaaaacaaaccgaagctaaactatatatcttattcaaaatataaagaacaatatggtactcctagatgtcacggttgtatgtctgtttagtttttttttatcaacattgctcatctgaaaagagaatattgtatctacacaataaaaaaaataagcattactgattaataccatgcataattttgtctacacaaaactttgaaaaaattcactagggaaatattttcatcacctacattccctctttttctcccataaagggcaccaagcatgctgtgctaccacaagtgtagcaagggtcatacatatggttgagttgaagccaccccagcaaaggccgctattgacaatactgcataactttgtacttactgatgcaataatatatgagggtgctaatagtgaactagacattaaaattacgcttcatgctggcattgcggggcacgactatgtcgactcaggacctatgtttaaaggcagtggagaaataaagcctcgacggatacggtcagcttcaaccattaaaggggacattcatatctgattttaacggtcatcaaaattaaaaaaaatcttataagttataagaaaaaaaatatgatcatcggtttacttaaattatttagaaaaaaaatagaaaaataaagtccccaaaacctcgtcctccccggcacatgcacaaaacattgctggtccccttcaaccttggctcatgctctccgctctccattcctcccccttcctatgaataatactgaaaagaccttatttttaatatatacataacatttctaatctaattgttgatctgttaaataattaaaccaacaattctttatccataatgcctataattttaatctaaaataagacttgtataaaataaaatagaaaagtagaaaaaaaaagtcaatagggattgaatcaaatcaattaaagagaatatagtaataaatttctaaaaaatagaaatgccataaccatccatctaacgtggtattatgagtttctcatatattattgcatatataagacatactaaggtagtcggacatagtagtacttagttggttaaaaagttatatatgtgctactatcaactttaaatttaggactcatggtgcctaggtattttttttaaaagaacaccataaatcacatatataaaagggaaaggacgcgtacaatatatatatctcctatgtatttattgtctcattctttcaagaaaataaagaagatcattgataattgcttatagtaatgaattaaatattatatagttcaaaccttacaaatatcttgtaaaaaaatatctaagcaatagcgatgaagaaaatttataaagaaatactccctccatcccaaattatatcaactataatcaaactcggtagcttttaactaataatcatactaactatatctaagtattatgcatgttacatcactagatttatattttgaagtacttttatgtaatgctaattttatatttgttgggatagaatggaataaagtactggtcaaaatatattattaaaacctatgtaaaaaaaatataggtcttgtaatttgagacagaaggagtcttttttttcaagcatatcaggtatcgtccgtttgatactccatcatccgattgatattcccagtgtaacctactttacatgcccgcgcgaatgcgcgggctacctttctagttattataaaagaatccacagagttttgattggcagttccgatgtaatccaaaagtcacctgcggactcacacgatactcgacatccccatcactcaatgaccgagacgaacatatacccgtcgacaaaattccaccgaaatttcacggaaccatctaaaaatcctgcgaatccaccacccaccgtctccgctccacgcgtggcacccggcgaaacaagagcaccagaacccacgattctgtcccatcttttcccctattttctccccccctccggcacctctacacctgtccaccccaccgcgaccccatcaaactccgcgatttcccacgcaacaccagcacacacaatgacacacacaactatacgtgtcaccacggccccgtttgccgccatcgtccgccgaggtcgcccgccgcgccgcttgaccgcgagaaaccccaacccccacggcgccctcgcacatcccgcgaatcccacgggaaaaaacccgcggttttcccccaccaccaccacgtcgatgcgtacgcatcgcgtacgtgccgtcccggcatgaaagctcgtcttttgctgggtcccttcccgcgctgtgtgtgtggaggacgcgcgcgtgtaatctgaggggagccacacgcgttaggtgggccgcttttgccggggcagagggcagcccaagagccaaccctccacggacccggagccccaacgtgtcaacgtgtcacgcgacgcgcgggaggtcaaacgaaagagacacgagtcgtcgtctcgacgtccacgccaatttccggcgctggccaatcgcggcgcggcacgcacccacccacgtcttccccaccatgcttttctaatccccaccaaaaatattaaacaaaaccgcagcaactttagattgaaaaaaacgttgattattcagacatcgaagactagttgttgttgtggagtagtagtaatactagtaaaagattattactaattgctcattcagagtacccgcaatggtaaaataatatgctatctatagaactacatctcagcaatagactagattaatagtaaaccacttcaatgatatgtctacatgggtatctatagctctctaatccattgtctctttttctctatagactatttccaggttaatagatagttttgctctctctcttcatttaatctcttctaagtaggaaaatatgctgacatggatctcttgtatagagcctataaataaccattgtgagtgcccttaacacaacttcgcttcgtcgaaccgaagtccaaccaaacaatttcaacttcatctaaaaaattaaagctagctaaaatactctcacaaaattaactagagagatgtacttaggtttaaacctacaatagaaagttataaatccacttaatacatagagaatatacaaaaaatataaagaatgatggttctcgtacaaaagctaacttaatacgtgctctaaaaccaatatattaatatataagtgagagagaaggatatgagatgataaattgaagctaaccttattgtaaatatattatatatacgttaactttaaaatatgctaatagctaacagtgagctgtactattaaactcgcttcttaaacagattcacaactttatttgaaacccaaatattagtaaaattaaatttagatgtctgagtctctaccgaacgagctccaagtccaacggagacacacacgttgcagtaagggtgggccccacgggcgtccggaccgtgcgtcgcgtgcgtcgccgtcgaacacggcacagcgacgcgcgtgtccaatggacggtcgccactgcattattccgggtgcgaatgcgattagattaggatttgatctcgcgattagattgggcgtgtactcgtggtagtagcattactactagtacgtggcgacgacgaatgacagcgatatatttttctttttctcttttgcgttggtggtagcttcgtcacgtgtccgggcctgggtgggtggtcgccgtttggtgtggacgcgaaggacacgtgtcgcgtggcggtgcgcggcggggaggcgggactcgtggacggcccggatgcggccgaacccaccacctgtcgcggcatcgacgactgatcgcgacgcgaggcgtcctttatattgcggccccgctttcgtctccgcctctctcattctctctctcgttgctcctgagatcgtctcgtctcgtggtggtggtggtggccattgccggagcttccaaggtgtttgatgtcgatggcggaggtgtgctgtgattctgcggtggtggtcggggcggaggcggaggcgagggcgagggcgcgcgccgggaggcggcggcgggcgggagttgagggggcagggaggtggaacgccacggcgacggctgcgggtgtggcggcggaggaggccgcgacgaggaagcggagggcgagtggtggtgaggccgggttggtggtggtggcgaagcggcacggggcggcgtcggtcgccgggaggaggagggagatggaggacgccgtgtcgctgcgcgaggcgttcgccgcgccggcgaacggggaggttgcggcggcgaggtgtgacttctacggggtgttcgacgggcacggctgctcgcacgtggcggacgcgtgcagggagcggatgcacgagctcgtcgcggaggagatgggcgccgggtcaccggcggcggcggcgcgcgagccggcgtcttggacggagacgatggagcggagcttcgcgaggatggacgccgaggtgatcgccggctgccgagccgagagcggcagctgccggtgcgaggggcagaagtgcgaccacgtggggtccaccgcggtggtggccgtcgtggaggagagccgcgtcgtcgtcgccaactgcggcgactcccgcgccgtgctctgccgcggcggcgcgcccgtgcagctatcctccgaccacaagcccgaccgccccgacgagctggagcggatcgaggcggccggcggccgcgtcatcttctgggagggcgcccgtgtcctcggcgtcctcgccatgtcgcgctccatcggcgacgcctacctgaagccctacgtcaccgccgtgccggaggtgacggtgaccggcaggtcggacttcgacgagtgcctcatcctcgccagcgacggcctctgggacgtcgtcagcaacgaggccgcgtgcgaggtggcgcagtcgtgcctccgccgcggcaggcagcggtggtgcgccgaggcggcggcggtgctgaccaagctggccctcgctcgccgcagctccgacaacatctctgtcgtcgtcgtcgatctccggcgaggcaacgccttgtagagagagtgtcacccagctgatgctgtagcatcagtactagtattgcagatattagctaagctaatggttctactaatctttttttttcatttcccttgtgttaaaaatcattttttttctcttctaattttctccctgaattaaccaagttcagtggagcacatagatcaggtgatggggttgtgcaactgctagttggtgtaaccagaatttcatctggataccaactgaaatgaaatgaatattaagcaagattatttgagaaggaagtttaaaccatgggatttttgttaggcaaatcacctttttacttattgaattactgtttctgctgtggttcagactgtaccacttggggcctgttccctttggtgctattttcaaccttaccaaattttggtaaagttgccaaaaaaaatggctatatttagtttgctgtcaaattttggtaactatataagtaatcctgcgaaaacttgccatcctatagttgccaaaacttgccatcctaattaattactctgcatcttgcaatcatgcaatcttgatgatatgattgcacgatattttcctctgccgtcccggactcaaattcaattaaaataacatctctgaattgattggggatacaaaggacaaaataaaattccagggttcatcagagaagcaccaagggaacattatcctcaattttcaattatactactgtaatttctcatgtttatgtcagtgacaagattcagaacattccaaacgaaatttaacacatcagatatttttttctgtgcgcgattcgtctggaaggagaacatctactatagtatctaatacatcttcttcatcagtcagaaaatctcaaatcacacaccaacacttgcgcggtccagctaaccctgctctgtggctgcctgcctcctgtcccagcaagaagcaagattctctcatttttctctcacgagagatctgccaatgcacagctcaacgattctcagcaatctctcaactcccttttctaaagcgaaattagtactatcaagcatcaacataggctgatgtgattagaccagaaagggattacaaaattggccactccaaacatgctaacatgctgctaaccctgatttatggacgggtttgttgctccagcagacaaagaaaatcttttgcttagccactaataaagagagtttagagagtagggtagagattgcaagcaacattggtgaatgaagtgatttggtgaggctacgagggagatgtggtggcagacatgggggttagtcgccggaggtgtggcgtgtcgacacgtacgcagtatgtcgagaagatcgggcaggattgtgcaatctgcgggcagatcacagatccggttcaatcttcaccgtgtttattactctctctgtttctacatagttgataccgttgattttttacacatgtttaaccgttcgtcttattcaaattatttgtgaaatatgtaaaactatatgtatatatataagtatatttaacaatgaatcaaatgatagaaaaaaattaataattacttaaattttttgaataaggcgaatgttcaaacatatttaaaaaaattaacggcgtcaaatatttagaaacggatggagtaatttggtaaattttattatagcacatggtgagtggtgacttcgcacgaaaccatttttagggaacacactataaaaatatggttatttatcaggagacaattgattaaattaatggtaggggtaccacttttttacatgacttcactagattgctcattctttctctttatcttcctatcttcttcgttatctcttcccctctctccctcatttctctcttctccagcgagtttgtctacatgtggctggctagcggcactgctttccctccaccttgcaacctcacgcactgatcctactcggatcctctcctcctcactgatgcctctcctgtcctcgagcggttggttgatcgatcgatcagcacggttcttcgccagccatgacggcggcggcgatggcgccctcacctccgaagccggtgtccccgaggcagatcagcctgggggacctcagggcggtgtccatgctcggccgaagcgtcaagggcgtcgtattccacgttgtgcccaccatggcgggggaggtggaaggggttgtttcctcatccatggcactcaaggcgatctcgcgggagacggagcaacacaagaagatggggagcggcggcgaggacaggcaccggcggatctggttcgagtgggatgtgctcatgtcgctgagccacccgctgctcccttcactccgcggtgtcctcgccaccgatgtcgttgtcgggttggtcatcgaccgctacggcggaagagacctcaactcgctctgacgccgccagaccaagaagatggcttcaggccaagctggtggcggctaagaaccgccacgccacaacggtggccgagataccgccgctcaagtctaccgtcgagctgacgaatgacgccatcgtcgcgaggatggaggcggggaagaagcgggcggtggtggaggtgctccaccggcgcattgaccgcgagcgtgacgacccgcggcggctgcggtcagaggtcgcactggagcagatggtgctcgtccggcaccaggtcgctcacgcgctgcagttggccgagcgcgccgtggcggcggagacccacgggttggctttggcgtgatcagcggtcgccactaccgagcaggccgcgcgtgctctagtcagcgacgtcgatgttgatgtcgacgcggcccaccacaatgtcgtggcggtcccaacgcggaggccggaggagttgcgcgggggcgtggagggcgaggagagaacggccgagtttcacgtcgaggagattgtggccgccataaggttggccgaggcgcacgccaggaagcaggaagctgctgagcaatggcacggccgtgaccttgaagtcgtgatgttctgcaacaaaatttgcatattaatttttgtggctaaatcctgctcaatttgaatatgcgagcaaataaaagaagatcagaattcctgctgaatctgcaaagagcaaatcacaaaaatgttctacataaaatatgtagagtgagagcaatttttcaaaaaaaaagaaatacaaatccagctcactatgcggtgagcaaatcaaaaaaatgctcaaaaaaaatgcaaacttagagcagataggggaaaataatcgcaaatccccctcaatctgcagcgtgcgaataacgaaatattctcaaatctgcggagcaaatcaaaaaattataacgtgtaaaatcacaaatcctcctcaatctgaatattttgtaaaatcacaaatcccactcaatccgcaaaataatattttgtaaaatcacaaatcctagtcaatctgcagccaaaaatgatcttcaaaaatcgaatgcagccaaaaatgatctgagtcttcagcaaaataatattttgtaaaatcacaaatcctagtcaatctgcagccaaaaatgatcttcaaaaatcgaatattaattgtgtctgagcccagttaattcaaaaatcgaaaaattatatgtcaatctgcagccaaaaatgatcttcaaaaatcgaataatattttgtaaaatcacaaatcctagtcaatctgcagccaaaaatgatcttcaaaaatctgcagccaaaaatgatcttcaaaaatcgaaaaattatgtgtctgagcccaggttcgaactggggacctttagtgtgtgagactaacgtgataaccaactacaccacccagaccatgtgactgaaagtaaaagattattgtaattttgtaagaaaagttttgttgttctgtaagtaacaaatctatacaaagtttggtttgcacaaaatctacaaagtttcatactttttactattagtggcacgtcccaatcccaacacgagaaaatcattttctatgaaaaaagaagtcaattttactccctccaactatttgtcatgcccttaaccacctaaacaattctctctcattttacaccatgagctagtaaaaataattcatctcattgtcctacaacaattctctttctttttttctatttctacgtagtgacttcatcaatgttaagatatgccagctcagtctttggagatgcttacaggggtagaatgtgcgtgtacgcgttcatagaggtgagtatgcgtgtggtgtatggacgtttgcgttgtactgtgtttcaaaaaacaagaatatatcatgtgcacataggtttacgtgcacatttcacgcagagtaagcagcatgtcaaaaagattgggcaggattgctatccgtgagcaaaccttaaatcatgctcaatatgaatatgaaagagaattagaaaaaaaaaaacgaaatcctgctcaatctgcggagagcaaatcacaaaaatgctcaacacaagaaaatgcaaatggagagcaaataaaaaaatcgcaaatccttctcaatctgcatcgaacaaataaaaaaaacatccaacaaaattagcaagataccaaaaaattaacatccaacaaaactctaaaaataaaaatttagcaagtcaccagaaaattaaggcaaaatttgctacaggacactcacagattgtggcatttgctgtggacacccaaaaatcgtgtatttgcttgtggacactgtaaaaatatggtaattagctgttggacacttaaggcattattctattattttcggtgaaaacagagagagaaagagtgttgaaagtaccaaaatgcccctgacactgttcttctttcttttccctttcctgcctctgacacgggtcgcgttcttcgctgtaggtggcggcgccgtgtgggaggtgctgctcacgcggtgggaggggcgggacgaccaggtgctgctgtacggtctcctcccagcaggggtggaccacggcgagctcat

SEQ ID NO: 70110 - DNA, 911 bp, Oryza sativa
acatatcttggatttactgttcatatttagcggtaatcaattcatgttctgcacagtcttttacacttttcctcatatttttttccattatatacaatcaatttaattttacagtgaaactgaatatgtgaacagtttttcagctttattccagtgtttatgaattaatatttttcatcatcttctaatatttgataggcacagctggttctgtcatttggctgttcagaagcctggaggctgggccatttgatatcctgaagttttgagtaagaatggagaatgggctgtccgatgaagttcttaaagcagttttccctctactggatggtcaagacctagtcttttgcatgcttgtatgtcgtcaatggcgagaaattgcaaaggatgactacttctggaaatgcatatgtgcgaggaagtggccttccatttgcaagcaacctccttcagatgcaaactaccagaagctctatttaaccttctccaaaccacggacgccacagcaccttcctgtaccaaagctcacattcgaggatcttgtgttttacattgacatgtggcttgacggatcactcatcttctctcaagctgtttcaggctgcatccttcgaggaggtctgcagaatacaccttgtggcattccggatgtacttgtagcacatttgactgctcctgactgcattctgatgatggaggttgaacccaagctggaaataactatggggccatccatcactgtgtctgttcttgcccaccgaaaggatacaaagaagatggcttgcgtcattaataagtcaacttttgattacatcgacagcaacgcagcacgggcattggcatatgaatatctccagttttcaccaagatacccttttatatcagacatccgagcatggatgtctttgctt

SEQ ID NO: 70111 - DNA, 12063 bp, Oryza sativa
ttaaatgcacttttagacaaagtatggttttagccggttaagaactacagttaatctagtttttattagtttgactgttctttgaggtaccaaatttagttattaaattataccaaaattacagtgagttgtatgtgttgattagagcctacatgaattttcccatgattttatcttgcatgaattattttagataattcgcaggacttatgtcttatatgtgtttctctttcctaaatgcatgtaaatgtttataaaagttatatttggactctcattaacatgaggtgatgttgatatgttagaattacagtttaccttacacatgtcataagctccttccctatttatgcctaagtttactttagtattaaattaagagaatgcttatagagatgattaagatagaatataccctatatgatataatttatttgttcactttcatgttcatgacatgtcttcagatggatgtccaaattagttttgtgaggcttgacattatccatgttgatttttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaagatgaaaaagtttttaatttgttctcaaattttattcttgcaagagttggatcaactccaactaggtttaaaatagaaatttttggtttacaaaattgaagaacttccctttcaactagttttgatggaattccttaatcctagaattcaggtatgttacacattagcgttcaaaggtaagtaaaaaattatacaaccacattacgtaatcaagaaatcaagtaataatttcatataactagaatggaacaatgcttaagatgtgaaaagagtttcatactatgatttagtagtcgttgaaacttatattgcttatagttttaggctcaatcaacgggtttttttcacccacgggttggtgggtatgggtgggtaaagaatggacccatacccacgtacccaatgggtaagagttttgcccattagtatacccatgggtacaagagttagaacacaattagatcctaatagagtaaaaacccgtcgggtcacggtttatgggtccccattgccatctctaggcgcggcctgaggaggctggggcggcttgggccgggcaggaaggagggaggggagggggcggcccagaaggaggaggagaggagggagtgggccgggaggggaagaggaggcccaagagaaagagggagagaaagagagggaggagagagggacttcggccgcgggccgagagggagaggggagaaaccttgggccagacttggcccaaagggaaggagagggttatttttaggtttttctttttaataaactctgataattgtttttgttgcttaataattatttccggtgctctgaaaattcaagtaaaatttgagggctccttttagaccaaggagaatttaacaaaaatttccgggccacatttgaatttttcttgtacgtattttagtgtttgccaatttcttttcgaattttaattaattctattattccttttagaaaatgatttttattttgagatggatttatcaggacgtgacaataacggcgaagattgataacataaatatatgtaatacaattgtatctttagaactaaataatggtatatagaggagtatagtgacaacgtttgatgagaattctaaatattataaaaataaaatccaacgagatgataaactctaaaaacgataaggtccaatttttaaaggttcgggacttctaaagagtaaaaaaaaccaatgatattaatgtttgattttaaaatctcaatgacaataaagagaggatggagcatgcgagccatagaatagtatagtggcaaagctgttaacggtttggcgggacttctagaaagttaaaaaataaacccgaacaataattatgttcaatttttaaaatctcaatgacaataaagagaggagacagcaggcgggccgtagaagagtatagtggcagcgtttgatgagacttctaaaaattataaaaatgaaactcaatgagacaataaactctaaaaactaccatgtcctatttttaaaggttcggaacttctaaaaacaaaaaaaaacaacgataataatgttcaattttaaaatcttaatgacaataaagaggggaggcagcaggcgagacgtagaacagtatagtggcaaaaccactaacgatttggcgggacttatagaaagtaaaaaatgaacccaaatgataactatgttcgattttaaaatcccattgataataaaaagaggatgtagcggatgggccgtagaggagtagagtagcaacatttgatgagagttctaaaaattataaaaacgaaacccaatgagacaataaactctaaaaactacaagatccaaattttgaagtttctaaggagaacgagtagaaatagtggtagatcgagtaatcaaataaagaatagggtgacttaaaaattataaaattaaacacggggtgatatggtttggtttttaaaagtcttaaaataacaagatagagaatgagtagaaatagtggtagatcaagcaagcaaattaagaatagggtgacttttaaaaactataaaattaaacacggggatgatatggtttggtttttaaaagtcttaaaataacaagataactattaaataaattttaagtaaaatcatattaaaaatagataattttatatggattctagccgcgcaattgcgcaggccaccagctagttgaggtgaagttacagcaagaatcaagggaaagaaaatgggactacctattgatcttttcaatagattcgaagttttaacttttgaatcttgcaaaattttgaaccaatggatatagccccttttttaaataaaataataataataaaagagacaaacatgtcaaaaaattgtaaatctaagatacaaaatcagttgtaaaatctaattttgttagtgcaagtgcactgcaactgagtgtaagtgtaataagtaactgagtgcactgcaacttcacttcaaaaatctgccacaagtgaaatagcaaaaaattaaaaagaaaactccaaactaacgaagccaacaaagaaaagaagaataacatgttggttgaattgccatcgactatgtcatcatgttctgttccttttggtttccgtctgatcataacaaatcatatacacaattgccaagctagaacttcaccaatcgtgattaatcgcttactacaatctgaatctacatgattataaacgtgcctgcactgcaaaatgctatctgccgtcctcctccatcaacgtgacgttgctcatgcagtacgactcgccgaaggagctggacgacacggccaggctggagatcctgacgttgaagtacgccggctgcctcggctccggcatcgtcaccccctcgctgccgagcatggcgatcacgtcggacatgttcggccggtcgtcggcgctgtcctggacgcacagcagcgccacctgcacgcacttcatcacctccatcgccgggaagtcctcccccagcgcctggtccaccagctcgtgccattgcccttcttgccatagctggtacgcctgaaagaagttcagaagttttcagttattagcggccgtgcattttcaggtgaatttcagtctttcagggtaactgaaatttgtgaattttggatgtcagagatttgtgcttacatatcctgtgagattgaagaatttgccgtactggtagaatccggcggtcctcttgccgcttatgatctcgagaagcaggacaccgaagctgaacacgtcggatttgatcgagaagagaccctcagaagcatactcaggagcgatgtaaccactgaataaaaaagcacaaaattcagtcattacaacatcatcaatgcatccgactgtagctatcactaattcttttctgacacaacaaaaacacatgtgctgtgtaacttgaccatcatcggtgattagtacttactgtgtgcccacaaccctggtcgtgttggcttctgtcacattcgagcagaatatccttgccattccaaaatccgagattttggggttcatctcccggtcgaggagtatattgcttgctttcagatccctgtgaataactcgcaaccgagagtgcttgtgcaggtaaagaagcccctgggcaatgccatcgattatacggaagcgtttgtcccagttcagcatcgcccccttttcagtgtctgcatatcaatacgtcaggcaagacaaaagcatcagcaacattcagcaggtttgcacaaagattttggaaatggacagagagaagttgaaagcctattgatcgagatggatatgtgagtgattgtaccaaagatgaagcaatcgaggctcttgttgtgcatgtactcgtagatgagcatcttctcgtcagcctggacgcagcagcccagcagcctgaccaggttggtgtgctgcagcttggctatcagctggatctctgtcttgaattccatcagcccctgcactgaacaggatgagagcctcttgatcgctatctcaagcccatcaggcaattgaccctgaaacatgtaagaaaagaaaacacaatttagtaagtagtcagatgaactgaaaactgaagaaacactgaagagtcgatcagtgtgtctgcaactctgcatcagaatgcaagaatgaatggagaaactgtgcttaccttgtagacagggccgaagccgccctggccgagcttgcaggcgtcggagaagttgtcggtggcgtcggcgatctggtcgaagtcgtagagcgagaactcggagccgctctcctcgatccgccacagcttgagcacctgctccatctccatggacatggtcggcacgctcaccgtccctgccatgttgatcactgattcagctgacagttagtgaaacctacagttaaccggggcagtgaagcatgggcgcgagcaaggtgtcagcaaatgcccgtgcgcacctctccttcttcgcctcctgatccagaggaaacatcccaagaagccgaggaggagcacggcgacggggacgacgatcgccacgatccacaggccaccgctgctgctgctccctgcgtgcaaacattgcagaaactgccactgtcagatccatggccccaacttttcaatgcccatccaatgctacgaattttcgacagaaaagatcatgcatgcgttttttcctgtaccactacaaggttttcatcaccagagtttgattcggttctgtctaactggaaatcccgactagtagtcgcaaaagggggaaaacgatcgatgaacgtgtgatgtgacaatattctcgatttcgacaacgatgagatgacaactacgtaggcgcatgcgacgcaggttcgtagttagcacggatgatgctgatgatgatgagcatcaccatcggttttgggcggtagggactgctcccgtagtcccaaatggcaaaggcgaaaccgtggttggctggacggtagtggaacggggccccgctcggtcaccggcaggcgcgcgcgcggtggacgacgaaggcgacgaccgagagaagggaagggggattcgtcaaacaccgtgggtcttttctctttccgccggctaaatatcccaagtaagctcggcgcgggaggtcgccgtcgtcggccgggacgacgacgacgacgacgcgacgtgacattccatagaaacgaatcatggcgagcaacttcacagcgaagcaaagcagcaaaaacgaactactgcagctgcggtactagtgaaatggcacgttgcctagtggttgcagtgatctgagtagcatcctaaggtcctgagttctaagtcttcatatagaacgaatttcagattggaatatttgagggctaagttctctgtttgatgggctaagttccaatttaaaaagactatatatatctggttggatgcagaggccggataaaaattaccctcttctaataaaaatataaaaaaactgccgcactatacagaggtacaaattctctcttgtcgcacactaggcagatgcatctggtatctggaggcatgggggaggaccatggctgtgcgctgtgcaaatgcagggacgacggtgtctgaggcagccggtggccacggtgaccgaccgtggaaagtgcagggagaaaggggaatcgaacaaatcggcggagatagatattctactgcaagaccagcttgtttgcagtgctccgtacttggcagtagcatcgcgtgacgcacgtggattcgctttcgtgtgtcgctggaacatcactactagctgtagctgcctacgaggggcaagagatcgatcgtgtgaaaagaacacagctaaaaaagggttaagaaaaccaatagtactatattcatatacaaatctcgttgctggctagctagctagcaccccgtctcatggcggatttctgaacaaagcaggggggcatgcatcagcatgcacattcatgttcttgagatggaacacgtttgattgggaataaaaatggacactatactgctcatggcgccccatctagtcaaaaacaaactacatcgatcatgtgtcgttcgagacgcccagatctcctgttccgtaaagatttaaaaaaaaacattttttccctgcatttcctggaccccgtacgctcgatcgattcctcttcacatgggaaagctctacaagatggaatatttttcttgtggagaaggggacaggagcacaccgagagggtaaaacaatgagcaagacggagacattaaaatatcagaaaaaaaaaatggccctacccaagtgtctggattgggcaatgggtattctccaagagtttaataaactaataaacacaaaaggtgtttggattgaggaaatttgatggtcgattcgatcatccatttgacatcattttagaacccttttctttttctcagatcttgaaaggcaagactttgatcgatcagctgtcacggctccgggtcgtagaatatatttgcagccggaactaatactcgtggccagcaaacaattcgtttctataggctgatgtggattggggaattctttttatggacaggaaagtcaagcgggtcctactttaagataagcacgcataacaaatgatgcaagcattgtgcattgacacagagtattttttttcccccaagtgtgtgaattttgttaaactcaatagaaggttgtgttatttattatactgattgatttatcaagttgggtatggaaaatttgttgacatttctgacagtatatattttgtctatgtattatgtcctataccctgcaaacttaagaaaagttgttgaagtagcgtttttttcatccttggcttacaaatttgaccatttatttagcatacaagttgttgattagctattgtgtagtgtagtatacctagatgaacaacgatattgatgcaccaaattatttaattaagttggaacctaattcccttaatcatatgatcaagaattaacgaaccgttatgcatcatagaaaagaaaaatgctgtttcatataatcatcacaacatcttctcgtttaacacgagtatacacaatgttcctccctaataaggaaaataataaactttgcaaaatgtaatcactgtctgtatagatctgttgcttagataattaatgccctttaaagtcatatggatatagtttagcttacaaaaattcaacgatgttcccattcaacaaaaactaatcaagcatatgaaatcaacacactacatactacttataatttaaaggaaaaacaactagctactcacgtgagaactcaacactactaaaccatcaattaatttacagaggaggaaagcatatatatagtttgtgaaatcaaataactccatcccatttcagaaaatgcaaatgccctgtacaaatcaaaggagcaagcaattgatactagctaactggtaacggcagtgaggccttgaaaattgaattgagggttaaaaaagaaaaacaaaaacaagactactagaagtccattgatatgatcgatgaactgggggaatgaattcatctctaaatttaaaccgaatgcatcaaatttcaaaatttgtgagaggatttaatttaggactaaccttgtgacgacggatccgggagcgggctaagcaccaccatgtcgttggggatcttgaagaatggatccttctcgtacctgaagtcgcagcgcacgccgaggatcctgccgccgacgcggccgctgaaccacttgggcatctggtcgatgataccggcgaggcagccccggcactgcggcggcgacaggtccggcgtgcactgcgcgatggcgtacacggtcatcgcctccggcgcgaacccggccttccccgcggcgtacctcctggtcgcgttgctcgccctgtcggccaccgcgttcaccagctccgccaccagcgcgtcgaacgccgcgacgtcgcccgcgtcggagacgttgttcatgttgaacgcggccgtctccggctcgttggcggcgccggcgccggcgccggcgaggaagtcctggtccgagtaccggagctggtactggtcgtagtagacggcgacgtccttgctgtacaagcagctgctcgccgcctgctggaacgacgacgccagccgcgcggcggagcagtcgttcccggtgaagtcgccgcggcagagcaagaggccgtacgccgtgtccggcgccgcgccgaacgcccccgccgcgtagcccgacgccgaggcgttcctggacagcacggcgaagaggccgttgagattggcctcgaacgtgctgttcggcaggtacgtccgcctggccgccgtcgtgttacagaaggaggagatcgggttgagcaccggcaaggcgcccccgccgtcgccggccaccggcgccggcgaagagacggcggcggcggcggcgaggaggagcaagaggacaagcatggtaggttgctaaccgaaaacacttgggagttgggaccgggctaacgttgtttgcttgctgtacatggaatggaatggctaagcctaaagagagagtgacacaaaagctattctgctctcattgctccagtggtttgtatattataggggggcatcaggattaagctaagttaattagggcttaactaagattatattaggattatggccaggttgattagtgcatggttgcttcagctaggatgacagtgacagtatgctagcttgagcttgagggggttgacctgttgcaaagcctgataggctgaagcaagctgcagctagccagcaactgatggggattggaggatgaaatgaatttgagaattttggctgtacttgtgtctgtactctctttaggtttttttttttttttctggctggttgagctgctccgttgctcatggttttcagagttgtttacaatggatgcttgatgagatgagtatggagggacgtgtcagttgagtgttttttttttttaagtagtaggtgtgtgtacagcatttgagatctatagttcaagctgttatggatatcgttttgagtacatcagatcatcggggcaatgtttgtcgccaaaaataattgactagtaccttttacctactatactaagtattatcaccagtagggtgatctcaattttcagtaagaaaaaagaatccactaccagtataaataaataagatccattgaattataaaagataatacttaattcagtctatactgatttcgagatagttgttgttgtaaaacatcttaaaattgaatttccgataatcatctctttattttctcaaaaactattgtattttggataggcacttgttatgaagtgtaaattgccaaccgatcgaatttgaattggatagaggtcttaccatatttatcttatatttccgaacaggtatatatgatggcatttcaatatttactactccattatcaagttattaacacaaatgcaatgttgtaacaaacatgaattcaaatccaatatctgtgtaatttggtaagctcatacaactacagttaaccatccatcatgcaactacaagcaaccaagcaactgcttctatatatattttatttgcgaggtgcttctatatttacttcacatgatcaaaatatgaattcatgttaaaattattaagattgatctaaattgtttagaaatattatgtaaagcatcctattttgaatgttgaaaccccatacatattcaaatacataattttcacttggtttcaactacaaatattatgtaaagaatgatgttctcttaaaacagcaaattcttgattggttacaactcatttgatttagggatcttgtttttacctttgtaaatattatgtaaatattttctttagtataatataactattaggcaaagccttgacagtattttggtaaaaaaaaataaagaactacaaataccatcgggggagaattcacaccattgtatgtattttcctcctatattcgttactctctctagatccagatattggataattcggaaccaattgatgccccaaattaggctccattagaaacacatgaattttcttttgtctaaaggtgaacacattaatttcacaagaatgtttcagtttcccagtaattggtatgaattttccaatgttccgttcagagctttatttatatctgtctatctgattagtcgttctttcgtgtacaagctaatagccattttaattagaagtgttaatatctgcagcttagatctactcgactgtgttaggtagctgttgcagattatcaaattgtaatttctcgatgactccatttgataagcgggtctctgatcagatttggcagcttctggctacagctagtagatgctggattgcctgtgtcctctgctcgatcttagtgtttttccagattgaactaacatgcgtgataaattatttgtggatcgaaaacattccgctagtatgtacaatgcacctggttttagtactctgaaaaaagattttgaattctagatattttaggtcactagatctgttcagaaaaaaaagatggcttgatctaatagcaacaaattccgctataatgccctatcacctgcccatggtataattcatgagaaatatttacttccgagaggaaccatatttttcagtgtaaattctactgataactcatcaatgttaagattagttagtataaacaaacactaagttacgatgtctattggtatctcctcgagtaccataaaaattattggagtatcattcaatcagtagcacgactcgatattctatatgtttatatgttaataattgagtgaagtgtataagcggttcctaaacttaagtgagtgtgtcatctagatatctgaactctaaaaatgtatttttaggtccttgaacttgtcttgggtgtcatatcagtctaaccaggctccaacccagtccatgtgttgatgtagcattaccacggtgacgcctatatgctagtcggatccacataccagttacataaacaaatttaaaaaatatattttctccactctaccttagattattttttaattttatcttttttctctctacctaagaggagaaaaatatatggtttttaattgtattttatatgactaacatgtgggtcccactgatatgtagacatcatcgtggtattgccatgttagcagatggagcgggttagaacctgtttagacctatatgacacccaagacaagtttaaagagccataaaagtattttaggagttaaaaatctaaatggcacacaccacataaatttagagatcgtccccatgtacttcactaattagagggcaacatcaacaaattcttctcattctattaagaaagcaattggttgttggatccttctagctaaatcc

SEQ ID NO: 70112 - DNA, 1721 bp, Oryza sativa
tacattatagctaagatgagtgagatccatagtaattctttaagacaagtgaaactatattatttataactaatttgtgtaagaaatattagttctccctttatttgttgaggcaagtgatgatcaaacaatcgatacttagggcccctttgaatcacaggaatgaaaaaacggaggaataggaatgacataggaatgaccgtttgattggactaaaggaaaaacacaggaatttgaagagagataaagactcaaaggatttcttccatgaggttctacctcttattaaaattccttcaaaacttatatggaaagatacattctataggaatttcatagaattccataggattcattcctttgattcaaagagcttcgtgggaaaaattcctataggaatgaaatcctctaaaattcctatgaatttcctttgaatcaaaaggaggccttaacaaccgtaataccttttctatcagttgatcacatttgctgagaataataattcaaacaaagcaactcctttgtcaacaggtctagggatcacaatcaacataccggacggtacaggtcttgggatgccaagcggtatttactgtactggccagaataattttaaattcaaatatgaaatttaactttaaatttgagtatacgaatttatattctcttgcgacttctttttttttagaaattcaggggtgagtgtgtgtctgcgtttgttcttgcaacttgtgtaggtatatttgtatagataaatgagaactcggagaggcacattcaatggggaaaaaacagaaatatagaaaactatatatggcccacagaatatcacacggcaaaaatccccaaaaaaaaaaactaaaacaaaagtttggcccagaaccaacagacaattggaatagcctatccgccttttcctggccataatgcacgaagatatattcattagtttcaccagtaatagaaggaactggaggtacaaaatgagtatagttacatagtatagttacacaaaattacttctatacagatgcaatatctcctcggttcatggcatctatctatcactccagtccagtctgtttttttttagataatgaccagtccagtctgttgaaaaggaagaaaaatatttgacaaacgtcacatctaatcagaagaacatctgcaatataaaaccattagcattttgctgtaaagcaatattatcatctatgcgtgaatctttacattaaacggccggcatagcatgctcgagggtatttttgctgcagctggggccactgcacgaagaactgatcagctattcgtagcttgtacaacagtaaaccgcttaatgaaagcttcttcactcttgcaatgctttcgatgtagaaaatggaggaccatcccaaaccaagcacctgcagaaatacaacaatccaaaactcagtagagatataaagcattatgctgacttggaagtgagacaaataatcaaatatgaagattggatgtttggatttaggcaagatggccctagacactgttttataacaaatacttcccctgtttcataatgtaagactttctagtattgcccatattcatttagatgttaatgaatctagacatatgtatgtgtttagattcattaacatctatatgtatgtgggcaatactagaaaatcttacattgtgaaacggagggggtaataaaaggtaccacaagtcttatactg

SEQ ID NO: 70113 - DNA, 2349 bp, Oryza sativa
gatacaacattggatggtgctttcactagaattgcatgaggagcacaacattcccattgttagtcaatagataccctatacaatgtacatgctaattgacaaacaatctcaaatcttcaagtatttcacatgtctccagtctgattttatgaactttctattgcatgacaaggaaatggataatatacattacatactgactcttaacctaggtgtgtaggacatgtgaaataacaaatgtgattgcacacgcactttatttatttctctattgaattacaatgaaggaagtgtataagctaattgataaaaaaaatcacagatattcaagtatttcgcatgtcccaaatctctgtttttttaatctttcaagtgaatgacaagcaaagaaatggatatatacacattgaatctgatcttaagcatgcagaatatgtgaaaataacaaatgtaattgcaaataagtcctcatggctacaacacatatttcaggaggaagaaattctactgcacaaataggccataggccataggttattcaatctccaagatgaactcaccagacccaaggacgatgagagaccgcattccagcagctgaagctgagagtttcgaaggcatgtgaccgctgtgatacatcacatatgcgaagcggacaagaagcaaagacacaagtactggaaaggcgcaacacacggccatggagacatccggccccatctctgtcagggctgacgagataagatatcacgcaggattttgctgttggatattcagcgttaaaaaaactgtgccatacaaataaaaaataggcatcaacatgctcttaaaaaaacagtagcacaaatagttcattctgggagatgtcttgagtagtttgaatgaattatataacaattgaagaaaaatacaatttcatgtgtaacaagcagttcattctagagatgtctcaagtagtttgaaaaccttttatctttatgtattatcattggtaaggtatgtagattggaagggagatgcggcatcaactctgaacttgaaagatatttataataaaatcgagcaagcttaactaaattttcattgccataagcagaaaatgattcagtggctaactggtactctatttggaacattcaacaaatatgccctcctcacttcatctctattttcaggagcataattggtctattgatattcgttagtatgttggatctgcaaatagatttagagaatgaagtctagaaataaaccaaagaatagcatgacataatcagggcctgtttggtagggctccaactcctagatcttagctcctaactccaactccaatgggagcttgctcctataggatctagaggtgggctgaaagtgtttggctagtttgatcagctctagaaatctttgaagagtgaaggaagcaaagatggacaattttatccttcggttttctgaactgaaaaggttgcaagttttctttgctggtagctactttaaacacagacactcatttaccatatggctagtaccaattagttctttactgtactttattctataacaacatgctacattcattaaatcaattttctgaactttgtgcaatccactgaaaatatttctgaacaaattctctcctcatcactactctatagttctatatgaaattccacatacacacacataggagaagttttcagatctaaatattttctatttgttctacgcacagtagcaacaaatcaaccaatatattcaatcattcgaatagagagtagagcagatttaaaggcaaaaggtggggaaaattttagggtttgggaaaaagagtaccttgccactagcgccccctgtcagccgtcctgcgtcgttgttagccgctgtgcttgacctcaaccgccgtgcgccacattcagccactacgcggcagccctccgccgccgagccaccctcactgtagggcgtagccagcaggcgagcaggaggcgggaagcgaactagccaagcagatcggcctcccgcggctctgggctcctcgccggctagcgaagcagatcggcggccggcccctcgccagtcgcgggatcgcagctcgcgcactctccgtcgccgccgtaccgcccgtcgcccgccgcaatcgcacgctcacacccgcagccagccgtccccactcccgtgtcctgtacgcagcagcccaccaaatgagttagtgggccaaatgattagattggcctctaaatgggcctttaaacatgcaggttcccttctgccatcactcctcttcatcttcctcgagcttctaaggcctgttttttttttaaaaaaaaactttatgcatttattaaatat

SEQ ID NO: 70114 - DNA, 559 bp, Oryza sativa
tgagtctaattaggccataattagtcataattaagtgctacagtaacccacatgtgctaatgacgaattaattaggctcaaaagattcgtctcgcggtttccaggcgagctgtgaaatcagttttttttaatcgtgtccaaaaatccctttcgacatccggtcaaacgtccgatatgacacccaaagattttcatttcaccaactaaagatgcccttagctatgggaaacctcgggagaaggcgcgtgcacctataaggtaccactttgaacgtacgtgctctccaagaactaataatagagaaaaaaaataagaaaacgcaagagtagactaaaaaggttattgaaatataacaacagaagattaaggagtaaataattaagagcgtatctgatcgtacgcatggcaaaatggatgaaaaacaaatttaataaaaggaaaacaaaaaggaaagaagaggtagcttaattaattagctatagctgtagctcttacaggcgcatatgcagacgatccagatgtagaagaagttgaggtaagggatgccggggtgggcctc

SEQ ID NO: 70115 - DNA, 2623 bp, Oryza sativa
aaccgtaaaaccagataccgagggtcccttaactatacaaaaccggtcagaataggtctcttggcggttttgatcccggttttgtcctacgtagctgctgagtcagcgtgggacccacgtgggccccacatgtcatcgtgccacgtcagcatactctctcttttcccctcttctcatctctctcactctatcttctcaggacggagggggaaggagcggaggccaccagcaagggcggcgtaggccaccggcgaagaagcagccgaggccatcggcgagggcggcgtaggcggaggtgaggctgcgcatggcgtcgggggcctcctagtagaggaactcgaggagggcgatgaggcagaagccctcggcgagaccgttggacaccgattgccggtgccgcacggcctctcactgccgtcctcccacgccgccaccgtcgccgggggaggagctgagcgcgaccgtcgggggaggagcagggtgcggccatcgggggcagagtagtgcgcagccggcgacatggagcttggcgcgggcggcatggttaccaggagaggagctgggtggcggcgggtgagggtgggcgcgggaggccgtcgccgcggttctcgccctctcccctgccccaccgtcttagggtcagagaggcccaggaggtgggagaaagaggaggacgtcggcgtcggcgggggcagcgccgttggagaaggggagggtgtcgccgcgcaggcgagctcgagggtgttgatggcgatgtcgtggccgtggttgagcttgatggcaccgtcgatggagccgccggcgtaggtctggcagaagctgtagaggccgtcgaagacgggctagtcctcgccgacattgaagcgcttgagcgcccgaatctggtcctactgggtctccggcacacccgccgcttcgccccgttgacgccggtcccgcctcgccccaccggcctcctcacatacactcgccttcctgccaccgtcgcagtgcccgggtctacgccagccatggcgaactgggcagagacggcgcggccgtcgacgacgacgacgtcgtcgcggcccacctcacggagcacgtggcgggcggtggcgcgggacccgcgccccactggcctcctccccctaacgtcggctagtctacgccaccctcgccagtggcctccgctccttcccccgccgccctgagaagagagagtgagagagatgagaagaggggaaaatagagagtaggctgatgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcgaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaaggcacgcgagccctagccgccagccgactcgaccagcgcccggaggcggagcacccgccgccgccgccctcgccatcgtcggcttcacccctcatcggcaacctagtgcaggtgagctccatctccacccctcctcatctcctctcctccccacaccatctttcctagtctccctctgttgcttcctcggatctgcttcgctctcgtgctctacgcctcacacgacgcgctcttcctcgtcgccaccaactttgttgctgcgcgcgcgtacgtcggtgcgctgtgcgcgttctacttagtttgccttgtgatgctgctcttagtcgggttagtgcttcgtgctgtgctcgctggtttggcgcttcagatctgtgtgctgtttgctctcggagacgctagatccatagtcgtcgacttgcaaatgctgcgagctaatatgattcttgttggatttcttcgctcctagcgtgagaaatccgaagaattgggagaacacggtctttttttttgtcccaataaattggttggattgttctagtatatattttttattatttttttctcccaaattgttggaatggcttctccctctttcccaactggttggattccaaattgttggaatggcttctccctctttcccaactggttggattgaggtgaagcgtgcttactgtattttttccacctggatttggtactatctttactctctgaactagttgggaacggatattccaatctcctgtctcttcgtgtgacttctttctgcttccacgtggggttctggaatcttcaattcactgtagtataagttcatatcttatttattctcatagactatgatttggtcgacttcgctcatatattgccgtgtagtagagggtttttacaattattcacgttcttggattgctgagatatcatggttagttgtgctgtttgaactggttatggccctcccgctgtgaattgccaaggtgtctgaatgttggtgattttgtggatagttcacgtgttggacaaagaatgcattataggagtgacaaatatg

SEQ ID NO: 70116 - DNA, 1746 bp, Oryza sativa
ccacaacaattcgccctaaatcatgttctaattagggatggcatcagatcggaaattagggatgaaagaacacagagatatagaccaagaaatacctctcagagtttctctcgacgtgcgtctcagagacgctctcagcttgtgtgctgtgccggtgcgccgccgccacgcctctgcgacgctgcgccgccgccgcgccgccgcgggcgctgtcccgccgcgcctctgcaccgccggaagagaggggaaaggaggggacaggacggtggagagggcgaccggagaggagggacgtgctgccgcagtgccgctgccgcctgctggggaggggcgcacgcgtacaacgctgttgccgtgttgagctagcggctagccgctaggggcattggcgccggcggctgggagtgaggagaggagcgatgcggtgggtagggttagggttttcctgggcctaatgggccatatgacattttgtgctggtgttcagggttggcactacatttaaaagtctaatatgcacccctcgaagccccgcgggtgaattacctcccccgcccaattgcaggccccggccccgactccttgggtcagaaaatccacccacccccacctccgtagcggcagggtcccccgcgggggaaattgccatccctaggcgatagtgcttcacttattcttccaatccgatgaccaagacgatgaagctgacggtgatgacggtgagggcgaggttgactatagaagataccattgaaccgcaaactcaacagggacctctcacaaatataggttgaagcaaacccgataaataaaagaagattccatctaaccttgaaaaggatttgtccgagaaaaggaagggcatcaaattgatataatctatgctttttcctcgagggtctgcctgcgagtatccgagtatgatatttcctttatacccttgccaggagcggagctagaacaaaatgaagggggttccactcgcttgctttactctggtttgaataaaatttagcttgatacgggtgcttaagtttaaactgacaaggtatatatatatggtgaaaatagataaactataggtaaaattttttttgaaaccgggttcttagctccgccctgacccttgcaaacaaattatccttctaatttttggctcaacgggaataccatttatcttttttttttggttcatacgataatatatatacaagtgaaattcccatttgggtaaatgctaaaacctttcccttgtcaaagataacagcagcagatcacacgcatatacaacatgagaaactctgacaaacatatgaaagaaggaactataacatatacccaaaaaagttttctcaatcatttgagccattgagtgataaaaatacataggtaacatgtgttttcgaccatgaatcaagctcattaataggcggcagagtacattatgtttaaccatgcaaagaaaggtacttcgttgaaacatatttcggtgtaaatttagtgtggtacgggcatatccaagcacgaatttaagttcagcagtgatatgccgtaatttacacacatgttttgggctacaaacaagcgcgagtcttttcttaatcaaatggcagtcgtcctgccgcttcattacattacattacattcctaaacttgctacagaaaacaaaatagctttctcacacgaatccttaataacaaagataaattattttagcacacgatgtagcttattataatttgagc

SEQ ID NO: 70117 - DNA, 759 bp, Oryza sativa
caagtcaagatgcataatggtttgttgtgtgtcctaatccagggagctacccaaaaggggcaattgcgttggatgatcttgcattagctattggcaaatccagttttcgttaatatgcatgcaggttggcaggaagtgcagacaagcaacagataagcaatctggtgaactagtctcaatccagtttaactgaaccgtttttgttcacccattaccctctactgggtattattccaatctgaatcctactaccaacaagttaaacaaaagtgttgcttgactaaaatgcattactaccttgcaattgatccttcccgttgatgacgatgaagatttccttctgtacttgagtgatgcctgtcctgagtttagaaaaccattaactggctctatctcaattgcatcagctggttctatgtccacatcaaatttacttcgagcttcctgcaaatgagaacgtatatcatcacaagtaaatcatgctgacagccataaaaaacgttttgcactaagctgacattgaacccagaagactccatgacactatgaaagtaagcaccatccacttcggtggtgtgaccagatcattcaggcctttaacaagttaactgttctctttttttctcagaaaaagagtgtccaaaaggaaggaagaattgatatgcatgaagtatgattgcatggatgttatgccatatatttcatagtaggtaaaagcaaccagaaagaccttatagcataaaaacaaaacaaaaatat

SEQ ID NO: 70118 - DNA, 550 bp, Oryza sativa
agctgacctgcctcttcgtcggtcatggccgcgttgtgacggcgccggcggccggaggacgggacgaagctacgcgcgctgcggcggcggcggcgatcgactgctggtgttgatcaggattcaagggagagaaagatagattgttcatgggggagccaaaccagaggaggttgtaccaagtctggcagggaagcaacgtacgacacgatacgatcatctcgcctctctcttccttccattacttctctttgaaaatcttcttgcaacctgcaatttttgttgcgataatccttgtgaaattcagatcaatattttttttgtttacactttgagatgacagacagctttgctttctccatttttttctttttcagaaatttctctgcggcggacgcctgattttcggtccggatgcgggttctctgttcctgtccaccgcgctcatagtggctcctctggtaggcctatgctgcccatgcatcacaaagatgaactcgatcaggtcagagaaacaagatcttggccttccctgtcgtcattgccaccatcg

SEQ ID NO: 70119 - DNA, 2429 bp, Oryza sativa
  unsure (1)..(2429): unsure at all n locations
tacgccaagacaagacgccggatatcgacttcagagataggcacgactagtcccttacggtgtctcaggatactgtcaggagagacgaaagcgctatctctgatctcgctaggcacaggttcgaggaggaaggctaccctgttgtcgactacgagtcagatcgtcagactgccatgtcgacaatagttagattggctaccccaaatattgtaatggtgtgattatcatgaataagagcaataccggcttcggccaacaggatatagggttattatatgacaattcaggggcccgaacctgtataaaaatctctgtctccatctcttttacgtcagtctcgcgtatatcctagtaccaacgatccccatgacatgcaaataccgtagtcgagacatcaaacgtcgacagtggcacgccaggtagagggattttggtgcttcaggattttgacaagatgggtttaagagatgaattctccgacaacaagctactcgacaacttcgctgttgggtgatctgaacctaccagaatacgtatcccgacaagatcggaaccatcgtcgtcaacaaattcgatttatcaagatcgctcaagcttcaacacgtcaatgccgtggatcacatcaattttgaggttgtcaatcaacagtgcagacaaccttcgagattgatcagtaccaatacacgcgccacatcaactggtggagggctcgattaaccgcgtccaagccgaacacggcatcgatctccaccaacaaaacaagcgcgtcgtggagcggaaatcaaagcgtcggattgatctgcttattggtgtaaatgctagtcggactcggggagtttccacgtctgcactactatccaatctctaggcagcaatctgattcggggctaaagacaaacaggtcaattaaatgaccagattacatggtacgtgcacgggggacagtaccatgcacgaaaaagcatattaaggagttgttgttcctcaccaagaaggcaaaggtatttagtagattgaatctactaatttcgtagatacatctagcatgtatctacaaaggtacgcaatattttatatgcaatttatcgtacctattcagatcatacagcattgtcagatctataatttattatgtttacctagagcatgttttttatacaatatttattatgcgagtgtttccggtgttaggccgacaacggtctaatactggggctcgctctattctcttttgtatgaatcatgcttgtttacggtttacataatgcctaatatttacatctgctcgttacatcctgataatactagaagatccatgcagttttctgagtacatactcgatattatctgctatatgtcttgtcttctagaaaatatttttcaggaacaattgagcactcgactaggttgtggtcaagtacaccgcattatcgagaacgatctcgacaaatgcagagtcgtcacgcccaacccaccaacgaagaccgacgacctatctcatagcacccgccatggctggactactcgagaaaaggttgttaacagataattcctcgcaagcgctgtcggcttgatcacccgacatgcatgcgaacggacatccggatatgctacaagttgggtgtgtgagtcatgctggccacatgagacgcacatgtaataaaccaactctagcacctccattggtgttcgagagataactctacacgttcactggtcctcgagccagtacatagcaatctctcgcactgcaacctccatgtgttcgagagataactctacacgttcgctggttctcgaaccagtacgtagcaatctctcgcaccgcaacctccattggtgttcgagagataactctacacgttcgctggttctcgaaccagtacgtagcaatctctcgcaccgcaaacttctattggtgttcgagagataattctactcgctccctggtcctcaaaccagtacgtagcaatctctcgcaccgcaacttccatggttcttgaaccagtacgtagcaatctctcgcatcgcaaacttccattggtgtcacgccctgaagttcccctcccttgctctaaattcataaaataaatcgtccgaagaaattgtttaatttaacctagagttgaatccttaattaataaatgcaaataatcatcggaatcggcatgtggaatttttcttggattctacatgtcaaaatatgctaacaggatttttagtggaattttcagagccttggaaataattttaaccaattaaaataagcaaagtgcaatattaaatccctgggaaaatcctttttcctttttatctttcctttttccccctcttttcctcctttgggccgccggcccatctctcccgccccctcccgaagtccaggtcgcctccccctttctccctcgggtgctgacaggnnggggccc

SEQ ID NO: 70120 - DNA, 691 bp, Oryza sativa
cacagtaaccttggaccttctcctgaagagaacaactgcaaaaaatgaaaggatcaacaataccacaactgaataagcgacgacggcagcgattccagctgcactctttttcttccctgcaaacaccaaacatgaacttcaattggggaaaccttgatttcactgtaacttctgttatttttttttcttcaggaaaaatgaagaacagagtaggtcatactccatacctgctccaggctctagagatagaaccggagcctcggctgctggtggtggtggcgccgacagctgcagcatcgcccggcctccgtagaacggccgcacatttccccaatcaagctgttgacgcttgtcggcgtctgatattgataaaaaaacatgttgagagtgaatgatcagcttgatgttattgaactttgcagagaaaatggtgaagatatttagctaaaattgagtggattagtaagtttggtggtaccaaagaggatctgatcgaggctgcggttgggaacaaactcatagacgagaagcctctcctcttgctccaggcagacaccgacaagcctgacaagattcttgtgctggagctttgcaaccaatgcgagctcgttcttcagctctcccactccttgtgctgaactcttcgataatctcttcactgctatttcatcgccatcaggcagagtaccct

SEQ ID NO: 70121 - DNA, 1228 bp, Oryza sativa
aacaagtgatagaaagaaatgtcattattcgtgattgtactgctcatagacaacttcagtcagatttgattgagcatatttggctaaagtttgggaaacgaagttaattaggtgatcgtgcatcattttaagtctagtttacaatctgtgtattacatatactacttcatatatagcttagcagtaacagttgaactaaataactacttatttttttccgtaatgtgattttttaccttacatatactgacatctcttcttttatttccttcctgcagataaggtcatgtctaatgtgttgctgctctacctaatggttgaagtgctcctgtctgctggatagatgaaatgctcctgtctgctggatggatgacctaatgtccattggatgaatgaatttttaatgttgaatgtcatcaggctatctaagttattatacttatgtttctttattttgatgaactgtgtcgacgtttgatatcgcgattccggtatttgtatagtatggggatcgttggtactaggatatatgcgagatgtaataaaagagatggggacgaggatttttatataggttcaggccactgaattgtcaggtaataaccctactcctgttggccgaagccggtcgttgctcttattcaccataatcacaccagtataatatttgtggtagtctatctaactgttgtcgacttggcgatctcaagtgctgactcgtagtcgacaacagggtaaccttcctcctcgaatccgcatccggcgatatcaaagacaacgatatgtctctcctgacagtatccgtagacaccgtaggggactagccatgcttatctctgaagtcgatatccgacatcttgtcttggcgcatgttggcttgtatattgatcttgtgtcttgatctattgttccgtgtcccctctcctcctagggggccttgtatttatacccataggtgtccccttgtccaagtagaactagggaaaccaatatggatacaatccgagtagtcattgtcgtttccatgagaactctattcatccttccttatgcggaactcctcctatctccgaaggttatttccgtataagacatggtatgtggtgggtcatgccgagatttagtcaactactattaggtatgtgttatccataaccctgacaaactgatgttatgaaagactaccagtttgagtgctgctactttgttatttatgggtacctattta

SEQ ID NO: 70122 - DNA, 3171 bp, Oryza sativa
ttcccgcgcctccggttgccgtcgccggcgaccgtgcatgcgcgccaccgccctcaccataaccggtcggccggtttgaggccgagccgagccgaccggacgtctcctcctccccatgagccgccgctcggtggggcccgcttgccagccgcccctctctctccttgagtcactgacccgcgggtcccgcgtgtcggcgccacccctccttgtgctgacgtcagccctgggatgaattattgcgcaataaattgattaaggctttttctttattagtaaaaacacagataatcttctaaaaatcataactaattcatccgagctccaattaagtccattcaagtctcagtaaatcaagaaaaatgtatagaatccattaaaaatggttttgtttcctgttttagtagtcttatagcatgttttgcttgtgtgctttgtttgtagcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgccattgatagcttgggtattaaaatgactagatgttggtttaggagatgcttagccatgcttagttcaactaatgcacaaaaggggatcacactaaagcatagactttgattattggcaatagctttggattagtgccaccgcaatggtgttggtgaattaaagtacactacatggtgggctgtgggtgcatggttttgctagtcgtgcccatggcgattaaggaccggttcgcgggatgccctggaagaacttatcgtacttaccacaagccagcgtgggcaacggctgggcttgtagtgtagcttttctctagccgacatacccaggcgagggtgggcgtgatggagttgggtcggccggggtgtccggttgatcggcttccggattcaccgcggcacgaaaggggggctgcccgttacctgctggggacggggacgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttataggcggtcgaccagattcaccgtgattagtctcacccctagtttagcttaatgaactagtgtagttcaggtggttggttgggcctgttgcaacgtggcgtagcgttggacagtgactggttaatattgcttaattactataactgtttttactgttttcaactactggttttaaatgcccgctttatgcaaatgaaccccgtagcctcctttggttatatcctgcatcatacctcctcttccggtatgacttgctgagtacagtgggtagtactcagtcttgctcttttcccccacaccagagttgaagttcttctcagttggagatgtcttgaagaggttagtttcgtcgctgccgtcaagggttgcctgtggaatggaatcgcccgctgcaggagtcaagtcttcaggcttagctcgcttttatctttttccgctgcatttgtattctttcatatttttgtaagacgtggatctgtatgtcaacaattgtcatttgtgtaccctggctagtcctggacaagggtttaatacacattcagcttagaaattctggttcgtgaatttctgggcgtgacaagttggtatcagagccgaccttgaccgtaggacaagccaactggaaaacctaagagccctctgaaccccttttcatatgcacatgccttcttcacttggatttgtttcgggaaactttggggtttgatcttttgattttgggagaaaatcttggtcgcctatttaatcggatcttttgactagggacagtccagggttttagcaaaactttatttggaatttatttggcagtcagtcgggaattgttaggtggtatgcattaagttgtgtctagattcgatgggatgtagtctttatgtgcatcattattatcatgcatttatttcatgcattaagttattgtttagtcagttgcattagtgtcttttgtctgggttcatgaaaaatgttccatgcataaaaatcatcatgcttggctagttggttgggccatttgttgcattgtttaaatttggatttgagcatgcattgattcctatcccttgtctaccttagaagtcagacctgttcttcgatcgcaagcgccgctccgagcttcagagtcaccgcccttagctttatcgtcttcttagtctgtttgcgtgctagtttttgtgtttaggtttgttgcttgtgggttagtcggcggtcgatatcatgtgtgagtggtatgacagccttaagtaggaattgcgtgcctctttttcagtgttttaatcaagattaagataattgcacttaattttataagaaagattagtttccgagccatttgttttcttcctttctcttatttctacctatcctcatccagatggtgaagacaaggaatgatccccgtgactccaacgacgccagtggcagcgaagagcagacagatgaagctcataccagtggtgcacctggtagcagttcatctccaccgcccgagaacccaacagtccctcagatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgtctggtgggataactacgtggtgacccgtccagatgcaacgaaggttacttgggtagagtttgtcaaaactttaggaaggcacagattcctgaagggattatggcacaacagaagagagag

SEQ ID NO: 70123 - DNA, 886 bp, Oryza sativa
ctatagggcgaattcgagctcggtacccttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaataaaacaacatagtattggattggacacgtacataataaagttgtttattattattattattat

SEQ ID NO: 70124 - DNA, 27502 bp, Oryza sativa
gagagaagggaaaaaaaagggaggggaggggaggggaggggagggggggagtgaatgaggaagaaggagattagttcccatataatgttttttctggaactgtccctattcacatcaattgctcaactggctaggtgagcacttatctttttaaagtagctcactcttttagaactagcaaaggtgttattaaaagtttgcatgcatgtatctcatgggttgggattttaatattctcatagaaattattctctacataggtcttggatcacataataattaattccaccagttaagcctctaatcgttttagactgcacggacccccggccggactcgacgcgcgtgccaaagtgcgtactacggcgacacgttcgagctgttgagcaccgcgaggagatcgatcgattgatgctcctctccgaagtgaagtactgacgttgatatatcgatcactctcgatacatacgtatatgatcaccgcacacaaaactaaacgtgcgcgcgctagctcgatcgtttcagtgagtgtggtacgcgtactgtcaatcaattatgcatgcatggcgcgccgatcccacatccccgaaggccgtacgcaagtcggtacgtggtcaagttgcccacctgagatcaaatcgcatctcatcccatcgcatcccatcgcatggtgccctgctgccgaaggcaaagccatgcaacttcatcccaagcccccaccccccgcgcgcgcgcgcgtgcccgcgcacatttacctcgccaccgcgtctgatcgatctcgcgcgcgcggttgccggagaaatccggcgtgtgtgcgcgcacatgcatgcggtcgacgggcaggtaggattttccttggcgtgtgggaacaccgcgcactgtatcgtggcgcctgaacctactgagatgtggagaggcacatacgagagtattctgcagctcgattgctactccctcctactagtactagataggtataggcgctattagccaaagctagtggctgagaccgcgaggaggccggctgggctcgtgacttccgcgcgcgccaagctaaggccgtaagctaagctaggcgtcgtcgttggcatgtggaacccagccgaaccggagcctcaaattcccatggaagcatccacgaaccttctcatcgcacacctcgctcgatctcatatccccgaaagaacagtatgtgtgatgcgtgctttggggcactttgggcttacgcgagggatcacgagctagtacagtggtccatcaccatcgatcacatgcgtggtggtcgtcacgctaaggtagtttgtagtgtaagactgccggtgccagttgacaagtatactcctatgtcaaccacaattgcatatcgtgccgtctttaggcaaatatcgaagttggatttatgctgatatgggagagaaaatgggcaaaaagatagctttataagtattgaccatcgtgcattatcgaagaaataagatgggagggacgacgatctttctctgcagatgttcgataaaattgaaatggtacatactgatatatgtctaaaactgaagggatgacgtgcacaggtcgaaaaatagtcttttttttacccggcgaaaaattcttgcctagatcgagaagatacaacaagctcatcattataaagcatatagtacatatcgatctcttcatgaattaattagtaatatttcaactaatagtctctgctattattttcatcaaaagaaatattatcctctgttatatgcatgtgtttattgtatttgtaattatatttgcacaatattaattggtgttatttgacaagcaagctgctgctacgcaacccgctgattaccatattgtttgtgctggctgcggcgcagccacaacccatgcagtcgaacaactccatcgctagcaagccttaaaaagatagcacatgctatgctatcctttattgtatgacatggcacatatatatgataaaacaaaaccaattaattaagcatggttaagcagctaactgtgacaacccgcaatgcatggtagctagactttttttttctttttaagtgacaccttactatttacagacgataattaagagaccgctactccctccatcttagaaaacccaactttcccagaagttgtttttttcctaggacggggtgaatacaaatctacaactgcacaatctatgttgaatgcaaaaccgacgatttgatatgtggatgcgtatagctatgaatctatatatttatatacatctggataattgcgtacaatcagttttgctcacctgcccgaggagacaaaaactataaaagtacgtatcaccattcaagggaggcaaaataattccaaaataaacagaaaaacggtggggttttggttgttatcagctgatgatttatccatagtctgactagctatctatagctatagtaactggaatacttaaaaaagctttcacgttgatcagaaaaatctgatgttggttagatatgttgtgttaccaaaaatccatagatcacataaaaatcagtgttaaataaaatatactgttgaaaatagcaaagactcattagtttcgttcctataatttagtaatttataaatttgaaatttataaatatgaagtttctttgtattcattttaaagtctcggcttagtttttcgttgtttagtctcaaattaaaaaatactaattattaagttgtagtaattgatatggactcatttttaatgaccacaaaatagttcctaaaacaactaatgtattcaaatacattaaaattttaattaataattaaattttcttatgttcacaatctggcacaccaacaatattgtccttgcaaaaataagatccaactctcacgagtttacgagtagtactgttaaacacatacatagtatacctataactacttttctttctttttttttttgggggggggggtacctagctagctacttttctcatgttcaacctggcacacacgaaagaaaagggcatatagtacatatatatctggccaatggataaatggataataccatacatccataaggcaattttaaggtaagcgatatgcgcgagtacaacgtgccactttgactagttgcagcagcttctgggctctagctgtggcaacgaaagagaaattcgtgatcaggagatccacaacgacgcaataaggtgcaacttgccccatgaattgtcgatttcacaacctcacagcgactttgcactgattcgttgcggacaagcattggactttccgtttcctgcgcctttctgaagtcttttagtttgagggggtacggggtggagaccccctttctcttgataggcataatgcacttttttgttggtggaaattgatgatgcccatagttgctcaggcacagagagatagagaagaaagaactcagctataggtaggatgacccagcccaattcagagaaaatctaatctagatgattgtgaaatgtatggtgcgaaaacactagccctattgacatgtaagttcatacatatcgggtgctagcttaggtctcagttagttcatttatattaattagcagcacaaataacaccgagtgacagcgattagatggataagatcatgcatgctctttatttagtgctttacatgattggaatggctgaaaaattgagagatctccgcgttcttttaacccacaataatatcaggtagtacactttctgctctcctgatgtcattaattagcaatttactaggtaacacgcgctagtgacagtgagtagtggctaatgtaatgtgtgcaccactaaagtgaacaagctaggcaaacagcgatttcctaattaattaatcagcacattcttcttggctcattttaatcacctgtcagcgcactagcaacggggtgaaatgcataagctaggccagaaagattgatgccctggcatggcctgttttgacttttaacttccctagatgaacaaaaagtctaaacaaagagatttgtctccaaatcttgcctacaacaatctccccctctttttctataaaggggcaggagacctacgcataatctacagcaatctcctgtggtatttgattagggctaatgcgatagctttcgtttcctttctttattactgttagagttgtatggcaaagatctgattcttatgctatggtataggattgtttgaaattgagtaatttgtgctgatcacctattcctaccaaagttttaatttaggcccatcttaaaagtattattttcactttgggctaagtaattctgacaaaagttgaagtttataccaagtaacctacatgtcatgcattgtgattaaccatatatgttactgtccatgtatcaattacatgtggaccacttggttcaaagcgcaacatttactaacaatacctaatcaaagtgaaaaaaaaacacgtcaaagataatccaaagtaaaactttgaaaaatatatagtaaaaaacgtaatttattcaaacatcatctctatgattatttgagatcagtcaaccagtcgaatatttgtgaaactctcaatacaattattttgtgtactattacagttgtctactctctccatccctaaatataagagattttggtttgatatgacacatcctagtacaacgtatctagacatctaaatctagatgagacaaatagtatttcttgatcgtcgaaaatatgtacaagcaccggtgattatagcaacagagcctacacaaccacctgactagctttggagttacctccttcattgtttatggtaccaatcgaccttcccttatgtagactctagacaccttaagttatattcgtaagtacgtttttcaaactattaaatgatacatttaattaagaaacttcaaataaatatatttaattatgaagttataattgttaatacataataattatgtactaatcacccacgtcgtgttattcgtggcatagttaagctaaacctagcatggtgctgagttattatctctactttcccaactaacttcactcgttttttgcacgtacgttttttaaactgctaaacgatgcattttttataaaaattttctatacaaaagttactttgaaaaatcatattaatctatttttcaaatttattttagctaatacttaattaatcatacactaaacactgtttcattttgcgtgctgggacacccgagacactgcattgctcaaaacgtttcgaaatggacgatgtcgtacatatatgcgtctccaaagtccaaacccaatcccatctctattcaagaaacagtaccacagtacagtacaatggtacgggtgctagtgctagtgctagactgcccctagccagccgctgcgcgtgcagaagcagaacagaacggacatgtgcagcttgcgacttccgtcgtcgacgaaacggacagacagagtgctagacgggcagtgtcccagtaggaactagaaaagcaaagccaaacccagggaaaaaggtagaggaaaaccctcggctcggtcggccgctctactgctactgggtgtgaagcctcgcaagcggaaaagcgcgcgcggcgagggagatcggcagcacgagcacgaggaggattgaaccgaactacgtctcgctctcgcgcgccgagtcgagtccgcccgcgttgacccgtccgaacccgcccttgacctgctgacgtgtgtggcgcgggcgctggcaccgccgccgcgtctcgttgctcgccagactgtctttaatttgccgggggccacaccgccccccgcggcggcggcggtgcatcgcgttgcgtcgcgtcgcgcggatcttctgctccgcccacgacgatctccgcatgctccgactgcgtctgcgtgtgctccctaaaccgcacgcaccgtgtgaattgtgatagtctgattagtgatttagatagctcgatcagtgagcatccaacttggcacttggtaatcttacaataataattctccttccagaatgaaaagaaaaaaaaatgaaggggtcattttatacgatttgcgaaaattgacttgctggtactgacacgtcaggctcaggccccacatgcctgaaattccacgtcgctggggccagtgacaatgtccacattggtactacgtggtacgtgattatgcgggaagaaatttccatgcaacgcttccatatttgtctgtcaacaattggctcgccgctcgctgtcttgtgcttgggagttcacagtgagcgtgagagcatgcaaaatgcaacacctactcatgccggcccggcgcctgcgttgagtgcaatcacgcatagcgcggttagtaccgtctagttacagcaacaatctactactcgctatacgtacctgcatgatcactggtcttttgtgaaaaaagaactccatgatcactgatcactagttaagcagtcaggaaagttctaatatgtactctccgttccaaaataattaacttttatacgcaaatttagacacagactatatctagattcatgtgtaaaagttgactttgtttttgatagagggagtacttacataaatattttcaaagaaattatatatacacatgttgatattttaataagggcatctttggagaaaactttaacaagtgtagctagacattttctcgctcccctgaatagtctagatatttcgacttctgagtagatagctacataatccattaaatgattggtgatctaaagttggccaacttatctaggttctcatcaattgtgtattcgctgagtgcttctcgcggaatccagctctccaaatttgagtaaatgaatgtctagatgacatgatttctcaatttaagtactactccttatatctctcaaaatataaggacttttgtcaattttatgaccaattaagcagtgagataaaagttcattatgtcccttattaaacaattaggaattggtggctgaatgttgggactaatccatcctggagtataaattaggggtttaaatctgattgcacatgttatataaattatatccaaatactactatatatatcactaagattgtaggacccaaggtataagttaattatttaagggcggggcttgttgaatttccaaagttcttttataagtaacataaatgatcagtccctaaacttgtgggggtggtgtcatttaggtccgtgaaattgaaaattatacatttagatccgtgaactttgtttaatttaccactcccggtccaatcgctctttgacacagctaactgcttaggtgacgtgccacgcaggcaatacttttgcgcttagacccctccgcatcacagtgcgccacatataccctctttagctacaatgacacccgaatccccctaaaaatatccccaaatccttcctccctctcattcctctccttgcacatacagaaaatgatgccctaattaataatcgtcattgttgtgcactccacaatggtcctcttcttgcacaacgagcactttatcaacggtaccttcttctggcgactataagacgaggacgagtttggagaagccatggggatggcaagtgtgcaagcggcactaccccgcctccccccactaattgatccacactgcgctacctcccgttgctaacctcgtcgtcaaaaccctagccgattcagagatatttgggaggttctgtttggaatgcactgataagggcaaattatgtaagaaaatatatacaaagggggataaagtgcaaaaatgttgtctacgtagcgcgtcatgctggcggtcagccgcggtcaaaaggcgattgaaccgagggtgatacactaaaccaatttcatggatctacacgcgtaatttttaagctcatggatctaagtgacaccactccacacgtttagggaccagtcatgtattttgacatgaagagagtaaaaaaacgatgcaaacaactttgaatttttcaaggttttgttagaaattaattcaattcccgccaaactcctctgaaaattctccattccaaagaactgcttagtcggcagatgaggcacacacttcgccatcaaaattgggttacagccatcattccgttgctggcccaatgataatcatttcccgttccgttttaccagttcaacaatcagcgactagtgtgcttcctttttcttttttggaccaattggcgtgctaattcagagatagatagagaaagagaggagaaaaatatcagcgaatcaacaccgagaaaaccttctcatggaagctgacagttcgcgagtggtgcttaggtcggcccagccacgacaatcgcgcgggggctcttttctcaggttttccacttttccttttccgcttcttaattaatacaagtgtgaaactacgaagaggaaaatgtggctagcttccatgatttattttaaaatattttggttcttttttaaacattttttaggtatacccttagaaaaaattattgtagtaatggatcacttctgacgctagtcaggttagtgccatggaagtggatcagtgatgaatctagaatgaaatttaagtatgtgctcatatttatgtaaattattttagcggcaaagtaaatatatatatgcctatcattttttaaactcaattaattaatacataaacaaaacaaagaaaataatgaattgtataataaaatcatgattcgaaactgttggtgtggtccatggccatgtcaatagtttaactgtatggccaaattactttattggtttttgaaacattaaaaataattcaaccaaaattgacaaattggtattctcaacgtttactaattggcacatcaggtacaatctcagaatctgctcatcaattatgtgataaggattaacaagctaacaagaaatttggttgattaatctcacaacttttaagttttcaccattctcattggctcttagtaatcagtattgcattcttgcttgcagtggctgataggttggagggcagatctggcccttaagccccaactatgaatccgcccgttgagagggccagggggggaggggggttgggttcgatataatgccgttggcggagccattggatctcggtgctaatgaggttggtacctaaaaatgattcatttgttaatacgttttttccctacaatctattcataaaaaggtttttaaaaagatcaagatgtaaacaattcacgctagctccccttttattcttttagagaacacacactctcgctctccattttcactcccttttaattcccttttccttatctgtgttttgaggtgatgcatgcaacgccgcttggctggctgggcccacagctcagtcgcatgcaagagtgtcgtagtgagcgtagtagcagcaagcagtagcagtagagctcactcgctcgccatgcgcgtgccgtgcggatggtttttagtgctggcaattaaaaagcatatgtgctcgacatccacttgggtttcagggctttcagagctgatcactcctgctctgctaatgctaacgttaatcgtcactctcacccctcccctcgtctcgtctaaattatctgaacctgacgaggtgatgagttgcgaaaacaacgtgtgtagtgtcacgcagaaggccacgcggatcatcacatctggggagagcgagccgtgtcgatcgatcgatccgatgtaacagcgcacgcgatcgatctgcaccgaattctcgcggtagaaaacatccgtgtcggcataaacaaatcgaagcgatctctcgcaaaacgctcgctcgcggtcgcgatcagcgtaatgataaccaagccagccactgcaacaaaaaacacagaaaaaaagggagaaggatcgagtgcgcgaggatcacaattagcggcgagaaatgggccggggatattgtgtactagtgtaccactcggctcgacactggagcatgcaaagtgtagtaattaatcaagacttgacgtcggagctttgcttttattaccggtttctagaagtgtacagtaatcctgtcaatcctacagagttcagctcgtacatacagtagtggcagtactgtatttactcaaaaagaatgagtaaaatttaacggacaaactttagtaacagcagcatcaacactagtataacggctacactttaacttctttttttttaccctaggaagtaaaaaaggagaaagaaacggaaaagaactggagttagaatagtctgggagctaggagtccaaaaatggcatcgtgaggcgattaatcttgttctaatcccccagatagcttctctccttcttctaatccgcttctccgctccgctacgcgtccccggcggttgtgcacccgcgggtgtcgcgcgcgcgcgcgctcgctcgccgcggcggattcccatggcggccgtgctgacttttcacacggcggcctgggtggggcaccacagctggtcgtcctccatgctcgtccagaagctatcgacgtcgaagccgccgatctcgaagtccgcgacggcgaggtcggggaaggtgaggccaggcagcgacgactcggacgtcgtccacgtctgcccgccctggcacggcggctgggccagctccagctccgtgtcgcgcatggccacgccgccggtggcgctggaggcgtcgcaggcggtggtgaaccactcggcgccgtcggcctgcgtgggccagctgggctgcgccccggcgccggagtccgtggacagcgacgacgacccggccgtggtgctcgacagctccggtgcaggcgtgccgcccgactgcgcgccgccggccgccgcgcagtactcggctggccagcagctggcatcgggcgccgggagctccggcgactcgtagagcccgtcggagccgccgtgctgccacgacaggggcggcgtgtcggtgccgccttcctgctgctgctgctgcccggcggcggcggcctggatgcgctcgacgaggcggggcatccagaggtagcgcatgacgtccttgaactgctggctgttgacgtcgcacttgagctgcttggcgtgcttctgcacccgcgtgcgccagtagttcttgatctcgttgtcggtgcgtcccgggaggtgctgcgcgatcttggaccagcggtttccccaccgcgagtgcagctccaggatgagcagctgctcctgcggcgtgatgttgcctcgccggaggtcggggcggaggtagttcagccaccggagccggcagctcttgcctgtgcgtttcagccctgcatgacaacaaccaaaaaccaagattaatttttctcttcacgtcacatcaaaatattcacatgtagtacaccattgctaaaacatagtatgcagcaactaatcaattatatactaatgcagttatacgcatacgacgacggcaggatggatgatgtaacgggggagggatgagcaactaaaaatatccctatgaacaatgctagctacgctgctaaccactaaaaattctctcccctttccctctcactcactatagcttctagcttagctggttggctgctagagaactcagggtagactcgtagctatctgtgtttccagaaatcagcatgtagatgcaagagcgactggtactttgcgtcctataattgctcatcaggctaagcatgtacggacactcagctcatggaattgatcgatgtgtgcgtgcatgtaatttatggtggaattgggagctcgatcgatcgagatcgcgatcctacctgctgatcgggcgagcgagttccagcggccctcgccgtgcgcggcgatgtagttgacgagcaggaggtcctcctccaccgtccacggcccgcgacgcaggtcgccgcccatcacctcctcctcgctgctcgcgtccctctcgtgcgccatgtccatcgtcgaccgatccggatcaaaatccctccctttcgagtctcgatcgatcctcgcgggccagtcgattgatcggatagatcaagctagtagctagatcgagctcaggagattctggttgttgtgctttggtagaggggtactatatatgcgccgttgctgtgctctctggatagatggatggatggatggatgtgtgctgcgatgaaactggcgggagacggggagggaggtgtcggggtttatatagacgggaggagcgcgaggagtaagaataagaaagaagaaagaggcgggtaggctgggctggacgacttggaaagaaaggaccatgtgggggagaacgccgcaaccggggagattagtttacgccttttttgaagtttttttttcccttcttcttctttaaaagccaaaagtttaggcgattaacccccatcgtggttaattagggataatcatgcgattaggattaattaaccacgccgctaatttaatcgcccgcgtacgtacgtacacgggttggagagactcgggggacttttgcggtgggtttgacccgttgactcgtccagctgtacaggcgtacagctcactcgcgcgcgctacacgcgctcgcgccgtctgcctacgcgggcctctgccgctggggcccacctgggtccatttctgtcagccagttgggagctacctcagcttctagttccggtgggaaaagagatacggagtaactacgtataccttatagccatggaatacacaactgatgatggtacagatatactgccactagcgtatactactacttactactactagcagtattggagcatctgtggcaaatgggcacaataattgctgctgcacaaatcacaaatactagtacgtatactatcggtagtgtagtacaccggtacggacaagtagtggtattatcgcaaacatgcgtgtacacctctagtacagtgcgtctgtgcatcaccatggttctacactccagtcgtaggtggtagctggagtatattataaaatatcagggcatccacaatagttatctatagactctctataagatatccatatcagtatattttcctacttgaaagagattaaatgaagagagagagagtaaaactatctaataacttggagatagtctatagagaaaaacgaggtaatggatgagagagctatagatatccatgtagacatactattgggatgatttactattagtctagtctattgttgagatgtatatattttatagagagcaccttactttaccattgcgggtgctctcaggttatatatagggttcacataaccgcttgtgaaacttggaggtttcaaagatggatagagttgatgatccgcttagtaagccaacagaagttaataaaattaaaccaaaatttaaactatctgacaattttttgaatttatgtggttttgaaaggactccgtgtgcgaaagggcttgtagcctaatggttacaagagcctcagtagcacctgaggtcctgggttcgactctccatgagagcgaattttccaggattcaacagcgttgtgctttcagtggtaggcgatgtttgtaaacctggttataagtcctatcctatccgaggtgtttggagctagcacataaacttcagctgacaccataagaggtgtatgagattatgtactattttcagtcaagaatatttgatgttaacgttgttatattagtggcactactgtcaaattttatcgactaaataaattactatcttattaaaaatatcgtattaattggataaagaatttgttggattatagtgagtcatgattaaattaattgtgttacatacgtacatctctctaagagttatataccaaatcggattctacacttaaatttagcatagctcaatattgcacacaaaaacaagctacttacttcctccgtaaaaaaaaaagacaaaccatgaattcccgtgtcaacgtttgactgtccgtcttatatgaaatttttttataattagtattttcattgttgttagatgataaaacatgattaatactttatgtgtgacttatctttttaatttttttcatattttttccaaataagacggacggtcaaacgttagacatggaaaccagagtttgtctttttttttttttatgggacggagggattatgtgtgatgtctgaaagaagccagaaacttcagctgccaacccagtagatgagattgcttgtacatattgagcagcaaaattgacttgatcagtctcagaatttcgactattccaaccaggagatcattgttggtggccgaaacgttcggcaaatgttcatctcagagccaccgcctcttcgccgagctttccccgtatgagctccccaggtcccctctgcgccgcgccgccgccttatctatccatcaggaagaagaatatcccgaaagatcttcgcatgatttgcgacgatcgagacgaacaagatcgcctcacctctccagacgcgtgcagctgcagcaaaagcctagctggctggctatagccgctgcatgctacggctaaactgatcgatcgatatcgacagcgatctgtaattcccctgcacacacacacaacaccccctcacgcgtcaattaatacacatcgtccagacgacgttacgtacgtacatatacgcgtttgtcacactagggcgcagcaatgcatttccgctcgatcgatcgatcgatcgattcaactttcgcggtgcaacagtgtgaaaattgctgtacaacagcaggcagcagctaaagttgatatacacagcgccccccgctgcactgtttccaccgtacatcgcgcgcgcgaggaggaggatttttgacccattttgctcggattttagctccgacaaaccgatcgatcgattgacaccgcgagcgatgcgagaaccagcggttttttttgtcaagacgtggaagacaaactccacacatgcggtttgttttttcaaaacaagataattgaaaggtactagtaaatcggtacaagtgttctagtattaattgggcggagtcgtccttgactatttaggctgcgttcgttgtgatgagttatgggggattgggtgagaaaaggacatcgtattccgcgtgcacgcttcccaaactactaaacggtgtattttttgcaaaaattttctataggaaagttgctttaaaaaatcatattaatccatttttaaaatttaaaatagttaatactcaattaatcatgtgctaatggctcacctcgttttgcgtatcttcccaatcttctcaatccccctctcctcaaactcacccttagtactactagtatagagatgatgggagagtcaaccccaactggcaagagtcatattctctcattgatctgccggggtctgtgtgaaacaaatttaaaagtcccaagttgcagctttgtatacgcaggaaaaaaacggatgctgagaagaagagatcggtgtggtcggattccacaccggggttgaaaactttggcagcttgaattggattcttatgtgccgttttttcaacacatggaggtgctgtttttttaaatttattttccaactctctgtttctattttatcccctgttttttcaacacaaatcagtttcaggatggtacacttgctcacttgcttgagaatccggtttgttttttaagctttgacaggctgctgcagcggtagagtagtatagtattgtttttatttcgaacggtcagcagtatagtattgttggtttggattttgtccatgcacttggcgacttgtaaatttgtaattttaaacgagaaaccggaccaaatctgccaatcagatggcgtccacggtttgattcccctgccagcttggcctagtctgttttgtatttgcagagctatgctgattgctgtagttctagtagttgtagtagctcgcaaataaaggtcaaagtgtttgctgagttggactggcgtgctcgttgacccccaactacggccaaggcaaagccacttgtggttaatatattcataatatttctgttcttatgcgagaggtcgatcgatctaatctatgtcgatcactgtcttcatgtgacctgcagcaacgcatatgcgtacaacagttcgtgtccgtgatggtcagtacatcgaacattgctctcgttttggctcttcacgcacattctcatgtgcgtttttttttaaatgttggagtgtacaagtaaatactcgtcctatcttaaaataaaggaaaaaaagttcggataatcttctagaataatcgtggaagtatgaattatccttctcaatttttcatacaggacgaattacccctcctctcactctacagtggttttgattctacatggcacacacacacatagtagtccagtcaacataaaaataaaaaatggtgaggcccacttatcggttatgtcttttctctcgatcaccacatgtgggtcctaccttttttatattttcatattgactggactgctacgtgtcactattacaaaaacagtcaaataaggtgttggttgggaaccggctataggtgtcggttttccaaccgttacctattggccggcatctatgcgaatcatatagttgccggtttaaaggtgccggttctttattttttaaactgtgggaggtcggaaaaggttaataggcgtcggttttaaataaatcgacacctataaaccagtccctatgagggtttttgtagtagtgtgtgtcacgtagaatcaaaactgctctggagtttgttgaggattaatacatctggtataaaaaaaaattcgagagtaaagaatgatttttttaattgaggggggtaattcgtattgccacaatagttgaggggtaattcagaattttttaaaaatataagaatcaagatgtatagattcgtatataaaagttgatttttttccataacaaaggaagtagggcagtttagtagatacggtcaagttgtgtaatgcaacgagatttcaaactttttgttgcacggaattggactctaccttgaaattttctagtattccaaatatagacaaaatatccacactaccgaaccctatggatttattttactgtagcttatattggataatatacaacttttgggattgatattgtgatcatagtgagaaggcttgttgcttagggtaaaaaaaatatttaaaaaggatattacccaggtgtacagcataaccacttctgaccatgatttttccttccaagaacttctagatctgtagtacctccggttcctaaccaaaaaacaaacaaacaaatttgtagccacttgatcagagtttataaacaaatttgtaaccgcaaaattaattaatatcgatcacatcgtacttgccttgaactctcaatctaataattttctaaagttaaaatagtaataaccagcaaattataaactcaaagtggactcactattaataaacataaaatttaatatggtgtgaggtcttaattttattttatttcttaataaaatgatttctatattaaaaatattaaatataaaattgcacttggcttgagtcttgattttagtttaaatttggtaatttcaaaagtcagaatctattatatgaaattgtacatttcttggactataattttagtatgatagtaccaatttaattccaaaattcagtattaatgggcaaactgtaattgagatgattaaattattcttcttttattctaactgtatattttcgaaggtacaaaagccagcgacgaatccttaaccttactgaatccctgctaaatacgcaccctcatcaagtcatctgtgcattgtttgtaccaaccaggatttaatccatcttatataaatgaggtttgtcatgcatatgcatcctttataaatgatccaattaaaatggatgttcaaatttattttctgtttctccgatcaatatgtgattgtgctcgagatttccagttgatatacttcctccatccaactgtccatcttttattatgtatttttataatattttaaaagatgatatattaattaccaaagtgctttgcatgccacatataaccatccttacttttactggataaaaaaacaaatttatttcaactaaaaagatacgcggcgagatttttttagttgatcttatcaagtcgtttcctttcaactttcttttttgcagatgggaaaatgacgagtcgcctgagttgaggaggataagctgctgtggcagcctggcaggaggccggcatcacgtatacaggcacgaccacatgcagaggacaacagtggaacgttgattccgaccacccattttgatgacacgtggaaaatctgcatgcatggggactaataaaaaataaaataatgcatagatatgcactgggggcgatctcagccacaataatcttttcggtgcctaaattatgtaaaaccccccgtttttctcatcaatatcgtttcgcttttcggcgcccagtgcttctttatggactatggtacttgtgatcattgatcgaccactcgccgttagaagaatgttgatgaagtggaaatccggtccatttccccctttttatatatatcgtaatgttttatccactaatgcggcgcattccaacggaaattaaagaaaaaaaattcatagttaccattcttaatattaatctaagaattcatatccatgttggaattttatatcttctcctcatgctactgtagttgaaataaatattcaccgtttgatggttatatgtaggagatagtggtggtagctagctatggtaggagatgataattcatcattcaccattaccacttatctctcccttcgaaaatataatcatttttagatttcgacacggtcttcgagatactactttgaccaataatatgtatagaagtaaaatattttaaataaaaagagttgcatattatgataatttgtttaataataaatctagtaatatcaattttacatgatagatcttttctatttttttacttttaatagtcaaagttaaaaatatttgacttggcactatactaaaatacttatattttgggacggagagagtaagtcttttcaaggagtacaaatttttctagtttatgctttatcgtccatcaaatatttacagaagtggttaaaaaataatgtatatgtagcaatgataatcgaaattcctatctctcaacgctgataaagtgaaggatgatgtaatgtagggtgaaatttatttattttttcttttgtagaggtggggaggacaacgacgacatgggtgagctcgtgatctacctcttctcgaacgtggtatggtcgtgggaaggagaagataagacgataacgttactatttatgcacaaatcttgatgcagtttacaaaatcaagtgaaaatttgcggtatttttgggtgaaactagacagtaaaaaaaaaaaaacttatactgctacgcgctactacctacaggatgattccaagtttgtcgccccattttaatgatcaataacacacagtgagtccgctagtttcttagccttaaactaaggaaagtatcatgtatggcctgtcttttgtgcaacctatagctagctcgtgtgttccattggcaaggcgacagctccggtctcaaaagagccctccaaggacaaggagagccggccgcaatggcgatcgaatagtaccgtccattattgtagagtatacatgtactatctcctaaactactattgctacttccatagctgaagttaaagtgaagccacaattagtttttttttttcatggcaatcgtaacccacgttttcgaatcccagaactaaaaaaaaagtacaatataatctcgctgaaaaactaatcgtcgtggcctcatataaatcaggcacgattgcgtcggcgacgagtaaattaaaataaagagtgcagagacagagagagagagatgcatggctagctcgtgcttagctttttcgtcagtgttatgttgcagctagctataatatatatatatatatatatatatatatatatatatatatatatatatatatatatatatatatatatatagacatacacaagtatgtaacggctaatggcttagtgggagacacataagattagcagcgtgttgttagtggaaaagcgatcgagagctcatgcataattaattagtgacaaacgtgttaatgttcgatccaggaagcactagtttgtgggtcagtatttgtaggcttcaaagggctcaggggtacaaaagctgcaagtataataacctgtttcaggtagtttcgcccgagcactttacgtgttccaatccaggaggcggctgcacatcatcgacaaagtcgtagtagaattaacctgggaagtgttctgttgatcagcttataatatagatcacacgcatatctctactggttttaattttgtcttaatatacgcatgacaagttattgccagttctggtgctagcaaaacagcatatatatatatatatatatatatatatatatatatatatatatatatatatatatatatatatatatatatatatatatatatatatatggtgaaatgttcgtttagaatctcaattcatgggcgttaactaggagatatggaacgaaaggaaccggagaactttccaacacaaggagttgccggcgctaactctgctagccaagataaaggaggaagcaaaaacatgggggttggcgggcgcaaaaaatctcgccgcctggttgacaatgtaactgcctatagttagggccacggccctaggttttttgttttctgtactttatccttgtttgtacagttttcgtctcctctattcaatgaaattgacggcctcgtcgattcgttcaaaaaaaaattcatgggtagatgctacaaattaaacaaaataaaatgcaacagatagtgtcccaaaaggggcactacatgtataggagccattttatatatagatgctgaaaataaggtgttaaaaaatgaaaagaaatccgggatgaaaggaacatccctaagcttaagaacaggctcaagaatatgtcccttaaagcaagcaccacttgtttgatatgcttagcatcaagtaggacaacaattttttttataaaaagtttctatgtaggcacatcatcttggctagctattccttccattttttttctcctactgatgtactgaaacaccaacaaattaaagttgctcatatccttttccaacccttttcctttttcttgtttttgttttcttgcttactccttgattcgagcattttatatcattgcattgaaactaaccaaccgcgtcctacgcgtctgcttgctagtatatgcaaaaaaaaaaaactttgatgaaatctagaagttgcgtttcaaattaagccacagagaacatattccaaactttacacacttctgctttaatgatgtggaaactaaataacaacttgagctctgttttggaccctgcctgagcatatataatcatctgtgtagaacttgacttcttaatgcaatgtgtcagtatcagcacagcatcagctaaaaaaattactaatcagaatgaagaataaaaacatggtgcactgacttttatgcttgcttgcctactcaatgctccatgaagccaacttttttaactattggtgtacaaagctgaagggaactttgcatttgcattgtacatactggtcctccttttcagcaccagtactcctaccactgttggttccaatggtaaagcaagcatataaactggtgcctcccatgatgactaagtttagataaaacatgaaaagctttttacaacatgtgattggatttgtctaaatactctggatgaagcatctgatctgaggatgttctgagggccgggactcctatttcggagttaaaaagcttccaggagagtacaataattggggattctgttttaaccttatcaacattaacatcaaaaagaaaagttttggaggtatacaaaatattatcattattttagctggtactaataatgtggatgatcttttaataaaaatttgtatgtaaaggtctacgaattgcggcagatttagaaagtatatgggacattcttatgctgcaagttagcaagtatgcgcaaaaaaaaaaggtagtatgattaaagaagcccaattgggacaaaactttgtgtcattaggctccatcaagaccgtacattacaatacttgtatatttgcatgaactacgatcgatatggcaacatatgcgtacatgcgaaaatatatttatagacgcaatgacaagtgtctgcacacaatagaatacttggattagaggagtggccactagcatagtgacaaaaagctttagaaagttcttccaaattaaataaatgttgtgtgaactattaattagtttacattatcatgtagatgagagcatacatattcaaaaactggcggaatgccatctacttatcattctgaaaataaaatgcaccaaaacgattttacatcattacggtgcaacggaattcttgcaagcatcattgctgaaagatcagcgagcaaatgcacggtaaatttctttattatgctatagctatatatgtgggattcccctaacctggtgaattaaaatggatcagagagccctcgtagccatatgccataggaaaaggatatcaccaagataaaggacacttatccacacgacatgaagctttcattcataatgatgattctggctgcaaatatatatgacaaattgcagccgttcgtgtatgacagtaaccaacgatatttgcatccttctccctccaattgcacatggatatgtatatttttaggagtcgacgtcgacgtaattagctcagcaaagactcctacatggtagtttttaccaacctactcgagatctcctatcatgagtcgccattaatctagctgatgatcatgactagctccctttgcattttaaaggatgctctctctcaaatctctctctgccaatgctaatggctgccacggcattaaccagcagttcagctgctacttagcacaccttttttcctccttatattactggctctatatatctgatcacacattcacaccaagtgttcgctaatggctagtgttatatggacatatggtccccctcctgccttaattatccattcttttcgagtgattaagcagcaactggaagtaagttaattaagctatataattgcgcaacgagaagagaagaggtctatgtgcgttctagaaccgcactattctcatggtgcgcgcgcgtgcgcgaggcggacagcgacgatcacgcgcgcgcgtcgaacgcgtgagcgcgcactgctcgctctcgccggtgtccggacccgccgggccgtttggccgccgcctccgccttcgcgggcggcccgtatgaacgctccggcctttacatttatcgtgttgaacctgtcaaacttgcattcacgcctcccgcaaggcggcgaggcagtcgtagcaacctactgtcccgtcttaaaatagaagtatttttagcatagtgtcaaattaaatatttttaactattaatataaaaaactcaatcatgtaaaattggtgttactagatttgtcattgaacaaactatcataatatgtaactttttttaaaacatattacttttaataaatattattggttaaaatagcatctcgaagactgtgtcggagttaaaaatatttatattttgaggccccacatgtcagcctcctttaggtcgtctctttttatatcctatacgtgttggaaccggccggctacggatgcgatgcacgactgttccactagtataatctagcgtttgtattagtgcatagttaacggtggctagtgactaatgtactgtacagtacgtgtggtctgctaattgctcatcgctaagctagctcgaccctgacacgattatattgagccgaattagcgtctttgactcgaactgctttcttctacagttctgctgctacacgtatacgtactggtgctggctgccagtctgccacgatcggacgtacactacatttgttttatctgcaaaccattaaaaaatgcgtacaaagtcagtacaagtcgccagcttaattagtttagcttaaccgtagtttaatacttactccggccgtcacgtgccgacctgacgttagtagcttttggactggagatgggtcccacacgtttgactgacggacccgacccgggtcgagtcgatgcgtggcgtcagatttctttactccaagcgacctctggtcaaaatgctgagtagtattatccaaacgtgcaggataattaattagggtgtcaaaactaattgttccatgtttggaagcttttgcccatggcgacaaatggttagggctgcaaagagtgtgcaagtggggatcaagtgacgatcatgcattttggtacaggacaatgcctttgaccttctggggcgttaggtgccaactgatgatgatgcatcctgcaaaaaaaaaaagggagggggactttagtttgttcgatcgatcgtagtgtgccgaattatatttatttagggtttttaagttgtgttgatgtcaatgcaaggtggttacaaaaatgaggacttgttgggagcactcatttggcttctagaagagattttggtagggttagttggtgattttctgatcaaatttgtgcagaaaaggaattaaactgatcgatcgtccgatttaattagttttttttgtgaggattcaactagttagtttgaagcttgaaaatgttcacatctttcgaataaaagaaactagtctgagaattaattatttatgtttacacactgctatatattgatatatatcgacggcactgattaaatatgcagccacaaattttcctcaaaacaagtatgctgccacaagttaagtatatatacttccttttgaaacctcacaagttaatactaaatccactcagaacatgtagtgcttacccattactgatgttcctgtgaatgtatatgttgatctacagactggtcactgtaactgctgaagaaattagatgtactgggattgcatatatgccagccgagaagcgagaatgtattgatcacacgcagcatttcttttgtcaggtagggttacatatataaggctcattggttcgagttgctcaagagtaatgaagaatttttgtgtgtgccactataggacatatagtacatatgtaatatccggagataacaccatttctcttgtttaaactttgaataaaccaagcgtgcaatgaatatactactacagaagtcaaatagtgttgagtatgcaaagaaggatgccactagattgaactggtttgactcaaaacaaattttgttattttatttttacttaaggacaaaattgagtaggtgcatcagggagggagtactaaagttgtgtgatgtggacgaagtaaagtgtgtgcatgattctcccacttagattaaaatcttgtttgtcacagttacacacataaatgtagtatctttagaattttagtgagacctacggaaattatttttcggctccaatcttaagtgtgtgttaaaagtaacatattcatgcatatgctccgtgtgcattttttaatgtgatcgaaaaaaaaaaggtatagcagtttaaaaatatatagtccctccatttagactcatcactattatgatttgattttcttttctttcattgagggggacggagagagtaggggaaaaggtataaacattcttttttttagaactggtataaacattctagaatgttccttatcagcaagcaggtcctagaaaattatagtaccatattttctttggagaatatagttctgtgtttagttgtttaggaaaaaaaatttgacgtatacggacacatgtttaaagtattaagcgtagactaataacaaaataaattatagattgcacctgtaaactgcgagacgaatctattaagtctaactaatccgtcattagcaattatttactgtagcagcacattgtcaaattatggcataattaggctcaaaagatttgtgtcgcaatttacatgcaaactgtgtaattggtttttttattcacatttaatgcttcatatatgtatacgaatatttgatgtgacggaaaagttgaaactttaaagggaactaaacgctccagtactattggttgcaaactttgataaatttagtggtttagagagaaggctagaggagatcctttgactggagcatcgtcatcgtggtcaaactcgacaatgcatacaacaagctatagtaactgattagctagctactactatatatagtacgtactgataggcaatatcagaagttaacaagattatcatggagataagaactaagggattttctttgaccgcatataagtaaacagactgttgggatgcatttggaatgttggatcgatttccatacggttaccatgagaatttcaccccaaaaaaaatcggtttttgctatatatgtgtcgacaaattattttgccaaaatctattgaattttcagccaataatttggcgtggagattagtgtgtgtgactgattagcttggtagtattagtactggattttttttcttgctaactgctgcatgcagtttctcattgtcttagactgtgtttagttccacgctaaaattaaaagtttgaagaaattaaaacgataagacggaaaagttgaaagtctgtgtgtgtaggaaaattcgatgtgacggagaagtttgaaattcgaagaaaaaaagttgaaatctaagcatggccttagcgtaaatttattagactttgtatgtggatttgatcccgtacactcacatcacgtgcacacgcctctccccctaaattttaggtgtttttatgtatttacatgatacttgcatactaattacatatgcaattttgaaacttatatcgtaaatacactaaaattcaataagtaaattagtaacttacagtgtaaatatatcctgactattttcatgaaaaatatgccgtcataaatattggtagtcccaacaaaatctccaattcaaacagaaggttagttcaaagagtgtttttcggtccttgaggagattataccacattttatactaaaagtttttatctctctcaaagaccataaagttcctcatataggattgaatagggatttgagcattttctgtttcgatgatacatggagaaagattagcaaagtcgattaggaccacaaatttaacagtagaagatatgattcgttctttctaatacatgtaaaatacattaattattattttgtgatgagacgtttgtatattggttttgatatttggttagatttaatcgcgaagtgatgctctctggatgcggttggtcagatcggtttgtacactatagtcagatcggacaaatgacgtgaatagtgttttttgttttttcagtgaactagagtttggttgtgcgatcagaccgagctgagtgcgccggtcagaccggccacctgacggtctgactggctagcttctgattggaa

SEQ ID NO: 70125 - DNA, 2471 bp, Oryza sativa
caagtgcctgcacatgagacggcgcgaggggtgatttaaacagctccaggtaccgcaagaggtcctgctcttcaaccttgttctcgttgtcgacgacgccgagtcttttcatcacgacgcgttgcgcccatggcggtgtgtagggagctgggcgagagcggtgtcttggctgccgaggcctcttcccaaggatggatgtcgccggcggagtcggcctcagacatggcggcggcaactgaagcactgagtggctggccaggctgcaaagctgggccactcgagggtgaagtgcgctcctccagcccagacccagacggctgaagcgggaaaggtcgtgggccttgaagttctctccggcggcagtagactcggtttgggccgaagaagcgccaatccggcccatcttgagattcctgggggacgtcgtcgaagtaaacaagcagatagaagagaggaagcacgcacacacttgtgagttgtgagtcttccactaacgagttcaagtcaaagcggttggcgccaaaactgcatactcgatccatctgactatatatacttactacacgtaccaacaaccaactcaggatataaattaactcagcaaggaaaggaaagattaagattatattggatggaaatggcgcgcgccgtcgtcctgctcctgctggcggtggcggcgttgagctgcactagtgcggcggcgtcggggccgagctgccacgccgacgacagcgccgctctgctggccgtgaaggcggccttcaacaacgcctccttcgagtactggacgcccgaattcccctgctgcgactggtacggcgtcgactgcggcgacgactacctcccctccgacgaccgcgtcatcaacctcgccatcacacgcgacgacaacatcaccggcaccatccccggcgacgccatcgccggcctcacccgcctccggtacatcaccttcttcaaggtcccaggcatcacgggccccatccccgccgcgctcgccaacatctccggcctcagggtgctcaccatctcccacaccgccgtctccggccccatcccgtccttcatcggcgacaagttcaccgacctcggaatcctcgatctctccttcaactcgctcaccggcgccatcccggcgagcctcgccaagcccccgaagctgaactccatcgacctcagccgcaaccgcctcaccgggagcatcccgcggctgctgctgagcaaggccgggcagcaagcgttcctgacgatgtcccacaacaacctgacggggaggatcccggcggagttcggcgccgtcaacttcgtgcagatcgacctgtcgcgcaaccagctcaccggcgacgcgtcgatgctgttcgggtcggggaagaaggagctcgtcagcgcgtacctgtcgcgcaacgcgctgagcttcaacatgtcgcagctgcagctgccggaagagctgaatttcctggacgtgagccacaactccatctacggcagcatcccggcgcagatggccaacatgacggacatgcagctgctcaacgtcagctacaacaggctctgcggcgtggtgcccaccggcggcaacatgcccagcttcgatgcctactgcttccagcacaacaagtgcctctgcggcgcgccgctttctcactgcacccattgatatactcctatatgatatgaggaccataatcatccacctacaattaatgcagtcttaatttgctgcttgcaattagtaatcgaataatcctagcaaagcaaagcaagctaggagtagtatataaataagaaccttcgatcggttcaggttcatgcgtgatgtaatgttttgttcgtgcttgatatggagtacctatctcaggccaccaacacatagtatgtacaccattcgtttcaaaaataaatcaattcctagctacaaatttagacgtagtgttatccagattaattcatagataggatttgattctttttataacggagggagtatgttttaaaggttgggatcaggttttgctttttcgaattaaccgatttgatcggaagtcactgatataccaaaattttgaacaaaatttagttaaatttgaacaaatattaccaaaattcacaaaaaactaaaaattttcagccgaaataatatcgtattagaggggttcaaaatgaccgaaattttggaaattttagtccgaaattttcagccctggttgagatgcctgcgggaaataatgtctgattcatactaagagtatgaagctacgtttatatggacatctttggcatagatttggatcccaagatttgtcaaagctgggtattcttaggttcaaaaactatggatgcagatcgacgtttacgttgataacgtttaatatatcattttattttcattttagatgagtttatttttaaaaagttaaatcactataatttagcgtaaaaactttaaatatatcgtgatttgagatctgaaa

SEQ ID NO: 70126 - DNA, 7852 bp, Oryza sativa
aaggtgacatcactgttatagcatcaatgtcagtgtcatctgaatattaggatatctgaactgcacgcagcaagtgcctgaggtgcatgtttgtcatatggaagcccaagtggagcattgtacatagtactttagtagtacctgtgagcaacgttgaattaaagcataagttggcagaattctttctgaaagcgatcaagcaggccgtgcgaaattgtttaacgatttcatagaatttgggtgaagtttaagattatgaggaaccggacaggtggctgcagatttttaaacagatgaaatttcagccaagaaagaaagtccaatagaagaaaggtaggcggtagaagtactgtgaacagtcaagaatttctgtcccgctgcagaatcagttcaaacattttgcacattcacattggcaatgccaattattgcgcatacaagcaaaagaaaaatgagagatactccgttacaaggaaattcaaaaacataatacaacaaatcaatgcctcaagagcagagatgattcggacaaaaaccaaccaaaagagaacccagtagacaaatttagtattctctgaaatttcaccacactttccaatctcgtttagtttggactagtccacttaaattactcaaagtccaagctagagccgaagtcactttcgttctactgaaactaaaaactttgtcctgacaaaacgagacaccaaccaaacagtacttaagaatatgcactcatccaagccatgttccatacgcatcacaattccacaagctccctgcagaagaaaaagcctcaaacatgcagatgctgatcgtttccctcctaatgcttctcctctctaccccgaatctgttggtagctaaacagcttcccttctgcagcaacgcgaacaccatcacacacatgccagagggcacctacaagaccaacctgctccagctcgccaaaaacctgatcaccaatgtcaaccagacgcagctgcactctgccaacggcacagccggggcggccggtcctgacacagtatacggcgccgtgctctgccggggggactcctccgccgagagctgcgctacccgcctccagagagtgcttgacacggccagcatcaatggaactagtggcgatgactctggctactttcagaaccagaagaatgtcaccttgtacgaccatgatttccaggccctgctaagcttctccgacaaggatttcatctccagcttcagcaacgcgccggagtgcactgtgagcgcttacctgaaccctccgccggatgctgatcgcgcgcagttcagccagcttttctctgagctcatggagaagatcgctgcagccgtggtgagtagacggccggtcaactacttgacgggcagggggtggttcgacctcaagagccagacggtgtatgcgctggcgcagtgcacggacggcatgccgccggagaattgccggagttgcctggacggcatcatcgacgaagggaagaagatggtcggcggtggcctgacgggtggcgcggtgctcgggatgcgatgcagcctgtggtaccagacggatgtcaagttcttcgccggcgacccagaggtgtcgctgcacatgcctacacgtacgtcccaccttcacctttaataaattgtgccttgttgatttggttcaaccagtctttcgtcttcacttagtcttcagtcttcattgcctgattactactcagcagggacattctttcatcttgagatgcccttatctctgtgaaaacaaatcaaacgatgagattagttcagcattcaagcatgattttcattaccccatcaacaaaaatctgcatgcttttttgagagagatttgataatttaacataaatgggtttcgattatctgacatcttggcccactttcattcactcagatgatcctacatgtcatcctcacaagtgtcaattaaagcaactgtgtaacgaaaaaaatgtcaaattatcaaatttctccttttttttggaagggtttaagttgggatgcacaattattcccgtgtgaaaatcaaccaaaaacgatttcaaaaccaaagaaactgttcaccttcccctgtttaatatttaccttcaaagtgtcgtgtggccttcctattgtttccactagtcataactcatatcaatggatgtgcagcaagcaagttttggatctgggttgtaattggatcgttctccctcatggtatctatttcatggttgcttgttcatatttggatcaaacgagagagaaaaagaggtaaataactaaatattagtctcacaacattctcctttgcgtaaggatatatgcatctgattcaattatatagctgcccgctaagagcctatatgagtgacaagaatagactgcttcactattttctttttcagaacaagcaagatttgaactacgattgctgtcgatggcagtacagaatgtaataaatctttggaggattgaagaagggaactcagggttttcattgtatgatttctctcagataaaagaagctacacaaaacttctcaagggaaaacaaacttgggcaaggtggttttggagctgtttataaggtaaattatatacttggctacttgcattgatattcaacttatttatttttatctgtatattttaaatgatttttagtttttaatcagattatttctgctatagttccattttcctttttcaaaaaacattagtgtatgcaagatccatacttacccaatgtcacaagataatgtggcactcaacattgtaattgtaccaatgtcagtttttcaaaataaaaaaaaaacagaaacaatatcctccactgaatatatgattctagtagcaattgtaatgttctttattttcagggcttgttgccgggtggtcttgaagtagcagtcaaaagactttcagcatgttctgtacaaggtttattggagttcaaaaatgaaattcagctgatagcaaagcttcaacacaaaaatcttgtcaagttactcggctgttgtattgagggagagcatgaaaagatgctcgtctacgaatacttgcaaaacagaagcttggacgtcttcatatttggtatgcctccatatttctacatactaaaatttgaagttaatattattttgagaatttttcaataacctcaattcatattctgtagactttgtgaaaggagcacaattaacctggtcaaagcgtctacgcataattgatgggatagctcaagggattctatatcttcacaatcattcacgagtatgtgttgttcatagggatttaaaagcaagcaatattctcttggacagtgacatgactccaaaaatttcggattttgggatggccagaatatttggttcaaatatgattgaatcaaacaccaccagaatagtaggcacacagtaagtacaaatatgcatctgaaactatcagtataaatgaacatgcatagttttatatgttctaataagaaaattgcatagagcagtccattttgtgtctacttattagttactacaattcctcatattattaaaaacaactcgagattttctgctggaaaagcatataagttaattatgaaattgtatataaaaatttctatacttcatgtatcttggtaatgtataacaattctactactgtaattcagtggttacatatctcccgaatatgctttcgatggggtttgctcgatcaagtcagacgtcttcagtttcggcgtcttggtcttggaaatcataagtggaaagaggactgctggtttctatccctatgatggcaaactttgcaatctcatttcatacgtgagtaaaatgtactccagataatctttatgaaacaaacagtgggaccaggttggtccagatatactctatattgcaaaccattattttttcttttttgttgacagaaatacgcctttgtcttttaacaggcttggcaactctggagatctggacaggggcatgagctggtctgttgccgtataggaaacaaccataaagtgatacaaaggtgcattcaggtggcactattatgtgttcaagagagggcagatgataggccttctatcgatcaggtggtcacgatgctaaacagcgaggaaatgacattgcccaaaccaaaccaaccagcttacttctatgtccgatccagtggctcagatgattcatcatgcaataacagtataagtatcacattggcaaggtagagtagtggattcccatcatagccattcaatagaatgatccaaaaactacggatcgacaatgtcatttgtgggtgcaagcgacggtccaatgcagttgcttctctgttatccgatttatttgtctttgtttaggcgtttaacccaaatgtgtttcagatctttttttctgtttcataatgtagattagtgtgattttgtactgctatatatgatgttctcttttcaaattgtctgtagacaaactgtaagacagtggacagtaatcagcataaacatggacggtagagtatcaggcagagctgcaattttcaaatctaagtacgagctgtcagccaccgattaacatcaatccctaatttcttcagcatttaacaacaaaacatctttagctttccaatcaggttccacaattttatgatcggaaaataggaggagctttcaagtttcaaccaaaaatggtggggaaattagacttaaaatgctgggaaacccaatgctcgaatccctaaactttaacctcgcaaaatagacgaaattttcgaataatctcacctcagatctgaaggcatttcagcccccgggtccccggtgcacgcccgtactcggagagcgacggccggcctccctcgccgacggcgacgttggacgacgggtggcggcgcggccacgattcgccgcgcaggggaggagaggattcgccgcgtggcggctaggtcgcgctcgcgccgcccttgggagtggttgggctgggccgcgccgccgtgtgctctggtgggccgtttggtgggctcgccgctcgtgtaaactggccagcccaatctttgaagatttgaaggtgatttgttttttttttcacgaacccgtaaaatgattacgtcaatatatattagaaaaaatacagagttttaagttacacggcgcaactagccagaaggccattgaaggtgatttgcacatattcctaatctcaaatttccattctctgtttcggtctaaatttcagattctatgctcatattccccatgagtttgttaaaagaattctttttgaatttttatatttcagaatttcagaacgaggaggattttggatggcaacatgagcatggcatcagctggaggtgcagctcgtgtaattacattacacattccgtaagttcatgatccagacccaaatatagagctgtcagatttcaacgattttattcgagtctaggatgacaggacaggcaatcctgcattaattcctcttcgtctcaggaaacaaacaccaaattgaccaagcttagctccggagaaaaaatctgcatataaatccagcaggataggttagcaatcatagaaattttgcagtccttgtctgctagcatgtcagtatccaaaggatgaaaggagaggtttgtctgattaacgagtttgacttggaattcaggcaactttcaaccaatcatgccaaggatgcaaacttctcattctggcattctgcaatacagcatgcgtggattacgaacagatcttggtttgtttgcacgttggactcaagagctaatctaaccgtgggtctttttttaagtacatgttttatttttttttggaaggaaggcaaaagctttgccttgtatatattaatagagcaggagaaaattatacagaggtatatacagggttagccaaagaaaaacgaatagcgcacaaaaggggaattaagaaattaagtgatatctcccaaaattctaagctcttgtagggttgttgcccctgctttgactcatgctcttccttcctccttgatctttgctagaattgaggatggtggtgacgcagagtttcggaaaattcttgcattgcgttcgcaccagatttcccataagattagaataatcaaagtcctaagaggcttgcgggggggtgtttggagactccgctacgagagttcaccgctgctcaatcgagtgacaagtttcccaactgcccatctgaaggtcagtgcctgtccatctctagatttctgcccatattctctttgttagtcctcatttggccaggaggtgtagggccgattcatccaccgtgtagcagagtgggcagatcttttggttttgccatcctcttttctccagtatgtctgttgtccataccctgttttgagtgaccaaccaggagaagaatttgcactttggcggcgcccatccagattgattggttgaagacggatcgcgcagcccaaggaactggagtctataagccgattttgcagagtattgcccgtctgttgtgaggttccatcgaatgttgtcttgattttcgtttagtggcctcatgtctctaatcattttccagaggcggacatactgttggaggtggctcgcctccgtgatatgagagatttcgatgtctcggatccagttgttttctattatggcatcgtttactgatctgttcttccttccagaggccatgaaaatatccggggcgatctgttgcggagtttgatcctccggccatttcgagctccaaaatcgtgcagtcttgccattgcccaccgttattgttgttgcggccacgaagaggtctctatctagctggttgcacggcaatgcggtccctacccaaggtttttctggcgccacccattcattccaaaaccatctgagccgtagtgctgatgcgaattgttgcagatccatgactccaaggccacccaggtctttgggcctgcagattcttttccagtttactttgcattttccgccagagatattttcgccccccgcccatgcgaccttacttgaacaggatctgttctataggctcgtaccgttgcatcctttaccagtacatgttttaaatgccagatgctgcgaaggttcaagctggtaactggtatatgtaactttcatccttaacaaggtactgtatttttttatgtaaatcttggtatctccacatactatatattttaaaattttaacatatacatatagtttctcaagaaatttaaaattaggaaacggctttgacgatgactgggtgtggcggcatcaacttatatccccctcatctcatgcttgcttgccggtgaggggtgttggcgtctttacgataggtgagtgccacaaggtggtggtgatggttggacttgtgtagggaagcacgaaggcagccctcctacaccgcagcctcctgcttgtgtttactggttggtgttatggcgctggtcgatggttgtgcaccaaaggtgctcgcagggtgggggcttctggtagttaagtggtcggactaggctttcaccaggttaccctttagcacgtacgaagcaacgatgaaattgtaaatgagatggtatgtgtaagtgagtccatccgtcagacgagctggactgcgcggttctggatggtgggctgttacaaatccttaggtgaaaaccacacccttgtttcccaagttgcgcaacaacaacaccatcagcgtcgcaacctctcaagagaggatgttggaggtcaatttctggccaaactcttatctagacggtgttctcttgtggcgatgtcctagtcatcacaaattggccacgttggtaggccttgtggagagtggatccacttttctctctcagggctgcagg

SEQ ID NO: 70127 - DNA, 1064 bp, Oryza sativa
cagacaaaccctataggtgcccgcacgaggctgataagagaagtctaaacgttatctctaaactcaccgagaacggtcacatgagctcgataacagttactccaaggtctccgcgcggttgagaatatgaattcgttcatttgcattgaagtcgggggctactgtcagggttatggataccacatacctaatagtagttgactaaatctcggcaggactcaccacataccatgtcctatacggaaacaacctacggatataggaggagttccggacaaggaaagacaaccagagttctacatggaaacgacaaaggactaatcggattgtatccatattggtttccctagttctacttggacaaggggacacctatgggtataaatacaaggcccctaggaggagaggggacacaatcgacacccaccatagaagacacggacaatacacacccaccacaatatatgggcaacatagacgccacaaagccacaagccaatataagccaacatacgccaagacaagacgccggatatcgacttcagagataggcacggctagtcccctacggtgtctcaggatactgtcagaagagacgaaagcgctatctctgatctcgccgggcacgggttcgaggaggaaggctaccctgttgtcgactacgagtcagatcgtcagaccgccatgtcgacaacagttagataggctaccccaaatattatactggtgtgattatcatgaataagagcaataccggcttcggccaacagaatgtagggttattacctgacaattcaggggcccgaacctgtataaaaatccttgtctccatctcttttaccttagtctcgcgtatatcctagtaccaacgatccccatgccatgcaaataccgtagtcgagacatcaaacgtcgacagtatgcatttccatgtattagctaaaacattgcgtacgtatgagggagatcatagccacgctggtatagtagtaggtaagttggaagaggatcacgaattgactttaggttctgttgctttgttgcacgatgagggctgcaggaat

SEQ ID NO: 70128 - DNA, 619 bp, Oryza sativa
agcaaatccttttctcgatgcttttatacccttgccgtcgctgggcctggctcctcgtttctcgcgcccactatctcgctccctcgtatctcgctatctcgctccctcgtttctcgtgcccacgtttccactaatcccattcgcccgcttacggcgcgtgaagtggatatgcggttgtggcaatcgaaatggattgtatcgtgcgcgcgttaattacgctcgccgaccgaagcggcgttaccgtatctccgggcgagacagatctgctcacccagattcgcgcgctgctcaagtggtgtggcagtcttgaatagaccgcccattatggacaaccaaagttatcaataccaatgtgcatggattgagaccgttgggtattttgcccagctacggaaaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacgcaatcgcccacgtggcctggcaccttcggggacgtcgggcccgagggtgaggtgtccgccctcctcctgatctccccc

SEQ ID NO: 70129 - DNA, 733 bp, Oryza sativa
agtccgcacatcctcaaatacaaagcacttccctagttagatgtaggttagacttcccgttcgagaaactttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacaatgaaacgtaaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatt

SEQ ID NO: 70130 - DNA, 13125 bp, Oryza sativa
agattatcccacatttaatactaaaagttttatcctctctcaaagaccataaagtccctcatataggattgaataggaatttgagcattttctgtttcgatgatacatggagaaagattagcaaagtcgattaggaccccaaatttaccagtagaagatatgattcgttctttctaatacatgtaaaatacattaattattattttgtgatgagacgtttgtatattggttttgatatttggttagatttaatcgcgaagtgatgctctctggatgcggttggtcagatcggtttgtacactatagtcagatcggacaaatgacgtgaatagtgttttttgttttttcagtgaactagagtttggttgtgcgatcagaccgagctgagtgcgccggtcagaccggccacctgacggtctgactggctagcttctgattggaatcggttttgagttgtttctttgattctcaggattactttatgtttattacctctagataatttatgtatatatgttatactgttggtgtgctaatgttgagttaattaagttgaaaaagaacttgtgctcgagtatggtttctcatctatttatgtatagatgtattttaatgcctcgggagagtgttgcctgtgatggattaggagtcgacttagaaaaagttgatgtccgaatgataagaagattatacgagatgcttaggctaaagagaaaacgcatgattttgaaggttccatatggcatacaagagggattttgtgcatatgggatgagaagtcaaatttggaaggagtccaaattttgggaaattatagtttgtattgtaaaggaacaagttgtatactatttattcaagatggattatggcttttgtgtagccaccttagggtacaaatagaagagtggttaaaacctctcggtattgattttgagagagaatagttttgagaaaagtataaacttaacctacagttcgagtttagtcaaaaattgagaggggagtgtcgttggtgtactttgtaaacataattagaaacaataaagttgttatacttccaaagagttattcgatttgtatttttctttgtttcggcgatcaaactagcaaaggtacggtcgtcagaccggtgactacacgatggtcagaccgatgacacctgggcagttagatcagtgacatctggcaattacggctagaaggacaattgaccagagctacaccttcggtcaaacatcgacatcgacactattaggcccgacgtatacacatcggtcaaaccgatttccatctggtttaaatgtatcatttattttgtgaaaacatttgttttttttggtgttatgccattcaacctcatattccaaccctcttaatatttggggaatgctaggggacgtgataccgttccccaacaggatgctcctcctccgcaaacgcgattctcacccatgcgacgtggccgaagccatcaatgcgcgcccgtcccccaccgtcaccacgcccgttccccaccgtcgccgtcaacggacctcgccggcgggcccgtcccccgccgacgccatccccatcccctgccggcgtcaccacacccgtacccaccgtcggcgtcgccgtacctagccacctgtcccgcccgcgcccacgtgtcccatgccccgaacccgggggacacccggggttttgcccgatttctgggcccccgggattccccccccccttttatctacaggggacggctgcaagtggcccgccgcgcgtcgggatgcttctcccccaacgggatgcacagttatatctactaggaatcacctgatacctcgtaagtatcatctgatacctcgtttgtattacccgatacatagtagaaattgtctgatacctaacatgatacctcgcgagtatcacgcgatacgtggtagaaatcgtctgataccttacaggtatcacatgatactttgcaagtatcacctgaaacgtgtgtagaatcgtctgatacctgataggtatcacacctgatacctactcgggatcatcccgttcgaaaacgggattccgttatataacaaccccctaatatatagtcatacttatactaattggacactctgagagagctgctacgttaattagaaatatttagccgttgatttgatcgaccatgtacgttgagagttgacggtaaataaatcacgcagttgaaaacataatggactttgatttaataattctgaaattcctatttaataaatgtgatattgcatccatcttacattctcaatttattgttatttatttatgctcaaattcaaaatcagtaattaacatattgtaattggtgtggactcttcatttaataagcatctatataatttcaaaaggtaaccaacatgtttatcataacattagaatttcaatatttataccaccattaataatatatagctcgtgtaacacttagagattggctactagtagtaatagtaaaaatggctaaaaatttgaagctgtacattatttttcctatatacgcggacctagcctgcgattatggaagagatcgaactgtcagtttaactgatgcaaattgcataaaggatgttaattgttatccctatttcagtattattaggaggccaatcatctcttatgctagtgcccaaggttaggctgaacaaatatttttcagaatccattaagagactgacttaaggaagcatcccatcagacacgccactagcgtcgtggatcgtatacgttccatgatgagtttactccgatattatccggccccgtacagagctagatcctccgaattaatcaaaagcacgtcatttgagatgtctaattgatcactgcattggaagacgacgaacgatcattgacaggcccttcaatgatcagccacacgagccactagctagcaaccgctagtgtcacccgatcgaacaagctaatgcgatatcttattatgggtattatacagttacggtcactaatcgagatattttggcttgcgctttacgaacagttgctcctgccggatacgcttggatcccttcaaatctatccttgctcgatcgactgaaacgcatcatattgcagaaatatctgaatccttacgaagtggcggcacagtaggacgacgggcaactgaacactaagctagctgctactactatatatgatcatcatcatcgatccgatcggtttgccggcactcatgcatgacaccatagtaaattcatttctcacaaacaagcagctattaagatgaatgaataccaatggcatcggtccatgcagatgagagacaagggacctatatctatcgatctatcagtgtactatctacctatctacctactaaaatggcgatcgagctgaagccactgatggatcgatcgatcgatacatatgatcaatccacattaagaagcagtgtgcgagaagaagtagaaaggggggaaggaacgaacaataatgcgtgcatgcagggagagaggaaagggaggcaatggtgcgtagcaccattgggcgcggctgcgtgtgcccggccgacgcaggcatcgccatggacagcgctgatccgagacggatccggccgcgcgcggacttagccatccgtcccactcggacaggacgcgcgcgcgcgtgtcgtgctcgccgctgtcgcgccacgcgctaggcgagtagcagctagctaggcgtgtgtggctataggccttttgtgccagagcgaggcgtgacggcttggggctccggcaccggctagctgggctgggcgctgggcatggccgcgtcgtggagcagtgcacttaggcgtcactcgcagcgctttccgggggcagaaaagtggcaggggcacctcgccctgtccatcgttcctgcccatatcttgctgcaccaccactaagccgtctccgtccatgatcacgcactgtgtcgtctcggagtcggatcatcatgcaagccgtgcctggagctgtcaaagactagctactgctatgttggatatagctaggcgagtagctagctagctagctgctagtatacgaactattggtctatggctataagccgtttaatttggacgcatgctcgtacgcacgcacgcaacgagaatggtggcgagcgatcatgcatcagtgcgcgggtgcacgcacccacgtacgcaagcaagcaagcacggcacggacgacgggcagggcaccgtgtcctcctccgttttgctcgtgtcactctcgtgcgccatgcactatagtgcgaggcgcgcgagcactaactagcagctggggtagtaacgcgcgcttggctagcgctaattaagctgccgggttcgctcgccgatcgatcgaatctttttggcgcggatcgcccacgacgaggcgagccaatccatctcgtcgatcgacgacgacgacccaacgtacactgaactttcgtcgcgcgcccgtgttgcgccgcgcggcgcggcgcggcgcccatcgatcgatcgtacgtacgcccgcagctctcacgatcaacgtacgatccggccgtgtggtggcccgtgcgcgcgcgcggtgcatggtggcgcgtggcgcgatcgagatcgtgcgtgctgatcgggaaagccacggattggttgctgcgcgcgcgcgcctcgcgctcgcgctggggacgactcaactcgatctcggacggaggtcaacgcgatcgggttagatagaaaggagcaacatggcggcattgttggtgctctcgacgtacgtgcttgctgtttcaatttgatcgtcatcgatctcatcacactagctcaccggaaatggtttgcagaatacggataccccggcccgtttttgcttcagattatgatagctaagtctagcaactaagtttaaaagaagcggttaaactcttttttgaggacgttcagaatttctatttctgtaccgagttcgcctgcatatatactcttgttaatgttttaaaatcctgatcagatcttatcataaacattaaatatctataaccgaaaagatgacatggcgtctacttgtttcctccgtcttgaaatataaagaattatacccttcaaatttatcgtataatataaaagattttataattttgagacaatactttataccttatcaaccattttttactagtttattccccactcactatcttttatactggtttattttttcatctatcattttttactactttattcttctaaccatcatatttattattttactattttctgaaattttataaaaaaatataaacccttatatctgtggacaggactggaggagaacggcactatatcaccgcatattgatacggccagaaataccgagagacgaattgaccggctgtccggcctcgatcgtggtgctcatctcggggcgaaatgtgttaccgtatattcgcgcatatatgtacgcctctgcacctgtactgatctgtacctgttagtgggggcagaaagccatggacgccttcgacggcgacccgtccatccgtcgggcccgggcctcgctgtctgtagcgtgcgctcgctgtttgacattcgagttcaaaagtgtgacacaaaattttcccccggaaagaaattcttgcaggtcgatcgacgactcgtacgtcggcgcctccctctcgacacgaacacgtactggtactggattagtactcctaattgtctaggtgcacgctgtgctgtacaattcggcagctggactgactcctgcgtccccaaatcctgcagcctttgcctttttgaactcctgatcgacgatctacttacgcagcaggcaagctagctagctagcattagcgtgcatgctgaaatggagagaggaaaaacaatactctctccgtttcaaaatgtttgataccgttgactttttagcacatgtcgttcgtcttattaaaaaaatttgtgaaatatgtaaaactatatgtgtacatgaaaacatatttaacaatgaaacaaatgatatgaaaaaaataaataattacttaaaatttttaataagacgaatggttaaacacatacttaaaaaatcaaaaaattaacggtgttaaacattttgaaacggagggagtataagattggtgagaagaaagtgatcaaatagcaactgaaaagtgtgtgcctttcttttttattgttttctgaggagtaaaaaagtctgcggctgattacttgcatagactgtatgacccgtatcgttctctgtatgcgtatgttgtgcaatgggacctaatccctcttcggttcctggatgatcaacgtactcaccgtttgtctaatgctaattatcgagcaggctatcatgcaggcaagcagagcagtggcctagctaagctaagctaaactatagctacactgtgcgtggtcaaactaaacaccagccaaagccaagccaattagccatcgctagtgagtagtgacccctggggatgcacagggccgagccaatagcttagctttgtgactgatcgacacggccaggcaagtacacacttgcacggcggctttgagctgacagctactacgatccacacgacgacattgccacgcacggagaaagccccgggccggcctcgtctctccgttgctgcctgcatgatctcgtcgccgtcgccgtcgatcggcctcatcttgcgcggcaagttgcaggcgagagaaggtggtacgtggcttatcctgaattccaacccccactcacgcacgggccggcggatgcgcgccggggggggggggggggggcggcggatacgtacgactgatcggtcgatcgacgacgcgtcggcgggcgacggacggaccgacgacgtgagagcgagcgtgcgtgaacagtaggtccacctgaagatgccattaccggggggaaagcacttgatcagaatcagagagctcaaaactggattgattaatctgcagtggagacaagggcttagaaaaaacgcgccttgggaaagtgactgacaccaccagcagcggctagctcatccatgcttgctgctactggattttttttttatgttttggttttttgaaaatttatttccctacgacaaaacttattttaaaaatggatcctgttttctcaacatcaaggtccaatatcttagcaccgataccctagctctctggatatctaagtcgctaatgtgatgggtgttggaaccgaggacttatttgtaaaaaaagttttcaaaaaggttcaaatgtaaatatttttatagtctctctgtactagcttttttacgtcgagaacctaattataataaaagtatttatgttttgaccattttaaaagatcattgtacaaataggttcacaacactaaagagattagtgttatcccctatatcttggctatagggggcgagggtgttgacaccagcgtcattggtgtcgaggcattggaccactggcgtcaaaaaaggattaatttctaaaataagtttctcatagggccgtatgtaaaataagttttaaaaaagagccaaaacataaaaagttcagcttgctgctatctgtttcagagtttggtagctctcctggtttggtttggttcaggacgcgtgattgagcgtaattgacacaatgacggtatgacacacaccgtacccaagttgatcaaaccggatagatcagtactactgagcatggaggcgaagacgtacgtcaaaatccttttttgagaaagcggatggttaagcagagttgacatgcattttctgtgtggctggccggcttgatagatagctatgctgctgctgtgaggagaagaaaaaacaatttgatgtttggtacgtgagagtgaaaatagtggatggcgctttcagtgaaacttgtcaggtttggcagcttgatatgtttgaacaaattaaagggcgagggtttgcacacacaagcaaacggtttttaagcggttttaaatagtttctgttcctgtgccatgaaaaggaagggtttatccaatgtcaacctgcgaagttacaaaagcgatcgagtttggttctctctttgctttaatttatggtcctctctttggtgaaacagcattgcccttttgtggacacctgggatgacaacgtgctgctgggattgtagccaactaaaacaagtctcctatccctttttcacctgtagggattaacaccagaccgtcttctacaaccaggcgtagcaggcaaacttggcttgtgttgatggcttccgtgaactacttgctgtttgaactttacacaggttacctacccgaaaactggtctacgttgcaaatctctccactgtttgctctccattttgagcagaaatagacgcctaatccagaaaaggctatagtgcaggaaatagagatgctgaactgaaagtccaactacaattgggcctttgggaggcctttctgcaagtgttggacaactttacaacagggaagcaacatccatttctttcagtaactttactttcatacacattgattgatacaagcacagatcgaagatgggaaatggttggaatacaataggtcttcttcatgccttttagatcgtgggaaaatgagttgatgagctaccatcacagctttctactcagacgtaatcttcctattgaagctattcatctgtggtttgcccttctcccgagccctcagaaggtgtgtctgatgataatggccctaagatgccctctgaactgagagttaatccactctgtgaagagatacagggagaaacaatttaattcagccaaatgttactgcagtggcttatgaataatgtcagataaatttcattttgcagcctcaataaaatgatgatggcagtacctcaggctggaatcttaacatatcagcacgagccattgcctctgcttgagctatcctctgcctgaatatctgagccatctcatcagcctgttttgagacagagaaaacagtatgtcagtttgtatacattccagatggaccagatcaaggaatattgctttcaaacttaccttctcaaaaacaagctttggattgcgaatcatgtcaccaggtgtcggctcaagctttttagtagaaagactaacacggcctctttcacggtcatggcttagaatcataacctaatagcatttaaaaaaaatactctggccttagctctataaactttagatagtatacttttctcaagtacgaatgcaaaaaataccttgagcgtatctcctggttgcagaactgtcgagatgtccgcaacacggtcatgactaatctggctgacatggagaaggccattgattccaccaatgtcgataaatgcaccataaggtttcaggctctcgacagttcccaagacaactgaaccaataccaagctgagcttgactatctgccattgccttgcggttactgaggacaagcctgccttgttcctcatcgacctccacaaacttcagaggtagttctttgtcaagcagttcttcagcagttgatttctgatcaaggtcaagaagtggtttgtaaaatagtgggcagctagtgtttacaatgtgattgagaactaagcattggaaactaggatcaaatgttcagttatctgcataacaactttgacctgcagatgaaaggcagctcatgccatgcacatgcacatacacctaaaaccataggatgcaagaaagttttgtagtaactaataagattgagaaccaaccgatgacacttgtgaaaatggaacaaatcccttaaggccctccacaagagctaccacacctcctttgtttccaccaattacctgcggggcaacattgccaaatgaacaagtcaggtaaccgcagactaatacattacagcaaattcatcccaataaaactaagcatacaatcatataagctcttgcaaaaggattttttgatatgttgttacaaagtgactggtctagacttcaggagttcattgctagttgcacaggaacaaaccaacaaaatcacaatagtccaataaaaacaaaaaatttctggtcattgtcgcatctatagacgatctcagtacctgatcagtaagctctaccaagtaaacagcagcacaaatatagaaattatgaaatcatgggttggatgtcataaagtatgtacaccataaattaccacttgaataatttcttttcattaaaggacaatggctgctgctgtgagggatagattcaaggacaaagcctgattgttagaaccgaaacggtgggcaagaagaagtagtgcttaacaaacatttggttacaagtttaacaacagcaagctattaaaggagtagtgaagaacaatagtaatagcacagaaatatttccttctgcaagtatttttactcactttacccgtgacaacaacatcttctgcttgaagctgtctgcacctttcccaggcaaggtcttgctgaattgcttgtaagctcaaaatcaaagtttcatcaccaggattctcgtcaataatcatgaactcttctaccaaacctgcacggatccctgcctcttctatatggttgacatcgagaaggcatgcctcatccaaaggcaagaaagcagtagacttcgattggatatcaacatatgcaccatttgaagtggtcatgaacactgttcctttaatctgtagagattgcaagaacatgatagtttttagatgttaaggatagagtaatacatcgtttcaaaaaaaaaggatagaataatacaatatatgagaaactatacaaaatttgcaatatgaacagtatcttataataccaacatagcacaaaatattgcagcaaagataacagtactgcatgcccaaaaggagatactaacagcagaatcattgctaacagagcaaaattctaaggatcaatgcaaatctggcagctggacaaaatgagtttttgtgtccatgtgcatttgtaacgtataagagatgtatagctgattattgagtataatattggttgataaatagtaagcaattcttatttaaatagacataaataattacagtcaagacaagcagcaatcggtcagtaactgaaatctcatcgagtttggggttaccatggtcagctagttactacagggaatggatcaatggatcaactccagcttactttaactatcatttaatgtgaatttggctttgttttttttttaaaaaaaaggagaaaataactatataaagaagaaaaacagaccccacctgtatgacatttcaaggacatttctatcttttgaaggggaaacccctttttgatggaaattacatgtacatgaacatcctacatgtgctttggaccttatgcatattcatgcttcaaagaaatatctatgccctgatggattggtgaccggtgtgaggccatgagggtgaggtaggcatatgtatgatgttcgtataacttggtacacgtgcggaagcaatcaaagagaggatgtagcaaacacaaataaaaaccacacgcttttggtagatcaaactcttgctccaagcctccaataaggtatcatccccaaggaggtaaaaaagggaattcgccgttcaagtctaattcaccagaattgaatcaaaagtcaagcttaatttaaagtacatcaaattaatatgaactactctagcttacactgaatacatagctatcgtataaatctccagcctatagaggaatatgatatggccatgtattgctcttatttgaagtatcagacctacatatatatttttttagtaaacattattgaaaaaacaactaaattatttagatgaagccacacaattgcgtgagttctagcgttcaactagtttcacaaaaggcaaaacataacaggtaagggctaatgaaactactattcctgattatcactatacctgctaccactatgagcaggtcagaaaatggaagaggtacttgtagtaaactgaacattctttcgcttgtaccttaggggagtaacacattatagacgaatcatgatgcgcagagcacattccaagcaagcaaacaatagaattctagttgggtaactttcagtaaccaatcaccttgttgttgatagcctaaaacaactagcaaaccgaaatgtaacaactagtgacatatacagggcaagtgactccaatctcccgcaagccgtatccaattgagcacaaggtaagactcaagtgacttgcaggaaaacgaggcatcacctactgaaagttaagcctgtttttaagcaccaattgctactatctgtttcacatcatacgagcgagcaaggacgattgagaagaacaggaggaaggttgcggggggtggattacgagtgagccgatatcggtgtcgatgtcggtggactcgacggcggagtcgaggtcctcgggcgaaaggagacgccctccatgggcgcggtgcggcagcgctcggaggcctcgtcgaacagctggcacatccgctcccgctcccgctcctccttggtgagcgcgtacgtcccgcacaccagcgccgacggccgcgtgggcgccgcggggcggcgccgcggcgcgccggagagcggcgggctcgccagccccgcgacgtgctgcgccagggacgccattcgcgctctcggcctacccgctgtggtgtgttgtggttgtggtgtggtgcttcggggcgacgagacgaggcgacggcagcttttcgggttgagggagggtggctgtgttatccggtggccgtgggggtttagccgtttaggataggcgatgggtggttttgggccagcccaggtaagaattccctcgcaaactgtgtgtgttagtattccgtctcggttaattcagctattaatgaggaaaggaccggtctagggtgtgttaggataatagaaaatagaagtaggattgagattagaaaataaacgaagggttaggattaaatagaaaagagggaatgaatggttagaacttaacgatgtcttttagtaggtgaaaaattatttcctattcctattagccaaacactgcctagggagtgacggattcggattaatagaatttgcgcatggccacttaataataacgagaggaaactactgatcaagtggtttcatcgaggatagttataactctaatatattgtaatcatatgaa

SEQ ID NO: 70131 - DNA, 3034 bp, Oryza sativa
tgctaccctggttgccttcctctctgctgacctcaccaattccggcgggcccatgatgtcaccagccttcacactctcactgatgccctccaatctggtgtaggaaggggaagaagatggagggcgcaattggcattggggacgtcatcgattggttctctggcaaccggagatgggatcgcaggaagagagagaggaggaggatggtgaccttggggcagaggagtcgagggaggaggatggtgaatgtggggcggagtcatcgaggaagggagggataaggtggatggcgactgtctgacgaagacgagggagaaaacggatctgagaaaacagaaaatggttgggttgtatatttatcccgtagccgcacgggacgccgttctatagtttttctgtagaagaatagtatgttgcgtagctgccatccaattattttttttgtaccatgccaaattttaggtatgcataatgattttaagaaagtcaagatcacgaaattaatttcatactccttgtgtaggttctggctgtttgtgctgaaaccatgatcaaatggaaaagttatggaaagaagtgaattgtaaactgaaattttgaactttaactcctttctaagatgataaatccagagccctgaaggtatcatctaactctggtgaaaattccatactcttctatctccatctttatcccattcaaatctgcaatgcctggccctattcattttaataaatatgtatctgagtttagaaatagctacagggtgaattcatatgttgaatttctttcttgggataacaaattagtttatgccatcttgtgggaaatattttcccctctgaaaactcgtttatgccaacatcaaattatagaagtgtttgtccatgatgagtcataaaatttctcaaagagttatattttccccgttgcaacgcacaggtacctgactagtttgacagatttttctcttgatgacaaaccaaatccaaaaaaaaaaaatccatttgtatctttcatcattcccacacaagccaaaatccaccaacaccaccttaagaagttgaagttgaaacattctcttccaccctccccaaatcgataaatcctctttccccactaaatttcacctcgaagtcatggttaagaaaaaaacatacttgcattcaacccaccttagactggttgaaccggacgattttgagctgaaacagacaactttgatactaatggaacatgattggaccattataaggcctagatgtttcttcttttttttgagaaatgtagtacaaacgcagacgctcacaacgcgcatacactcacccctatgaaagcacacatgtacaccttacccctatgagcacatccggaagactcgggcgcctcgctgttgacaggtgcattgcttaccactgaaagaataattagctgtaaacgtgagcacccgtgccaaatctaagacttggacccgggtgggttggttccaccacaagaaacctaactagtttagctacgctgtgggatcgagatgtcgactagaggtggggtgaataggaaatataaaaataaattacacctaatcaaaactaacctaatttgctaagctttgtgaaggataagtctaactaagcaactaagttaaggtgtgcaatcatagggtgataagggctcaaatatgtctctatgaaagtaaattgcacaaaagtaaatgagatgagaatgaatttttcacccgaggcttgaaaactcactggtttgcttaatcctcgttgaggcaagcccaacttcaccgctcaaaaccacgaaaccaccgtaagccccctccgtcaaggggtgggcaacgtgggtgccgggccacgaagtggactacccaagcctcgatcactagggtagttcttccttccttccaaaggtggtgaactccaaaccactcacaaaccggcactaggccttctctataatctccttggagaggtcaccgggcaacacctccacaagccttctaggaggcagcaatctccaagagtaacaagcaatgacccagctcggagatgatcaagtgtcacgccagctctacaatgaagcaatgcacttgaattttggctcaattaactctcaaacacaccaaatggatgaacacaagagagtgtgaaagtagttgcaaaaagtatatgcaaatgaagcaagaaccaagagaggccccttactactggtgggggtgtatttatacccccaaactacaaaaactagccgttggggtcgaaatgcccaacctctgttgcctaccggtccgaccgtcattgggtggccggttagaccggccaacagtgtaacggctagttttctagccattacaatgcattaaatgcactggtaacgggtagtctggtttgatcggagtaggccggcctgtcaaaccagccgcagctctggcggctctgtatcgccagttgaggggccgtccaactggctcacaacccactgatcagatggagcctagcccagtcagaccgacactggtcagaccggtgcactccctgcggtcgaatcggccaaggtagacaagctgcaagagtataagaaatcgtaccaagtttcaatgcatatgacctaatgtggcattttgatcatctttttgcttaggtaattacccctattgatggtatggcaaagctatacataaatatagcaaaattcgatcaattaaattaaaaccgttagttttaccgtcttcattccttttgctttgcgccatcgattttaatactcggtgatcatccacggcatacacatcatgtggtcctatctcaaaatgtataactcaacataatagttagtccacaattagcttgttattaattaccaaaatcaactagggggcctagatgcttcatacgctcacttcgctaaggaccaattgtttctgatggcaccatttggtttcttccgaagatcagatacgcattcaatccgcctttacatcagctaaactaaacggttttgaaacgaatcattcattgaaccaccaccg

SEQ ID NO: 70132 - DNA, 1922 bp, Oryza sativa
agccattattgtacaaaaccaagtgtcatcggttcagtatagagggctagaggcggacatggagccaattctaaaccatgttcttaggatcaaaaccaagtgtcatcagttcagtatagaggcggacatggagccaattctaaaccctgttcttaggatcccgcggtggatgagttcccagcatcatttttcttcatgtcttcaaacttatcaatggcgacctgcagctcatctgtgcctcccaccgctctcatggtgtagtaatacacgccgaggacgaaagcagacagtcctccagccaccacaaagttcttggtcttgggtgccaggctgccgaatcccgccatctttagtttgcaccggttgttgcagaaactgaagaagagaatgttacagaaacaggaagaagtggtgccacactgatgccagttgacctttagccaaggcacagagctatatgggatatatgaatttaaactgaagatagatatggtttgctgatgtagcctcaagactaagaccctgtttagatgcgactaaaacttttaagtccctatcacatcggatgtttggacactaattataaatattaaacgtagactattaataaaacccatccataatcttggactaattcacgagacgaatctattgagcctaattaatccataattagcctatgtgatgctacagtaaacattctctaattatgaattaattaggcttaaaaaatttgtctcgcaaattagcatttatttatgtaattagttttgtaagtagtctatatttaatactttaaattagtgtctaaatacagagactaaagttaagtccctggatccaaacaccacctaaactagtgtttgtctttaaatcacagtataactaaaagtgggaatttgtaatacaagttccgattatactagaaaacactcgagctagtcagtgctagaatatcaatcctggacagaacccatctgctacaagtgcagctggcaatggcaagttcgagagcataacattagcttacttagcagtggggaggggattgaaccataccagaacatagcctagattgatttggacatggaaaaggaaaagacttacctcacagcagtaaattttgagagattaataattttagaccaaagaaagattagagatttaaactaggtttgatggttggagtttggctagactagtaatttcgggtgtttactgtttagggagagtatttgatctccctaaaataaaaaataagctatcatattcagagtgaagggccttagtattagagcgtagaaactcatcatcacctgtttcagctactgatgatgttagtacactaaaatcataaatatctcagagctccttttatactggatttatagtggtacccaaaaaccaaaggcagtaattgtgtagaaagcaaagattttcatattatcggcacagacaggtctctgtattgtttttttttgttcagattcagagttggtttgtaaaaagactccctcgctctaatatactcctaggcagagtaggaaattgactaggaaaggatgtaagcaaacatcagatccatcgcaataaactttggcctacaccatgcatgagaatgagatgaagaaatccccaaaagatagataaggatgagcaagtctccagatgagagatccggctaagttttttttttacctttggcgaggagggagggagggctgttgggggttggtgaggatgcggcggcggaggaggagagagtggggtggaggaaggcggcgccaggcgagcgagagagagaggtcttcgtcttcgaggatgaggaggtcggtttcctgttcctcccactcccagtgggccaatgggccttgctgggctgggctaaactgcaagccggcccgatgagatgaacttcaccg

SEQ ID NO: 70133 - DNA, 2164 bp, Oryza sativa
caaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacttgcgcttctcttctcttctctgctgtgctttccatccatccactcccacgaaccgcacctcaccttctttctctttcattctctctgtactgtacgtacgttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaaattttcagcctctactcttattactcatgttattattatcatctcctgtataaatgtaatcattggatggcctgttctcgatctgattcaattagctagttgtacagtttaaaggcgtgtgctcagaatcatccatgaaatggatcaacgcgatcagtattcggtggtgtaagtgtaaaaatatatgcatgtatgtatgtatgtatgtatgtatgtatgtatgtatgtatgtatgtatgtatgtatgtatgacaggcaaacaaattaacacaggcgttgcaacaacatttagttataataatggataaccacatcaagcataaagtcgttgaagcgtagaatcagagagtccatcaggacagggaaattgcaaggcgccagtgccatcaactttacgttgacactgcaagtgctaatgcgtagtacgtctctcatcactgctcatgatccatccatccatccaaccactccatctgcgtgtgtgtatatgtgtactactctactttatacgctacctgtttgtactcccagctgaactgaagttttataccattctgttttcccaactgaagcttcaagctgaggttttgtacatatgcaatgcaccacaggctttacctagaggatgaagctgacaagcacaacaagtaactaatctcttgacagataccatactatcagatag

SEQ ID NO: 70134 - DNA, 664 bp, Oryza sativa
  unsure (1)..(664): unsure at all n locations
tctctttacactataaactttgtattttagagatgaaataagatagaagaaatatatatataagaactagtttgtaatgctgaagcatattgatcggataagagttgataaaagtatatagctagcatattcactggtactatcattaattgtcttcgtctacaaaagtatagatcacatttgccattataatggttatatacttggttagaactcgtacgtgttgccttttttggttgttcatattttcattttttagccgaggctccaaaacagaagcgatataaacttttgaattttgtgtcgtctttctgcgtgcaggctctgaagcatgagcaggagaagtgcacttgctgcagcaggcctnnnnnnnnnnnnnnnnnncctnnnnnnnnnnnnnnnnnnnnnnnnnnnnntgaaaggtatctatccttagtttggaaccctgattacggatgatactttcatatttccttgagagtaacgcatgcgtggatgcatgaaccaattaatgtcagtgacacaatccaaatcgaccgtgagcattttgtcgaaatgtgtaaattgttagataggacatggcaagggacatgtatatgcatgcctgcatgcatgagtgagtgcatggagctagctactccgaaatagcggggtgcagccattg

SEQ ID NO: 70135 - DNA, 33675 bp, Oryza sativa
  unsure (1)..(33675): unsure at all n locations
gggtctgttctgttttccatgtcctttaagtaaggggaaaatgaacatttgagagcacaagatgacaagaactgttgcgttcgaaaagtatgttttttctctactaatcggttggattatggatacgatgatttacttctaggacgagggagcctcgtccaaaataggctaggagggcagatatagatcataaaagggcattagggttgaaatgcacttgatagtgcagtgactaagaacgtgtgattttaaccctaaggccctttacttaaattcctagcatgctcacaatttaccgaagataccaccggtatatcattccaatggaatagctgatgtcatgattatgttagcataatatctaggtacaccagatcctatacctatcggatcatgctaacgtcggtatagtacctggtaccatatctgatgcatatagagtatcgtgctaacgacagctattccgttgtaatggtatgctgttatatagtctacctctttttattttgtcacttaagtttaaggcttgattagaattttagacagggcctccaaatttcagaggacggcccagtacgaggcaatactggactcctagcctcctggctagtgatgtgggcttaaaagagctgatcccagatgggcccttttattttaagcccacgacagcctttgatctcgtgtgttcttttccccacgttagtgaatcaatcaaccttgccaagtgccaactaacctactcctatagttgattccgtgaaatccctgccagtggtatagtcgtacatggtcctgttataattaatgccacttttcacgatcctcagttccttattatagtgcttatctatatgcatgtgcagaatagaatcatagattagccaatttgcagtacctttttttccctttgagagtaccaacttgtagttatacaccaatatacttaaccacacagcgaacagtaacacctccaaatctcaattaacaaaacagaggaaaagatcgaagtgtagtaatctccagacatgagtgaggtagtacaagcaacgtactaccagtctaccaccaccagtaacagcaagcctcgcagccaatcgatgaccggtaaaccgcatcaggttcgcgtggtagtacaagtgcagaatcgtgtgtggaggtactacgcgccccccgcgcgcgcgacggcgcgagcgacgcggatttctttaagtttttccgcacggtgttacatgggtttgcgtctccgctaatcgagcgcctcgcgcgcacacgcgcgacggttggttggttggttcggtttgtttaagattttggttgatttcatcgagcgatcccgcgagcgtagacgtgactgcgcagccgccgcgcgggggtttttttatgcagttgagtgaatgcgcgcgtggtcctctttctctctctcggctccgagtctcgtgacccccgctgctggagtcgtcggccgtcgtcgtcgacgctgattcggtgattctcgtcccaccaaccgggtttttctatagggtgggtttacactttacagattaggtcgctttccacgtcggccgtggccggtcgccggcgtgacagccttagcttacggcggcgacggcagcggcagcggtgttgtgtagcgcctgccttcgtacaaggatggtagggtatcaacaatgcagtcaaacttttttcttgtaaactaaaccggtaaaaaaatttgttaattatatttttgataagtaggagaaaaacgtatatggttatatggtagttttagaagtgacatggtaataacacatagccgttatatgtagaccgaggtcacacattttctccatagcgctagtggcttcaattgttatctttgtttttctatgtcagtttatgatattttctattacaatcatgttttacttaatttacaaataagttcaaagtattgcactaaacaccaccaaatctagaaattacaaaaaaatccccttgcactctctctccctcaatgtctctccctctacgccaataagctcgatccccacgggtgtggataaagagctctccagctgacactgcctctcctctatttttcagcatatatcaaaggcatctctctttttgaccgacgagatctttagctaagtcatcgttttctttctccaaagcaaaacaaaggcggatccactttgccaaaggatccactgggtgatctcaagactagggccaatgaggtcattgacagctagattcatagatcaggcgatgggtagcaggttgggagtggcccataaacaaggagagatggtagagcaagctgatgagctctacaatgatgggattgttgtggctgagggatgagatgagcatgggactaaatctacatcgacaaagcatcatacaaataggcctctcgatcttcttctcctccactgcgcttgttttcacttcctaaccccatcattagcctctcttttttttggtcgagctagcgaacactagccgaaatttattaagaaagtgcaagaaatttacatgctacaaccaacggcaagtcggtctccttctttcattggccatcacccgttggagctccgcgctcggagaggaggtggactgcaccgcattgctagagcatggcctcgccgaccatggcttgcgaaccatgcctccacgctcgagtacccttgccctgacgaggcgtgtgtcttttgtagggcacgactaaggctaaggtttaaggcccccatcctttggccaaatacatataatacgccattcggcgtattagcaaaataataataatttacagataagactttcatatatgtgtttttagcgacttaaataccaatgctggaaaataaacttcgatgaaaaactttaaaatttcaaattttggtagcggctaatgctgattgaaggaaacgatggggacctaagagcatctccagcaatagaccttattttgaagcgtctaaaagttaaatgagggctgcccccatttctcaaggactaaaaaatgcctccaactccagcagtagcccctatttcttagtccctactcatgtttatcttgtattttaaaatacaatccatatacagtatgtttaacaccacaaaaattcgaacacaattatttctaactcacataatttaaccatacttaaattcacaatttcaaacactacaattcgaatacaaaattaaaatttttaaacatgtaaatatggtatgggtacagtgccatatacgacaacaagatgcaaccaagattcgtaattcaccaatgaaaatgaaaattgctcataaaaaatacactatgtgaacccaatgatgcattatataatttaaaaataatacatcctacaaccatgaatgattcgattataaataacaaatctgaaagtaatatatgtcctactagcaagtgacactaaaattattgtggaaataattaacaaaaaaggactccaaagaccaatcgtgataatggcatatcctactagtaaaggacacatggatcatccaatagaatccaacttattccatcgaagtgctcaaacttctccattaccgccaccaaactcacctccaaagccactactaccatcaaatccaccattgagggcagccacctttgaagctgcaatctgtgccctcatagccaacacatacgttctcacatccggttccaaggtggaaacatcacaaaacataatcttctgttcttgatcccacactaacttacgctcagcaaataagagcttgcgctcttgaatctccttagtttccttccatctctcttctttcaatttcgcttctttctctttagcgtcaagcaaatctttcatcgcctctttgtatggtccatcttgtcctccattcttcaacttttcctttgcttgcttcctacctattggtctctttttagcactcggctgagataaatcaggagctgtactcttgctagcatcatctccttcatcttcttcaccagctctctcaattggggtcgaagacttcctagaccgtggcctcttgtgggattctagtgtttgaaactttggagaattcctcaacttgagccaacaatgattaaactgaaatgccctattctttggtgcagtggacgagtataatgcctcagcttcaagaacctgcaacataatttaagttttaattcacatacatacaagattgttattaataataataaataaacaatttaacttacaagctcttgatgtggtatgccacttggatgacgacgctcaatttgattgtagcaaccttgaaacttgcttacttccttctgaatgttaccccaatggtgctcaagagagtttgcattcctatcagactcaaaatcacggttagcatggtagtgctctgcgatcctctgccaatatgccttccctggttgctcattgccaataataggatctgagctaatgctctgccatgaaatgcacaattgaatgtcctccttatgagtatagttgcttgatcttttggcacttccttttgcaccatttgttgaagtacgaaggtcttcatttggcattagcacttcgacatcagtgtcctcggacatcatgcgcacaaaggaatcacctccacttgtcattgcaatctagtcactgcaataaatatataaattgacaacctttccaatctatctcagaaacatcaacaagtgattgcaatgtacatcaggttatactgtttgcaatatgtatttatttagcatatatattggttgcgcagtactaaggactcagtgcaaacacaaatttatttcttaaatattatatatgctctgcaagattagctctctgacatagaacaagacactgcatataaaacatgaatgatgacaatgtacgttttgctgtgcgaatgatttagatgggcctagacgcctagtaagcccataaagatcaaaatcaaacaaggagactcagacatacgaaactgaactttactattgtgatttgttttaatcaccatcatctctgaatttttttactgcagcatgtgtgcggccggtgatagatagctgtcgatggtcggcgctaggccttgtggacagcgggtgggcagctagttcggggaggacgtcgagactcacctgggcatgatcaatcggtgacgacgtgcgttggccgaagatgcaaggaggtcggcgacagtgagtgacggagtaaaaccgatgattgtgatggcttgaggcggcacaccatgggatctcgccgaagtttcttcccgagggatgtcgggtggtcgccgaccggagcaaaacgacctggcggcttgctcgctgggaggttgtgggaggatggcgatgacgcgggagggaggatgacgatggcgcgcgctcagaaatttcccccgccaaaaaaaaagaggatgggggctgtggggttgagccccccggactgggggcttggaggagtgatctaggggcctccctagattgggggctctagtagggaatctgctggacctatatttttttgcatcaactctcaaaacttatttagggactttgtttgaggaccctgttggagatgctctaagtaattaagaattttctttggttttattaaaattaagctggttactatagttggtgttaaaactttttattggacagcgacgtacgtcgtgaggggattaaagaatcgggcaagttggccgaaagccaacgtggttcgtgtgggcgctaccgcggtagcgagcgagaggtgcatgcacctgtcagaaaacggatgcaccacccagggaacggacatcttgttttttcttttttctttccggaatccggcggagaggaacgcctgtgcaatccatgaaaaccgcggctggctttgggggggctttagctacggaacaaaattttcgagatgttgcgcctacgcctcccgtacaggctacagccctgctgcagtgctgcgtcgtgacctgacgtgtctgtctagctgtctcgtggtactagtacgaaatttactgacacaacgcactagtgcatttcccagctgttgaatttcacctaccattggagtgaccctgtttaaatggtagttaaaagtcttttaagtccctattacatcagatgtttgaaaattaattataaatattaaacgtagactattaataaaactcattcataatcttagactaattcacgagacaaatcttttgagcctaattaatccataattagcctatatgatgctacaataaacattctctaattatagattaattaggcttaaaaaatttgtctcgcaaattagctttcatttatataattagttttgtaagtagtctatatttaatattctaaattagtgtctaaatacaaagactaaagttaagtctctgtatccaaacaccacctaattcgtactctaatattctcaaatgtactgctactactactacaatactgcatggatccaaatactcttataaacagttaacagatcgatattgtaaactacgagtaaaaagtattccctccgtactcgttttggacagcgacacggtctccaaaacataattttgacttcttgtttctataaaaatatatattaaaaagtgatatatgtatacttttatgaaaatatttttcaagaaaaatctattcatataatttttacattttcaaactcaacaacttgagagttattcatgatttatattcccaatgtttgacttaaatattgtcctaaacgacttccattatgagtacagaggaagtacaatttacccccgaactattatggtacggtagtacaatttaccctctaaactataataacatatattgtattcaatacctcaaaactcttaaaaccagacgaataccggggcactattttggacggttttaggctaggttagctgacttggcatttctaacgcggcaaaaaataacaggcccacttgtcagtgatccatatattctcacctcatctcttctacctccttccacctcgatctctctctcatccttgaaccgagcagtgaggagaaggccgcggtggcagcaaagactactccccgggttgcttgaggtggagcgtggtcggctagagaagcccagggcggtgacggtgcgcgacgatggccatgatgctaaaccgctcgttctcacggggggagcactgcgccgcctggagcacctcccgcgcgccgcggtaccgccctgtggccaccgaccgcgctcgtactctagcgccagcactgagccgttgccaccgctagagctgccgatcggattctattccagggcaacgacctcgacgttgggcccttgtcaccatcacatttgtcatcgcaagcctcaccgtcagtgccaccatctttctcgtgccgcgcagcacggtgacaacgacgatgtgtccctgttgccgtcgccgtcgcagagcgccgacttgcagagctccaacttgacatagtatccacccaggtcactgcacaggcgcacacgcagtccatgccgctatccctccttctcccgcctgcatgccagccccaagaacacggtgacgaaaatgaggccaacgtgcgtggccgactactgctaggctgaggccgacctgcggtcagagaggcgaggccgagaacgagcggccaatgctgtcgtcgccgttgaaggcaaagggcgcggccgacgcgctcgcgcgtagcctccacctcctggggtccatacttgtcgacgcccgcctcttgcgtagctccatctctccggcaacaccgccgtcgtgcccgacgcggacgcaccaccaacaccaacaccgcaccactccgccgttggccgcacgagcgtgcgcacgaggaagagagagtagggtgaccggggaggcgttagattgagggagaagtatgacaagtgggcccacggagtttttttaaaacttttttgctgactggactgacacgttggcatctcgtaggtaagctcaagtcaaaaccgctaagaacaatatttaggtggttattagtctagtataaataattgagagtgcaaaatgtctacgtgagccttcacgtatacacacaatgtatacaaactaacaaatattatttttttagaaaaatgtacatgtactttaaatagtatttatatatacgcgtgaagtcccatctttaaatttatcatatatatatatggagaaaaaaatctaagacttatattcataaagctattagaattttttttaagtatgaaatataatgaatttgaggataaaactttacgcatacgtataatagtattgaaagtatatgtataatatttttaaaacgttttagcgatatttagtatagttggtatgtacagtacggagtatggacatgaagtttggtcctgttcgagaacccaacaaagggcagattaagttctagattttcgtggcacgcttttcaaactgttaaacggtgcgtttcgtgtgaaaattttctatatgaaagttgttataaaatatcagattaatcttttttttaagtttgtaataattaaaatctaattaatcaaaagttattaccacctcgttttacgtaaaacatttgatcttcatatttatcttcagaagattcaaacagaacctttgtgtgcccaagatatgaacctcttaattaacaaatagatatagttgtatagctatagctgttgggcgcacagctttttcatccgtgaatggattacattgtagaagtaaaacttatttcgaaaactatactgtataagtattcgacactggctttaattagctgaaaggaaactttcatatgcccttttatggaccaacatgtcgcacggaccacatttggtataaatccactgaacacgtttgatcttttcccgcctacttagctggagccttatccattaatttcaaacagttagtaagtcctcaaatggactttgagagtcacgtgacaacaactagggttttttttttttggggggtgtccactcgatctttcatgcatattcacacctttcgccttttcttttgaaagatcacggttaatttagtgctatattaaagaaaagatgaatagtttaaaaagagagcaaattaatttaaaaaagatacgaatattagtgaagtacctaatatcaaataattagaagggataaggaccaaggtcatctaacccagccggaagacctctgggtgtttctctaaaaaagagcaaattaatattcagttgatttagaacaatcgggctaaaaccgccatacaacaataaatacactaactagcttttttttaataatggaatagataacatctcggcctttgctcaacagagctacagccaattattacaatctagcacttaacaaagagtgtagttcaaatagaattaaacacacacctaaacataaaaaaaatgaccagaccaatataaggagcacacaattatttaagtctatttgtgaatctccatccatagttggcaaaaagttgcataaccgtcgtctcaagcttacgacatataactttcaaaagctctccatcttcatcacacttttacggttgtgcccaaaaccggagccaatatgttgctctgaagaatgcctgcataaatgaaatagatagtgatttgtcaaaaatcatatcattcctactcaatcacagagcctaacatatagtacaagcttctacaagaattagtttgctccttttcttgttcacccccaaagccaaccatcaaacatacaatgtatgaaagtaggaaggtataaaccaaaagagtactgaaacgctccccaaacaaattttgcaaaatgacaatctataaaaagatattgaatagtctcatttttcatacataaacaacatcttaagctgccattccaattccgttttgccaaattgtctttgttaacataacccctttaagcaagtaccacataaaaatcttaattttaagcggcatcttaagtttctaaataatcttatttctctcaatgtaaccattattaattaaggcttaaggctagatacattgaccttacagaaaataaaccattttgatgataattccatctaaaatagtcagtagattgattcaactgaatatgtacaatagaagcacgcaattcatgccaatatacaagattctgaccaactaaaactcttctaaaagaaacattaagcggaacagatcccatggcattagcaatagataaatttttccttcgaactatataatataaagatggatatttatctttaaaagccatgttttctagccatgtatcctcccaaaacttcatttgttcctcattattcacaataaaaaaactcatattttaaaaaatatttttaactttcataagacctgacaaaaaataggaatcaccctaactagctagcaaagcataaccacgacaacaaaactaacagccttaaaacaaaacgcagttcactgtacattggtaaaaactcgccgtcattcgtcatcacaccaccgcacacatgatcaggcgactccaattttgataagaattaagaaccaaggaacacaactttacctgaccaaaaccgaagtccgtttgactaatgctttcgatgccacatatcatggctccgacttcacaaccaccgtgcgaccgaatcatttcatcattatcatatcttatcgaatgaattactaataatctatcgaatgaattactgcggcacaagctaagactatctctatcctattttttgttgtcttcctcttatgatattactccactgcttttggaccacactagtggagctaggtttagatgtactaggttttcaagtttgctttacttagaagatagctgaaacatgatttcaaatagacaaaatagaccaaagtggaattggatagagaaaagattataattgatgtatgagttaactaagcgtcaccacaaaaacatggtttccagtgttattgatggttcggtttttccttgtcatatctagtgagcaaaacatatggtttagtgcattgacccattcacacccaattgattattcatttcattcctaaattttgacctaattccatttacacataccgtgagtttattttttattttttgcggggaacaccgtgagtttataatacaactcgtaaagagacaaatcattgtgataaaattatactactgttagacatacacatgactcccctgcaatagagtttacggatgtgccgaggttaaaaaaccgctccctaacggcaaggtcgctaacagcaataacggttgaaaacaagtgaaattcaaacattttttccgcaaaataaaatttagcttggatttgtttgaacttaaaccagttatatcgaacaatttcaaatgaccatgtcgatctatccaatgactgtgataatcagtctgttagcgtcgtagaaaaagtctagatgagaaaagtatcgagaggatgggcgaacataggtcagctcgaccaccaaattgacccaaccaacttgcatgatcgatctttgccgttaactacgtacctcccctcctacgagtgcacaacaccacaaaccagcttgtttcctccatatcacaaaaggtaaatataaaagactgaggaagtataaacatttgccgccaccaccattgattatcgagttcatcctctagtccccgcagtccgcagcagaggaaagaaagcatccaaaaatctaagccacaccaaaaaaatccttttttttttcttcttccttccctttcctcgatcagcatcatatatccaacacaaaaatctagcaccaaagatgcagcgaaaagccgagagagatgcctgccggttccggggcggggcgcgcgacgccacctacggcttgctactgctgctgctgcgcagtgcagaagcccactccactccgcgcgagacatccacttgcccgggcccggccggtccgctggtccccacggcgccacacgccccgagaaccaatcacggggcctcgcttccctttaaaatcccaccaccctctcctcccacttgcgcctagccccaccacctccaccacctcacctcccccttcccttcccttcccctcttctctcctctactagctatagtataggccgcccccgtcgttttgttaattttcacgccgaaatttccacccacaccacgcgccgcctgcctacctgcgcctgcgcgagctgcagatcgatcgacgagaggccgcgtctcggtcgcggggggtggagttgatcgatcgatccaaggaggggtatgatgaggaggtttctgccggtggggggaggaggaggaggaggggtggagccgtcgtcgtcgtcgacgacgccgcagccaagggaggcggaggcggcggggctgcggttcggtgggggggacatctcgctgggcccgcacggcggcggcggcggcggcggcggagggggcggagggcatgggcatcagctgcaggacgggagcgtggacttgctggcgcggcacagcagctcgccggccggattcttctccaacctcatggccagcaacggtaagatcgatcgatcgattgcgctagccaacccattgttcgattttatttgttcatccgtgttcaatttggcgtcgcgtgcgtgcatagctagcccatcgtgtataggcgtatagctaattggttaggactactcagagtcacggatcttcaatttctagcttaattctgtcaggagagaacggctagctgtgcaaatgtcaacctcgtctttgccttcacatgccccatctctttctcgtcacacacgcacacgatcgaagtatcgatcgatcacatgaattgctgttctaggcttctagcaacaaccaccaaaaaaaacgaattccatcgatattattgttaatggtgttctttctctctcagtgtttcctccacactgtttcagattcttcccatacttatccgaaaccaaacgggtttgatcaatcgatcgatctctgtctacctggttcttaacttctatgcaactcccatcactactaactgccaaagccactagctcgctcggcgacgacgaaatgctgatgagctcgcgctatctagctaagctcgatcccttttgcaagttgcttctgcggcgcgcgcgtgaatcgatcatcgcgtgcgacttttcaccggtcctaactggttttttttttgggttaaaaagtggttttcgctaaggccgtcatgggaggagctagtgtgtatatcagactactatcagtatgcgttgtggatatccatggatgtgttagtctgcggctttttgctacgtgagttgccataaatagtatcatggagatcctctgtgcccatttttctactcagagccattagccataggctcctatatgtggttagtaacttttgtgtgataataatgcatgtttgccacagttagggtcaatatatatatatatatatatatatatatatatatatatatatatatatatatatatatatataagctgttaattaaggatccaccatgagatgttatatccatgagattatgcggcttaattgttttcgtgataatgtaatatgagttcaagtttttaaggcatatgttattacgaggagtgcacaaatttggctcggcgtgtaagaaggacgatggaaaactatgggctacacaggaggcgggttttctcaagtagggtatcatcgatagtgaaatgtggggtctagggttttgaatacaccgcttttattctttttacgtacgctttttataatcgagtgtctctagattgtcttattttctattgcaacttgctataaatggcttagtttttttgccacttgcacctggtgtccctctctctcatttgatccattattttcagttgcaaagtcattgcgcatgacaatccattcttcactacaatagtagacatggggaaaaaaaacaatttgaagctatagtggagagagcaaagagatagatgtttttttttctaatttaatttgttcataataagactagaaaaccatgcattcatcttccaggatttgcacaaatatgtacatttgattaattagtatcaccattcaccaacctagctagctaaaacaagctctttttaaaaatgtttttggcaagtattctcatttcatataaaggatacctatatgcacctcatttgatgaaaatcattgcaaaattatgcaccatcattatttattccatgagtattaaattaattctgcgtcacaaatattcaacgttttagagcatacagagataataaccctttaatgaaaacttcaaaatatcatttattcaaaaattaggaataagtgtgtcaatatctttttgaaatgcagatcaatatgaacatagagttatgttataattaattttcacactacatatataccaacatctaaaatggccttttgaccgagcaacctgtatacaacaattggtaaggataaaaatagtaccagtagaaatgtcgaaatccacatataagtactacaccagtactaaatttagtaattatactttgatcgaggtaggaatagcctcgagtaaagtttaaaagagtcaaatgtctttcagtggagcccatgtagcagcatttctttcaatgcggcagccagttgcactctagattctgctctagatagaccaacttgcgcatatatgatcaattaattagtatcaagacagcaagcacaattaaattaccagtggatcttagtgcctcgaaccctagccaaggcaaaaagaaaaagatgagggcatttgattaatttgtggattaattaatttttgatcaatggattaattagggcgccacttgccttaatgtaaggcggggaccacgtgtgtgtcgccgcaacttggcctgcggggtgggccccccggtttgtccaggttcagctcctctgctgatggcctgacggtgacgtcacggtcttgcctcgctaaagatagtgacctacggtgcgttgagatggcatgcgtgattgctcggcttcttgatttggcgtttgctttctctcttggctgcgtctatgtcagcgtgcgaggcttgctcatatgcacgggccggcacgcggcatgcacgtgctagcgtgtccggtaggcttcaatataccatctgttcgcatcgtagtacaaaaaaaccgaagaaaccatccgattcaatgaagaaaattatccatattcttaggttgttgtattttgaaatggagagagtacttgttcttattaatttgaggagaataagatcgatcccctggaagtagtcgtaggtacgttcaaaataaatataaaataaatatagtgtaatgtgtgcatgtcagttcactggtcagaaaataattttcgcgtcattcgcagcaatttgactagaaatttacattgtggaataaaaaaatcgtggggccaaaatttcaatgtttttaatgaaaattttaggctagatcttgggattttcttttttaacacagtacagacacaaacatgcatatatacacatgcatactcaacgctctgaacatacacgcacaccctatcactatataagcacctttaaagaggaccgtcatgaagtcgtcacagacactgtcaacatattttaaaagttgataaccaaccattttgctaagggcctgtttagtttgcgaaaagaaacattttgggtgtcatatcggatgtttgaccggatgtcggaagggtttttcagatacgaatgaaaaaaataatttcataacttgcatggaaactgcgagacgaatcttttaagcctaattaatccgtcattagcacatgtgggttactgtagcacttatggctaatcatggattaattaggctcaaaagattcgtctcgcgatttcctccctaactgtgcaattagatttttcatttatttatagagagaatcccttatataccaccgaaagttggtctaatcccttatatgccattgacaattagttcttcccttatatgccattgatccaaatttgcacactctctcacgccactcccgtcagttgacatgtgttgaccgttaattcttaaggaaaaaagacgtatttacccttctgagtatagggcatgcctaacaactcagagagggcaatatgtcttttttacttgagagttaacggtcaacacacggtcaactgacggtagtgacatgagagggtacgcaaatttagaccaatggcatataagggaggagccaatttttagtggcatataagggatcagatcaatttttagtggcatatgagggattatctcttatctatatttaatgcttcatgcatgtgttcacaaattcgatgtgatgttttttgaaaaaaaatttagggaactaaacggggcctaagttaaaaaattcaaatactttttgggcttctattgggacccaatagtaatccaaaatttgaaacctttgatttgaatagcgatgtaactattgggcatacaaggtttgaaaaaatggttacggccggattgctaactttgatattattttcatccaaaacgaccaatactgaattggagggagtagaaattaagttgcaacacgtaagtacatgtttgacgatgtgcttataagtaactagtaatagctagtaaagatgaacgcaaatgcaaacactaattttaattgtttttgtctctttcatatatataatattcgtctcactaacgatctactactctttctaattaaggtggtcgtttgaactcatctttctgtaagtttcatattcttaatacttgtgaccactcaaaatagaccttacattttaaaatggatggagtacaactttctggaacatatggttctagtcacgagaatattcctctcatatactccctccgtttctaaatattcgatgccgttgacttttttaaacatgtttgaccgttcgtcttattcaaaaattttaaataagtattatttttttcctatcatttgattcattgttaaatatacttttatgtatacatatagttttatatatttcacaaaaatttttgaataagatgaatggtcaaacatgtgctaaaaagttaacggtgtaaaatatttagaaacggaggaagtatatcctgtatctatcgtgctattttgtgctggggcaactcggccgggccacttttaatttcgtagtgctagcttgtaattttttttaattagttagtagtgcatagtgttgatgaatggtaattgttgtggtttaagttatgtttaactataataaccggtgattagtcaagtttaatttgtacatggatttcaaatagaaatttggtagtgtttaattatgaaaatatttatagaaccactatgcatatataacattacacctgcagttaaacacacatttgaacatgagaatcaaacctaaccttaattacgtgcacctactacagaaaaatattgtagaatcaaatacacactactccattcaaccttggagaagcaagtttgaacatcccatcacatctaggttaaacttattgctcaacacgtgtacctatagagctagctctaacggtatgctaataccgtaaactattgtttacttgtcacacttggcagttttcaactagcgtttgggtaacagtagctctttctctcacacacacagttaatttaactaattagcgatcattagttaatttccgtgcttgctacttggcaataaactaagcaggctttccaggctcaaaaggcgggggaggcagcggagccgaagcccaccaccacccttccatggccggcagcggcagcggcagcagcagcggcgggaggaagatgaagtcccagctgagcttcacggccgggccgccgcacctctcgcacatcgcggaggacggcgccttccccgaccgcgccggcgccgaggcctccgtgccccgcaccttctccgccggcggcagcagcggcggcggcgggttctccatcgtcgggccgtgggaggagtccagggacatcatctccaccctcggcgggtacgagtcccaggtaaagattgctcggcaaatttgattgctagggctaccttcattgaatcattgtacactacaaggcttcttgatctcttcatcccttgtttatatttactaacattcataagaatttggacacatgtatgaaacacatacatttatacatgtatgaatctattcaaaactcaaaacaacttataataattaatgtaaaacagaggaagaagtagtagctagctttgctgtgtttgtgatatatatatatatatatatatatatatatatatatatatatatatatatatcgcgatgtgttctgatttcttgggcgtgttggaaatgggggcagttcggcggcatggcgagcacgtcggcgctggagatggccggcatggacaggtacctgcagctgcagcatgaccaggtgccgttcaaagtgcgggccaagcgcggctgcgcgacgcaccccaggagcatcgcggagagggtacgtacgcaatatcatgatcaaaacgcctctatatttgcttttgctttctcttcagatcttgacacatgagcatgtacgtcggtgtgatcgatgcgcgtccgtaggaacggaggacgagaattagcgagaagctcaggaagctgcaggagctggtgcccaacatggacaaggtggccattacgatttgaactttgcataatgttcatacctatatttacatgatatttgaggaagaaaggaacatccctagctaagtattttcttttaaaaaaaaactttccacatttcttgtgccattagcacacagattcatgtttctcgccttaataatagacatggcaaatgcacacgcattcacccatgagtgtgcactgtgaagtgtcccttaacacatgctcaacaaattcatggacaccaagcgcaaaatcataacctaatagaatttctagaaaaagcgtatccatgtttgtgtagttaaattctataggcactgagattagagctttggtgcatgacagccacaactccaacaccataccaaacatgctttctcaacaaattcatgattattgtatatagatgaaaggggtcgtacgttctctcatctagttctagctaatattaattagcggtaacattttttgcgcatgaataatgcaaccaattgagtaattaattatgttcgtgttgcaacagcaaacaagcacagcggacatgttggaccttgcagttgagcacatcaagggtctgcagagccagctgcaggtacgcatatttgaggatttcttcacaaggactaatcccgcaagtaggggataagattgaaaattcacatttacattttttttcgtgaatgcgcaaaaggcgcgcccatcaatatattaaaaggaaaagaggttttgttacataacgcaaccagctagacgagcctatgcgaaggaaaggaagaaacgaaaaaaaaccgacattgtctatcattcccttttgttctaatcaatttgtcttatttaaatcttttccctctcaagtgatgtatgggctggtaattaatacacctctcaaggctgagagataacatattttctatttagatttgttagcgaaatagccgtgctttgctacaaataactacaaattatatgcatgctagtattgtttggaacaaattaactacgaggtgtgttagaagatatattcatccctggggatctctttacactataaactttgtattttagagatgaaataagatagaagaaatatatatataagaactagtttgtaatgctgaagcatattgatcggataagtagttgataaaagtatatagctagcatattcactggtactatcattaattgtcttcgtctacaaaagtatagatcacatttgccattataatggttatatacttggttagaactcgtacgtgttgccttttttggttgttcatattttcattttttagccgaggctccaaaacagaagcgatataaacttttgaattttgtgtcgtctttctgcgtgcaggctctgaagcatgagcaggagaagtgcacttgctgcagcaggcctnnnnnnnnnnnnnnnnnnnnnnnnnnnnntgaaaggtatctatccttagtttggaaccctgattacggatgatactttcatatttccttgagagtaacgcatgcgtggatgcatgaaccaattaatgtcagtgacacaatccaaatcgaccgtgagcattttgtcgaaatgtgtaaattgttagataggacatggcaagggacatgtatatgcatgcctgcatgcatgagtgagtgcatggagctagctactccgaaatagcggggtgcagccattgtgatcccttaattaattctcgatccactgatgattaattagcttgtaattctgtctttaaaccttttttttaatgacgaggggagagaaaaagaaaatgaaattttggtcagcatgcagaaagaactacattattaattcgtgccatttggggtgctgtttatagctaaccttctcgatcgatcacctttgtgtgtctcaagttgcaaccatactggtttaatttgtgctttcaatgtaggaggactaatgcagtgtacgtgttacgttgatgcaataaaaatcaccctttttaagttattgcagcaattgcgtatgcatcactactaagaaacgacttttggggcgttattttcgcaggcctttaagtacatagagtatttgaccgcctacaaaaatgtgttttgacggttttttttaagtagtgcatgatcatctcgtcgattcacctgtatcactgtatgtatggttaatttgggtttcggagttggactatgtctcagcttaaatcgtttccaatcgaattccacaccgcgcgcgcgccatgccacaacaactgctgcgtcgcacccacttgcacttgcaccgagcgccatggcgagtaggccggttcatccaatcctcgtcgcgttcttggcgctgctcctcgtcggcacttgccaggcaaggccggctccggggaaggccgcgtcgtcgtcgttgtcatcggcggcgaagggggcggtggtggacggcatcacggacatctacaacttcggggactccatctcggacaccggcaacttcctcgccttgatggagcacaccgtggcgcctccctacgtacggcgcggccatcggcagcgccacggggcagtgctccgacgacgggtacctcatgatcgactacctcgccaacgacctagggctgccgctgctcaacccgtacatcgacaaaggcgccgacttctcctacggtgtcaactttcgccgtcaccggcgccaccgccctcgacgcggcggccctcgcgaggatcggtgttaccgcgccgcgcaccaacaactcccccactggagctggacgctcagagagagctgttggtgtgcgaacggaattactggcgctgacggtggaaggatgagagtgtcacggaacgaagaaaatatcgcgtccaaatgccatattatgaaagtagtgcgaattgagtggtctatcctgaaaacggtgcatattcggtggcatattctgaaaattctcgagcaagagaagctggcgcgagcttgctggtgatggtgggagagatcgccgcgaacaggccgcgaacaggaggtcgtagcgccgcgcggacgtcgggcgcatgatgaccggcgtggtggagtcggtggtgctcgtaccagaggtggtgcggtcgcgtggtgagcgcggcgagggaggtgctcgagatgagcgcgacgcgggtggtgatcccgggcaacttcccgctgggttgcgcgccgagctacctggcggcggtggacgagacggagcgcgcggcgtacgacgggaacgggtgcctcgtgggtctcaacctgttcgcgcagatgcacaacgtgctgctgcagcaggggatccgggagctgaggcggtcataaccggaggccacgatcgcgtacgccgactactccggcgcgtacgtgcggatgctggagggcgcgcgcgacacggggttcgacggcgtggcgctgaccaaggcgtgctgcggcgggaagtacaacttcgagatggagcagatcagctgggatggcgtggcgtccacctgactcagcgcgcgtacagcgtcatggccgagcttctctaccacaagggcttcgcgtctcctgcacccgtcaagttcccgcaccagtagatcgtctggtatttgcaagtagtgaaaataatgtaagctgtgacattttttgacgaagatgtaacccatgatttagtcatatcatgtattccttttttttttcaattggtacaaaaaatagcagtatcaattctttttcactgatttcaggacgcttctaatttggatttgccgatgcttcacgagggtgttacaaagttgcagccacccctattcctactttatttctaaactgatgtacagaacgtgtatttatgtactccgtggatacaatacaatgtgcctcagctacaacattgtttatggaggagtacatatatgaactacatgctacggcctactcctcaacaggaggatccacccaacggccatggtccttgattaactgaatcaaggcgtcagtggccccctccattgcaatgccccgttgcacgacggtctgcacccaaaacaagtagaacttgtgttaatggaaggaaaatggcagctctaagtttttgtttcagctcaaagagcatatatatgccatgcagttaacatccctactgttgattgtgtttgcatgatcatgtacaaatattgacttgcagctatgttcaacgatataccgtgatttccattattccatttgatatgattcaacttccacaagtataggaaaaggttaccttgccaacataaaggtcgatcttcccaggagcacctccaacgtatccgaaatcagcatcggccatctcccctggcccattgacaatgcaacccatgatagcaatctgccaggcaaatgtagacatgattagccatcaggctagctaatatgcgattgaaaacaagggaggcagaaggtctgtaagagagtttacagagacgcctggcagatgagaggtcttctctctaatctgagcactgacttcttggaggtcaaagagtgtccgcccacaagaaggacaagagacatattcctgcagcattaattaacggtcagaaatcgccaaaagaatgttctgcttcacaagagagaattgcctaaagttatttatcctcttcggtaggctataaggttcatttactgttaaaagtgcaattttgcacttcttcatgatatctcacgagttaaaggttgacgttgttcatgggatctacagtctaacagagaagaattcatcagcttaccgtttttgtgttgcgcatcctgcagccctgtaacaagttgaaggatgtgtccctcaaaaactcaaattcctggtcagcagcttcaagaagtacaccatcaccaagaccatcaactagaagagcaccaacatttgccccagcaccaataacaaggtcatctctgcatataatttaactcaaataagcacaagagaataaaggtacagtaatttcaaggggtaaggatgggcggtcaatgcatctcttaataagcacttcatagtacctgttcacgcttttggggaattctatgtgatggattacagggaagttcaaaccgttggtttctaagtactcaaataacctgcaaaacattattaaaaaaaataaaattttaggtaaagagaagtacagaacaatggaaaaccaggtggaaacattggtctgtatgtcagttttctgcagagtcaaatccattttcatttttcatgcttaatgtgtaacttagaattgactatcggttcatcccaacaaatggtaataatggagggagtggtattaactggcctactgtgttcacttacctcctagcagcgtgtactctgccagtcttctcttcaccataaggaacactgtgcagtaacattgttatatcatcaacacccttaagaagatctagctgttcatatgattcatctccacgaagggtgacagccaatctagtgcctacataaaaaaaagattcatcaataaaacagactaagcaaaatgttaaaatacagaaaatgacataaacacaattcacaaaacaacaaagatcattatcaaattcaaatgtctaccttctggcaaaagtttgtgtgcaccgcttgacagttcatccacattgacaagagcaattgcatgtgggagtggctttgtcagttgctctgataagggagtcaacacacccatgctgatgtcaactaatcttttgagtgcaagcctctgtaccattttacagatttcaacacaaaaattttaaaggaatagaatgttaatataagcttgtgatttgtgaaaagaacaaataatgttgaaggaactcacagcttgagcatcttctacaggtgggagctccttcaaaagaatagaatctacagttgccagatcctgatattcatagaaaaattaacatcagtttagactgaagtaccaataaagtttagttgtttgctagaatgtacagctataaggatcagaccttgaaaggcatgccaaccacaagctttgcagcaagagacctataaaggagctcaggagcctgaaaaataagagagccttccatcattacaaaatgcatcaattgatttgattcagatagaaaaaaatcaatgccttctttttgctattgctattctcactatgtactatgaactatgcatagaatgcatggaacatggctactgaaaatatcatgttgtagaattgtatattacaaaatagactattgtcttgaaatatattttggtaaagttacacaagatcaacacattgcacaaaagggtaacaaatatgtgagttaccttcaactgatccaaggaaactgacatcaaaacagagccatcacggtgcaagacccctctgtagtctacttcctcaccctgtcataagtgcaactaataagaaatctagcactattgtttttatgataactatggactataggagttattttgaactaacctccttttgtaaaggcaactgaccacttctacgctggaaatcaaaatagcgcctgtgcttttcttcaaaaggagcctgagaacatataatgtatataaatagaaattcttaaaagaacaaatagaacaaaacactactaaaaatagtcaaaattaatgtgtggcattggcagctaaacaagagaaaagtgtaaaactagagaaaggtaataaatcgttaccactcctatttgaaggtctgcggcatgtgtgccaagatttgccaatctccggcaaggatcaatctcttcttcaggtggttccgtgagggagacacggattgtatcgcccaagccatcctgtaagacaacaaaaggaagacataaggcatgcttaccctttgcagatggaaagatatgatatatgcaatataatacacaaagtaaaaatgcaattaccatcagaagtgttccaatgccaatggcagacttcatcctcccatcttcaccctctccagcttctgtaactcccaagtgcaaaggataatcccaccctaggttatacatttctgctacaagcaagcgatatgcttggaccatgataacagggttacttgctttcattgaaaacacaaagttatggaagtccagcttccgacagatcctggcaaattccaaagcagactcaacctgaaattatttgtagaacatgtcattcatctatcaaaacgatcattaattgaagacatccatgaaacgaaaagttatttgaatgaaatccccagaaaggaaataataccattccgcgtggagaatcaccatagtaactcattatgcggtcagacagacttccatgatttgttcctatacgcattgctcttccatactgcttgcatttctcaaccaacggggagaagacctgaaatgatatggaagtggctatgcaagtaaggaaacatactgcacattcttactgactaaattaacactaaagagtgagatatttggaaccttctcgatatgctcaagctctttttgataatcatcttcagtatattcaagctgctcaaattgggcacggcgatcagctgcaagtagagttctcagcatatgcacagagttgataagatattgacactaaaatgatacacatcattatttcactcaccaaaattccctgggttgacacgaattttgtcaaagcattcagccactcttaaagcaactgtcggggcaaaatgaatatcagccactagggggatgttgtaactgttgaaatgcaaaagcaagatgagaattcattcatgaaaactcactgaatctggaaaaatgatgactcttacttcttctgaacaagagtgttcttaatctcaaagcaggcatcagcttcctttctaccctggactgttattctaacaaaatcagcccctttatctgctatcctcataacctggaccagtgctatacttcgttatttcactagtcatgaaacatagaacatctaaaagaacacatgattaatgcatgcccagcattcaattattcaagcatagaattaaaaactaaaacatagaacttcaaataggagtgtacctcctctacggttttagcaacatccttggtatccgaggtggtcatagtctgaatcctaatgggatgatcactgccaagtggcacattcccaaccatcacagtgcgggtttttctcctccttgtctcatatatagattcacaatacttttgcctgggaactaaagaataacaaaagggcaaaagacatgctgtcagattctttacagaaaaaatgttcattcagttaaaagcactaagaacaactaacacgaatatacatgcaaggtgaacaacagccggcgagttatacctaaaagtgggcttccttctgaagatggctcgagctccatggtatcagaaccggtacttgagctcttggccacaagcaccctgcctcttgatgagcccacccttagagtagcaggaaccgacaagatcttagcaaagtcgacgctcctcgtgaagccgatgccaccatcacggaccctgacatgtgggagcggcgctggtgccactccggtggccatggctatctcgaagcaccaacttctgggttaggcaatcctacaaacaggtgcatggcaatggtagagatgagcacagggtcatctttgtgggttttaatggacagaaatggaatattcccttattgcttccagtccaacaacaggacaaccatggtgtgtagttattgaaaattaactatttcacaattcgtacaaaatactgacatatcaacaattagcaaatttaataactttactttgctaataataagagaggttggtaggacagcatgaagaaactgatgcttctactacaattccaaagaaaatcaaagtatagcaccaatcaataagcctggtcttttaaatagcatttccacttagaaattgaacatgcttgcagaaaattgagataaatattttttttaaaaaaaaaaaactgattcgtgtatccttccggctaagaacaaagggagaaataagatggcatgaactcttgatagctcaaaaaaaactaagaaaaattaagaaaaatccctcctaatccaaagataatgctctctaagttgatcaaatcccgaattttcgcagccaatctcaagagctctacagccctctgaatcataaaaacccaaaccttctaattcccaagcagaagcacgaattccagcagctcccccgcagcaattagcaccgacaacgccagctcccccgctagaattccagcaaataaaccaagcacgaattgcgcccaaccaaccaccacaggaggatccacccgatcggcgtccccccaacacacaaacacacacacatacacaaagctactagaaatctcaggaagtagagataaggctccccaacctcgtagctcccctccggcgaccgcgacgagatcagcagcggcgaggcgatgcgatgcggggatggagacagagtgcgagagctcgcgagctcggcgaagaggacgacgaactggcgagcgagtggtgggctttctaccggattagcccatttatccccagaggccggcgcccccgcaccgcgcggcgcgtcgtgtggactcggtgcacgagcaccgcgttgccgtgggcagtggctgcgtgtggggtccaagagatgaggtgttggtggaccgggtgcatgggaggggaaggctgacggcgtggggttggaggtgtggaagtggggttccgggctctccccgccatgatttaatcgtgcccgtcgttttcccatgcgcttcgtaattccattatcattttgttttgtttttattttattttttattagttcacgatggagagaggctgttttgttcgtttattatttctgccatttgtttttcgtggccggcatgggattgtattgtaccatgaaaaaaaaatagtttaatctggtgcgagagatggtgcttgagccagataaaattgtctgattgttccgtattgttactggctagaggagaaacttcacgaatattcatgggtcatcgaaggatgttttttccttgatttgttggataattcgaatattttattgagaaaacaaaaagataaatttggacttatttaagacccaaagttctttcacggcagctgaggtggtggaatgggactgtctaagaatctggtgatagtttttgtaggaaaaatattttgaacataacttatagtgtaagttgtatatagttatattataattgctatgtgaagtatattgtaattaaggtgtaattttagttttaattcaaaatcagctgataatgttatttttaaagtatttgtaatgataaaataaatgataattatattttgtaataagataaatcataaaacgtatgcccgaaagtcaagatgctaaacaacaaaaaccatagggagtgcagtactatttattgaagaaataaaaaggatattaacattctttagaaataaaagaaacttgatgttgtttaataaggggagaaaaggacatcatttagttcattacatttcaacatttcttccatgcatgtactttcgatgtttgatcgtgactttgacaaggagatcgatcttaattagctagtgcagcttgaaacaaagctacctgcccaaacatacacacacatcgtcgtcaaacctcatgttcaatgccaaaggggagtgtggtttgagcggctgacttgttgtggagcaaggcatccgcgcgcgacggccgccgaagaccataatcaccttctggtccggtggcatggtatgacgggtagatgacaatattgagacgatggccagttcagtcacaccacatgtgttgacctggagcaaagcagatggcacgtttccctgagacaaccgtctccatgtgggcggaagttctcccacacatgttttgggtcgtgggaactttgggagcgttgaaaggtaggcataaaaaccgtggtggaaattttcgacccatcaatctagtgttttcgtaacagttatactgttttcgtttctagttatatataaaatcgactcatgttgttttaattttctgttatgttgatgtcgtcattgaatagttatactgataaatacggaaaattcttgacgaaccagtaaccgtttccaatctttttacctcagataaatgtgcaacctcatgtgaatttaaatgcgtgctagccgggatgaaactggtttggatagtttccgtccgtccgaaccatttttcggattcggatagtttctgtcggaattatccaaaaattctcggattcggaaacgaatttggatattttttctcggaaacgaaaacgaatacagtaaggatactatccatcggaatcgaaaaacggttaaaaactatccgaaatttttttcggatatccgcagatattgagcaaattttataaaaaaacatgtatatatacataactttttcatacggaatcagatgaagacaaacttcatatcaacattatagagctcgatgagatctacaactttattattgactattttattatttaaggtcatttaagggtctaaatattcattataatataccatattaaattttacaaaatctcagatctacaattcaaacgacatctgatggagatgtgttccatatcaaagttgtagagctcaacgggatctaccactttgtagtttataacatttgtacttgaaagcatttaaagtataatacatacattacaagtttcgaagatgtgaagtaaaataaataacatctccaatttatgcaatggtaaataagttatacatctagtaaaaggtcttggaatagaaaatgataatcatatttgcatatggatctcttagaggaacaaccatgaaaatcgattttcacatacgattgtggaaccgtctataaaattgacgatataaatgttggagatatttaactaaaataataagcgatatctctttcttaatcaagaaactcaatttgaggggttttttatataccggtaaatattcgctactgtattcgttccatcttatattcgctccgtatctgtattcgataatattcaattttatttccgtatccgagttttcgatttcgaatccgattccgaaaaaaaaatgaaaacgaatatgataaagctagtttccatccgttttcgatccgttttcatcccttgtgctagggcatacttatgtgggtgtaggtatgacatatgtcttccccttcattctcgctaagctaggaatcattcttgttcccgatttccgtctcttgagcgcgagactcccacactagagaagagcgagcgggagggcggtgtcagatggcgtgatcttaaatcgagcgatctgatgaggtgcgggtagaggaatctaatttctgttgttaggggggcatttttttattctagggaattaaatttatgctgtctattgaaaataagtatatttttaatccttaaattctcattagagaatgaaaggcagatttaggaagagactttcaggcaactcttggccatgctcttagagtgtcaaatacaggaatgtataataatacttaaccaaacaatattattagagtctacagtaattatcctagactgtttaattaatcattttatagcaaaaatgaaaaagtcaattacccaactttctccgatccagtctatgaagtccaacaaacccaatacgacagcccaatgtattacagattgagttgggccgcaagcgcccataccaaaaacatactgtgaggttgtcagtgcacgacgcgaaggaagcagagaaaggtcagggcacatatggttgggaccgcctatgcatcactcgggtgagattttttcttccgaagagaaatcacgcgacaaacgtttagcaaaatcgcatatggttttatttataaatcaaaacggctcaaacttgagtagttttgatcagaaaaaacgcgcaagccatgcaacaccgcctcacgcgcgcgcgctgttcgtgaaatttatcggaggcgggtgcacgaggccacggcggaacagcagctcggccatgacgccgtacgcgcgctgcgtcaggtggacgccgtcccagctcacgtacctccccgggtccgcgcacgccgccgtccccggcgcgccgcacatcgcgcgcacgtcgaacccgtacgcgcccccgccgcccttgccgcagcacgccctgaacacgcgccgctcgtcgaagccgagcgccgctgccccgtccagcgtcgcggcgtacgcggcggagtagtccgcgtacgcgaccaccgcggcgccccggtacgcgcgccgcagctccccgacggcgcggcgcagccacgcgttgtgcagcgccgcgaagaggttgagcgcgacgaggcatccgcgggcgtcgtacgccgcccggtccgtcgcgttcaccgcgctcatgtagctcggcacgcaacccagcgggaggttgcccgggatcaccacccgcgtcgcgcccatgtcgagcacctcctgtgtcacaaaacccacaaaaattaatttagttcttaattaattactttgtagccaggattattattttaaaaataaggtcccaaaaattaatggaaaagaatggtgtgtaccttggctgcgctggctatggactgcacgacttccggtacaagatcgacggccgtggcaacgctttcgatcatgcgtgtgacgttgccgaggctgtatccaccgtccatcggccaggtctggaggaaggcgtagttgtagtcgtttcctccgatctctcccagcataaccagtgacttcgacagcttttcacggatctctgcaatgcaatgctcacacaaaagaacttttttctttcagaaaaaagtatatatatataacacaagatttctctatatgaaagtcattctagcactgaaaagctgtacattagcttaattatttgtgagatacagcattgctgactggcactgatcaggcaccggtcgaaattaagctgaaatgcgtttcagtttgttcgttcaccttgaggagaactagttgtggagttcatgaattccttgaaccatctgagctgcacgtatatatccggttgaagtagtacctcaaggtcttaggttcatatcctctatggatggattgtttacagggttaagttccctacttcaatagccgtatatatccggttggatgtagaggccgggtaaaaaatacccttctctaaaacaaaaaaaatctgagctgcacgtcgagggggctgttggtgtgggggacggtgatccgcctggcggcgagcgccgtcgtgttgagcgcggtggcgccggcgacggcgaagttgacgccgtgggcgaagtccgcgccctcgtcgaggtacgggttgagcagagggaggccaagatctctagctgcacatcgatcgatcatatccacaatttaatccgaaacaaaaacgcatatatatataacgtaatataatattgtttcttccatttttcagacggaagagagagagaaattaaactgatgacgtcaccgaggaagtcgatgatgaggtagccgtcggagcaccggccggtggcgcggccgacggtgacgccgtagggaagcctcgtggtgtaccggagcagcccgccggtggcgccttgcctggcgaggttgcggtgtccgacagcgagtcgccgaggtttgtagatggccgtaatgccgtcgactactaccgtacgtgtcgccgtggacgccgccgacgccgccggcgatgtcgtcggcggcgctgatccgaggcatgagccggcgaacaggagcactgtcacgagcggaacaagagccatggccgcgcgcgctaggttgccacagggtacaggtcgctactttgaattattttcccacgctaattaaagtaggctcgatgcgaaacgtggccggtttttttcgttacgaaactcagctcttccgtagggaaacctacgcgacagcattaatgcattaatcgagttgcttgcacgaatctccaagtgagggaggggttacgcgttaggcgctgccacgtgtatcgatcggcacgaatctccaggcagtcggcgagggttaag

SEQ ID NO: 70136 - DNA, 5006 bp, Oryza sativa
cctctatcgtcaccgccccttctcctcctcgccggagaagctcgcctcggatccctcctcctcctcgtcatcgttgtcggtgctcggcccccgcacaccgccgctcgccgccagccgcgccggccaccgctcgccgccgccgcctccgcgccgaggccactgccctcagccgctgcccccgcccttcccgaccatgagagagagaggaagagtgagaagagtgaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgaccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaagcccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgccaatggctatgcaaataagggcagcaatgggaaagtgcaactccaaatgatccctcactgatcaaaatgtcacatatctaatgctactaccatcgatgttgtgttctgactaatattagtgctggcatccttttttatttgtttatattttatctgaataagagatgacttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtgaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgtcaacgattgagaaacccctaagttgctgatatgctgcaatttataaatgccaaccttatggtcaatttttttaaaaaagaaaatttataggaaatgaacacttcccctatgtaaggttcgtatgtgtggcaatttggttatgcagccctctaaagttatggctgttaaagaaacagtttgctcatctatgctttcagtcttcaagtatgaaaaaataaaatgagaaaaatcataataatatgcttgtttatcacctgatacatcaaatcttcggtacccagttacatggcagagaatttccccaatacaacattttgcactcaaatactttctggctaactggaacttcctttagaagcaccaaagagaagacaagaatacattgcaaaattacattacagcaaattgcatgaatatgctgacctaccacacatgtttattccaatactatgattctataatcctaatttctagtcattcccgagataactctcagctcagctcctcgttgctgagggcatgataggggccatttccttcaacacaaacataattatccgcgttaacaaaatctctccttgttcgatttttttctgtttcctctatattctgtagtccatagttactttcatgtttgagcatgtggctcgttaggtctaatagtgggagaagtttttttggaattgtgacgggttcaaggacccgaaaaaaacataagtttgtttctgatttaaccaaagaacatcaacttgattttattgttttatctgagacggttaagaaggaattttctacatctgctctgaataatctttgtgttagtaaagattttttgtggcactgtaatctcctagaggcagatctggtggtcttctttaggaattaatcttctaaattttgacattggtttgattgatgagggggatttttaaatccaattttctttacggaattaggcttgatatttttaaatgggcttaagttttggtgatgggcccggcccagaatgagcttaaagatcaatcccttgaagaattagttaacatgtgcagtcatgagactataccaattcttattggtggtgattttaatattcttcgtagtcctaatgataagagtaataccaattatgatgatagatggccctttttgtttaatgctgttattgatgggttgtgccttagggagatacagttgtctggtaggaactttacttgggcaaataatctagcaaacccaacctatgagaaattggatagagtgttagtatcaacggaatgggagcaaaagtatcctttatcttctgttgttgctctaaacagagatttatcagatcacgttcctttgcttctaaatacaaaatcttcctcttttagtgacgctcaacattgttttcagtttgaacttggttggctgttacgtgatggttttgtggatatggtaaaggaggtttggtctgggttgatgaaggcaatactcctatggagcgttggcaggcaaaaattcgccgcttaagacaacatcttaggggctgggctaaacacactagtggtttatgcaaaaaagagaaaaagcagatcttaaataagttggatgcgctagataaaaaggctgagactgttgttttgtctcaagaggaggttgatcttagatggtttttaaggaataggttatctgcgatcttaagggaagaagaaattaaatggtatcagcgggctaagactaaggatattatggacggtgactctaatacaaagtattttcatttaatggcaaatggaaaacacaggaaaactaggatttatccaa

SEQ ID NO: 70137 - DNA, 7541 bp, Oryza sativa
attcctgcagccctgatgccgtggaggagggctgatctgcggtgggagaaagctcaacaagggtagagcgagggagggagggaggagtatagttggccataaggcccgagcccaatggcccggcccaaggcacaggattttggcccggtctaggcacggcatggcccgatcactgtcgggcccgtgccggcacaacccggctgttgggccgtgcctaggcctatgcctcggcacggtgggctggcccagcatggcacgaaattcagggatgtgaaatatacttattttcaaccatatgtaagacagggcacaaagaatagggaggacaattagacgtatcatatatatatatatatatatatatatatatatatatatatatatatatatgagggaggggaaatagacttatttcaataaaagcacgatgggccgtccgtgccttcggatcagcccggcacggcctgatccttattgggccatgcctgggccacaagtggagcacgtgggccagcacggcacagcccgccgtgtaggtcgggccgtgccggcccaacaaattttggctcgggcacgaccgggcctaggctgtgccgtgccgggcggcccatatggccaactatagggaggagtaggccggggaaggagggaggggctcgccgctcgccggttgtttctgctcctcgacaagcttatccaaagaggaaggaagaagaagagatagatggtcttactagtgggaccccatgttaacgtggcgttcaacagtaccaaaactagtctaatacctctttagggggtgaaatatccggtattgatagttaagaggtgtagtataaccggttttgtagttagggggtgtattttggacaatcataagagttcaggggggtaaaatggacttttccctttttatgcaaaaccaccttagagggttatataaatggtattgaaaagtttagggggggttgaacgtctgcttctcaagttcagcgtgctagacggatttccatatctaaagtttagtgtgggtatttggactttttttcctataaataacaatatctaaacttacattgttggggtttgttgtgtaccttccattaactataagcatctcgcgcacataatattcacgtactatggagcctaggggtttctcgaaacacttcaaaagaaaaataacaacgctaattagaatcaaattggtgtatatatgcatgaatttaaggtgtttatgtgttatgtcattacatgccagcctgttttaacttgcagcttttgtttttatcctatattgcccatcctttagacatgtacattctgtgtgcactgctcgaacaaagtaattgacatgttttacttacaaattttttatagtaagaaggtagagtggacgaatttacttacaaattcaaaattgtaaggaactctacaggtatctacataaaagtttggcatgtcacaatatgatcaagtattctgtcggatatatgttcgtaggtgggctatgtaacctccgtggactctctcggcctggttgggattttgacggaggtcgtcagcgaaaactgatttgcagtgtttggaaaaagatattccctcagctttacatgaatctcaacacagtatgatgttccaatattgtatatcagtatgtcacacaatattgtagtatatcagtatatcagtcttagtttggaatgtaaggggccttaataacagtggaaaaaggtccctcatagcgaatgttgtgtcttcctcccgtgcctccctctcttctgttgtcaagaatccaagctggcggttttagaccagcagctagttgctcaaacttgtggtgcatctcttgatggtttcgattttgtttttccagcgatggttcgaggggtggtgttttcacggcttggagaagtgatcgctttatggtctcttgcacccacaagggtcattggtcgctcaccctaagcatcaccaacctagaaggaggtggctgctggttattaacaaatgtctacgggccacaagacgctgctaacaagatccttttcttggatgaactgctcctggtcggccaacaattggtgactgggccgtggtgtgtcgtgggagatttcaacctgctgtcggctgattcggacaagaacaacagcaatgttaacaaaagattgattggcagatttcggaacatgatggactcgcttgaggttcaggaggtttatctctttgggaggcgatactcttggagcagtgagcaggaaaacccgacactcactaagattgataaagtgttggtgaatgctggctgggaggatttgtttcgtgatgctcacttgcaagctcttagttcttcggcctcatatcactctccgcttctgttggcctgcgacattatgatgcatcggccgcgaagatttaagtttgaatctttctagtctcggctggagttttacttaggttttgatgatttgttaaggaaacttgggagtcggtgcaaacaggttctgatgccatttgcactcttcatctgcggttgtgcgctactgcagctgccctcaggaaatggggggaacgtcgaatcagcaagctacgtctccagttggtggtggcctatgaaattatcttccagctcgacaaggcgcaagatgataggctgctcatgggcgaggagagggcattgcgggctactctgaaggggcgttgccttgccctggcatcgctcgagcggattcggctaaggaaacgctcacgcctattattcttgaggtatagcgggacatccgcccaattccatcaactaaaaattaatgcacgcaggtgtaagaaggcgatcgcctcgctttttcactagggtttctaggctacaactgaggaggacatgcttgaagtcacccatgatttcttcttcggcatcatgggctcgcctactcagaggtcagcagcaatcgacttcgcgcaggccggcatgcatgcttttgacctgttggaacttgaaacagacatctcagaggaggctagacagatcaattttgctatgccgagtgagaaagctctaggacccgatggttttagcggggttttttcaagagatgttgggaggtgatcaaggatgatgtggttgccgccatgaaacttacttggagagtgaatgcacgtcatctccacctcttgaacatggcctccattgtgctgctgccaaagaaggaagagccgactcattttggggagtatagaccgatcagccttatccatagctttgtcaaaaactcaaaatcctcacgaagatcatggcctctaggctatctgctagaatggatgagatcatcaggcaatctcagacggcatttatccggaaaagaagaatccatgagaactttctttatgtccaaggagcagtcaagcttttgcaccgtaccaaaaagccagctatgttgttgaagattgacattgccaaagcgtttgatatagtctgctgggatttccttcttgagctgatgcaatttctgggtttcggcaaccattggcaggactgtgtcgcatctctcttggctaccgtgtccatggtcgtttccatcaatggaagggtgatcctctttcgccactcctgttttgtcctggtgatggacactttcgcggcattgtgcaacactgttgttaccaagaacaccctctctcctctagccagcgcccagattccgctacgggcgtccttgtatgcggatgatgctattatcatcctccatccctccaggcaggatgtcgaagtgatccaattcattcttaagctcatgggcgaggcaacgggcctcatttccaacctcgccaagaactcctttacgccaatcaattgttccgagactaaaatcttggaggtaatagaggtgcttggatgtctggttaaggacctccccatcacctatctagggctccccatgtctactcgtaagctgtcaaaggcccagctgctgcttatgttggataggatggcgaagaatctagcaggctggaaatcatgcctgctctcaccggacgctcggctcgctctgatcaaacatgttctgatggctatcccactctatcttttatcggttttggaattacaggtgtgggcggttaaggcaatagagaaaaaatgttgcggcttttttgtggaaagaggatgaggatgcgtcgcggggggggatgcagccttgttgcttaggaaaaactcttcttgccaattgagaatggcggtctgggcattgtcaatcttggcagaatgggcattgcaatgtgaacacgttggctttggttgcagtgttcccaaccggagtggctgtgggcgtccttcgcgccggctcaagacaagaaagccgagcatttccttgctgcgggttgcaagatggtgttgggggacgggaacaacatcttcttctggacagacaactagctcccggatggaggttctattctgaactgggcgccaattttatgttcttacgtcaaaatcaggggaaggacagttcactcggcactgcaagaggatgcctggaacggcgacatcagggggggttatcgctccaagctatgatggaatatctccaagtctaggacctgatcaccgctgtcaccctgaaccctgctcagtcagacgtattctgttggaagcctgctacggatggtgttttctcggtgaaaacggcctactccctcctctgcgccgggaagacgtggtcggcggtcggcagattgatcttgaagtcccgcgcactgacccgctgcaaattcttcatgttcctcgccatgcgatgggcttgcttgacgacggacaacctccagcggcggggctggcatctcgcctcgttctgtcacctctgcgggaatgatgcggaaccctgcgcccacatcttccactcctgtgattacacgaagtcggtatgggcgcaggtcagaagttgccttggcatttcctgtgattctccttctagcgacatgctgagttggtggtgcgtggcacgtaaatcggttcacaagacggattggaagacattcgatgcgggagttatcctggtggtgtggttaatttggaaggaacgtaatgcgtgggtgtttgatggaaaggccacttcagcgatgcatctgtgtgcgaccatcgctgatgagtgggaagcatggaaggccacgggtttgttgtgcgccattgattgtggttagatagactagtcattttaggctctccctacggcggttggttggttgttgcctctaccgttcttggtagatggtattttgtaaaaacttctcttcttcttaatatacatctcggccggtttttgctggtccggcttaaaaaatatttgtagcatatatctgcatatcactgtactccaaatattgtgtgacgctattttacaacactgacttatttaacatatcagaaaacgtggtgtttagtgatatttgcaacacttaaaatttatagcattttttttcattcacagggatatgaagcaaccagtgcagtactttcccagtttctaacaatttatactggataagcaacagaacacgcgttgggcctcctgctatgccaacggggcgaaaatcattgaatgatgtttagggaagacctttgctaagattgtcagcatattagttgtgacgaggaagggacatgaagcacatgaacaaccacctagagccagacaatactgcatggaacgagggaaaaaaatgttcatgtgtggcattctctcaaatgacacgaggttggttgctttgttaaaatgtcagaaaattcactattcaatttgccaatactaataccatcattgaggattgatccctaatgacggttggagggtattaccgacctttccaaccatcataaccgtcatactcaaagctataaaagaagctcctctaattccatttcacacacacttcaagcaaagctctctcatattctctcaagtttaggaataaattctctttctgttatctttccacttagcttagatgtattagtatgagaatgagtagcttactacttgtgtgtcactctaccctttgatttattgacttagactatgattattacaactaacaaataaattattagtacggttctctctactatgatcttcccacgggattaaataaatacgatacccttggaatactctcgggtgaaatgctacaatggtatatccgtgcgcttgcggatgaactctgtaaccataatataccaagagtatttatgcgtcattgctgggaattatatttctagtaatatcgttaagaaataccaacaagcatttctggcgccattaccggggaagatttataatagagattaccaatactaatactttatttttacctctgtataatcactgtcctttgcaggctaaccttggttgttttcacttttgttgtggaaacagggtagtgcatgactagtttcaacttgcgaacgatcaagtttttagagagcgtctcggcgcgactgctcctgttcttctacgacaacgctgcttcctctacttctgcttcaccatggcttctactggagagaacgggaacgaaggagacaacatgaacgggggcaatacgaatgcctcaacatcttctgggtataagattttaactttacttgattttcttctttttatttatgtgttcacaatattatccataggattacaatcctatgtgaatatcgattatgtttatgcttatgttatcaaaagcatgctcatgtttatgtttagcatgtttatgtttagcatcttcactagatcgcttcttattgtgtatgtcatgtttattatcttaatattttggattaaaatatgtcgaattatgaccatattttcaacatatgcagggtcattaagttttttatcctagaattttcatgactatttgcaccataacgcgtgccgaatatttttaggcacatcattaccattactttggacttttaaataaaacattatccttctcgaattcccaatcccagctacataatccctccatcctaaaaaaacgaatttaggtttacatgtgacacattatagtaaacgaatctgaacagagatatgttcagattcgtagtactaggatatgtcacatttagtaataggttgattttttatgggatggaaggagtatatcagtgtactccaaatattgtgtgacggtattttacaacactgacttatttagcatatcacaaaacacgatttttagtgacatttgtaacacttaaaatttatagtagcattttttttcattcacagggatatgaagcaaccagtgtagtactttcccaatttctactaacaacttatactggataagcaacagaacgcacgttgggcctctgctatttcaaccgggaggtctgcggatgttgagactagagcgaaaatcaaaatcgtttaacaaggtttagggaagacctttagtcgtttaacaaggtttagggaagacctttggtgaaattgtcagcatattagttgtgacgaggaaaggacatggagcagggctgcaggaat

SEQ ID NO: 70138 - DNA, 663 bp, Oryza sativa
aaaactacacctttggttttagtatacttctttttcatgcatgtcttttaatttgatggatttgtgtgggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatggctctggtcacaaatgtgtgcgaatatgaagaacttgcaaagcacaaactgccaaagatggtttatgatttctatgctgttgacgcagaagaccaatggactctcagggagaacagtgaggcattctccagaattttgtaagttgtgctctaaattggtagggaatatctgaaaatggagatagggaggtcctgattttgtgttatattcatagaagttattgttaggatgtagcttttagttattttcatttgacattgtgttttgattttgaaataaaatatattacccattacttcgtctttcaaagtatattatggtg

SEQ ID NO: 70139 - DNA, 5691 bp, Oryza sativa
cgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctcttgcaccccgcacacccacccatacactttagctggacctttggccgctctaccctctatcaaagtaggaaataacagcagcaacaacagctcacaggcgtaaaagcttacacacctcctcctactcctcttccacgcgcgtcagtgggccgcgctgcaccgcgcattgcttcacctctgcacacctgaaaccgaaaaactcaatttggagtgaagcacggagagagagagagagagagagagaggagagaggtgtcttggacggaagtttttgaaaaaaaatttccccaacctcgtgggcacgatgccgtcatgatccccccttacgcctcgctgcccaaaaaatttcaatatctcgcccacattaatcaccttcctcacgaggccaacgagcacaaatcccatttcatcatcattcataccaatgctctcggattcttccacgtccccggattcagtttcctgctcctctccccccctctggatccctacttctcttcccctcgttccagcgcgctcgccgtcgcccgccggcgtccggcgaccatggaagcagctggagtggaggtgaacggacgaggaggaggcgacgtcgtggtggtggtgccccagcagcatgaggtggcggcgaaccaagcggcgatggcggcggaggcaaacgggaagcccgtcgaatccaacggggtccgcgtcgtcggcggacggatctatgatccggagaacggaaagacctgccaccaggtaacccctcctcctactcccacctacctgcctgactaccatgtgttcgacaccgtgtctagccggtgtcctatgaggagtggtgcgtccctgttcttcctccccggtggttgggtcgggttggatctgaggaattcttgctcgcccccccttgcttttgcggggaattcttgctcacccttgggtggagcggttgctctgtttcttgctccctcgcagtgccgtcagaagacgatggacttcgccgcgtcatgccacaagatcaagaagaacaacaagcagtgcacgatccagtactgccgcaagtgtctctttaacaggtgaggggggaatttcttctcgtcttctttcttagcttcaggaggcagagcaaggctggctgaccatgtgatttctgagtgattcgtggcgcaggtacggccaggaagccgagaaggtggccaatgacggcacctggacttgccccaagtgcaaggatatctgcaattgcagcttctgcatgtgagctgaccaaacctgatgctctaccggtcatgctgattatctgtggctcgcgttttgttgtcagaagtgatggatggactttgatttgtttggcaggaagaagaaggggctgccgcccaccggaatacttgcccatgctgctaaggcttcaggttgtgcttcggtccatcatttactgaaaaaggggaaagaagcggtggctgccgcgcagaggagcacccagaaagtgagatctacacctgtgaaggtgtgtggtgttcaggattggcacgatcctttgtcacattacaattcgctgttgcatggtacgattgttcactatgtttgatatgttttgctgatcctttttttatgaacaagcagaagagcccaaagagggccatacagccagatgctgctgctgatgaacctttggctgaaggggatgagaatgtatgcattgatttcaatgctgctccagtgaagaagcagaagagaagcaggaaggtgggtaatggtgtggctctgacgaacgatgaaagccctgatgctcccaaggaacaagttgttctgcccaagggcactccagtcactagtgttgccggtgcaaagtgggagcctgaagatgttggtcttgcacttcagttcttcgaattctgccgcacatttgctgaggtagttacgaaagaaagatcaaggatatttaatagtatgattgcacatgccttgtcagagtaatatcttactagcatttgcaagagaataatagatcgagttttttttttctatttacatgtctgatgcatgttatgttttggtatgaagtatgacaatgtaaaaaatgcttttactggtaagcaccgaagtgttgatattagagcttcctacaagtttggaatcatatctatgtgtttatgtaggtaaggcatgcaatgccatgatgggatacaaatcataaagggaataggtattcggattagaatttggagagggagatggtggggtgaccgggtgacagcaaatgggcaaaaggaaatatatgactacctgttgagttcattgtacgcattaaatggatgcgatttctctgcgtgcaacatgctaacacctagatacaggctatctgttaattgccctttaatgtgtacaatattcgagttcctatttgtaattatgaggtttcttttttattgcatggcacttcttgtccatatgatatacatgttaacattgataaactggtcgaaaccttccaattatatttcttggtttgtaatttaagccatgtagtagctttcatataacccaaattaaatgttattatgttctgtcgaatttttttatttgtgataggctgcgtgttcaactgaactaccaaagctatgttttaaagttttttttttaaggaaactaccaaagttatgtttcatcctatacaatatctcttgcaaaaggtatgtataaagctccattgttttacacatagtttgagcaaagttcaaacttctgagcaaaacaactatctattccatctgttccaaaatataagcatttctgactatttacctgaacggaaatgcttatattttggaacgagggagtaagtgatagcgaagcttattcttttctgtgcgagtttataatttatttcttctgttatagaccaaacatccaagtccttaaggcataattttggtaaccagcaaaacattgtaacagttgttttattaggcgatgtgatagttatcttaatcttttatgtttatttctaacaagtgtcatggaacaattagtgtaaaatttttgcaactaccgtgagtcctgttccattacaattgttgcatcatacttcctccgtttcataatgtaagactttctagcattgtctacattcatatagatgttaatgaatctagacatatatgtgtgtttagattcattaacatctatatgaatgtggacaaacctagaaagtcttacattatgaaacggagggagtaacttcttagtgttttttagagttttccttttgaattcgggcttaggatcgctttgcgttataatctgaagtatttagtcattgccgcaagtgatcgctgcgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcact

SEQ ID NO: 70140 - DNA, 692 bp, Oryza sativa
atcaagacaataattagtcgtaaatgcaaacacatgtgttgactctagaacttaattcggatggattaatttgaccataagaaaccaaactagttgaattacgccgtaatacagataaatcctaatagatctattttagaagatgataagttcataaataatatccaaattcggcatggttcacattaaaattagaaattatagacgaggaaggaaaccaatctgctgccgtgttacacggtaaccgcagtttgcaaccgtcaataggagaccctatccactacgaaatccgttggatccctcgtgctccgcaatctcagccgtccgtttccccctatagtcccccttacctccccttctacagttctacgaagtacgatccaaacaccagcggcgaaggcgacgaagacgagggcaaaaacaccagaaggggaaaacttttgctctcccggcgatctcgagatctctcaagatggtaatcccccatccaatttctctctacttttcctcggatttgcgccgcactcccgatcgatgtcttcgacgcggttaactgcgatggatttgcgcgagatcggatctatggtctagaatttcgagtcgattaggcttttttttgggtggtgttttgcgttgggtgatttcagattggaagtagaacggggggacgaggattctggggctgcaggaat

SEQ ID NO: 70141 - DNA, 2208 bp, Oryza sativa
ttgttcaagattttattcctgtccaaaaaaaaggcaaaagaaggctactaatgaacattgtgaaactagcattattcctgttcctagtgaatcttcagcccaaaatccttgcttagctccaactatgtcatacccaccaaccaaaagctgccaaagtgggaaaaaaaggacatactattacttcatcagattcaattaggtattttggttttcagatttcattttcactgatcattttgttttttagttacattttcctttcaaagattattgtcttacatttatgtgaatcttcagatcaagatcagtgacaggatccaaccaaccggaacctttgagtgtgctgatgccactaccagcactagcacctgacaagtgcaaggccaaggccaaacccaagacaaagactaaagccaaggtagccactaagaaaaacaaggaagatagcactgatgctacacctttggctcaaatcaagcgaaaaaaagttgttcccgtgactccagatagtccagcaatggggacaagaagcaaaaagaagaaatctctagattttaatttatactaagcatgtgttgaattattttggtactgtaatatttggaagttagcttggtactgtaatatcttggagtactgctctagttaatttgcatgttaggactgtgttagtatgcactgtgatgagtgctgatgcactataatgtattttggtaccgtcaatatgtattttggtgttgtgaggtcatttgaacctttatgacatgaccatgtaatattttagagaccttggtatactgcatgtccaagcttttgttggagaactacttgtttaattcatgtctttgtgaaaaatatatgctatggtagtggtagaaatgttgtatatacaatattcatataatcaatataatgctgaaaattattcatataatcaatataatgctgaaatgttgtatatacatgtacatgtcaaccaaattaaaaaaaaatgccaagtaatggtactgcctgcctaacaactcaggggtaaattcgtcttttcactatcaagttaacagtcaacacacagtcaactcacgtgagtggcatgagagggtgctcaaatttgacccaatggcatataagggaagagccaattttgtgtggcatatcagggatcagaccaaatttcaatggcatataagggattctctctttatataatgcctgatatttcatatgctcgttatatcctgataatactagaagatccatgtagttttttgaatacatactcgatattatcttctatatgtcttgccttctagaaaatatttttcaggaacaattgagcactcgagtaggttgtggtcgagtacacccattatcgagaacattctcgacaaatgcggagttgtcgcacccaacctaccaacgaagaccgacgacctatctcatagcgccgaccatggctgggctattcgagaaaaggttgttaacggataaattctcgtgaacgttgtcggcttgatcacccgatatgattgcgagcggatatccggatatgctataagttgggtatgtgagtcatgctggccacatgaggtgcacatgtaacaaaccaactttagcacccctataggtgattgagaggctcctactcctggttctcgaaccagtaggacgtagcgatctctcgcgccttaacttctgatggtcgaggtatgactacggcaatagcgtagcggtcctcgcaccacgagttcagatgacttcagatggttgaggaacagctatgactgatcttcgacagacagcatagcggtcctcgtaccacgactccaaatggtcgagagacacctactcactagttctcaaccagtcaatcgtagcgatctctcgtacaattacttctagtggtcgagttatgactactacctagtcctcgaccaatggtgtagcaattctcccactatttccactttaagtggtcgagttacgactactacctggtcctcgactagcggtgtagcgattctcccattattttcactttaagtggtcgagttacgactactacctggtcctcgaccagcggtgtagcgattctcccactatttccactttaagtggtcgagttacgactactacctggtcctcgaccagcggtgtagcgattctcccactatttccactttaagtggtcgagttacgactactacctgg

SEQ ID NO: 70142 - DNA, 1451 bp, Oryza sativa
actgagtattcggttaaaaataaaaaattatagtgtgaatcacatcatcaccccactctctttccccttattctctcccttactcctctctttccctttcaacatcgtcgtcatctaaggcggctcttgttgtacacaagatggttgggacgggggcagcagcggcaacatcttagacaatggtgtagtcagaggcggctgcaacaatagtgcggccaccaacggggtggactagtcggtttgtggctaatctaggctgggaagggagagggagagggagagcaaggtcatcagaggagcaggaggcgctgcagtggcggaggagaaggaacaacgaccccgcgggcccttgtgatcaagtggtagacatgatgaggagggagatggtggtgtggtggcgaggacgacatgttggaggggaagctgtggtggctggagtcgctaaggtcggagccagaggggctgccaagggcattggtggcagataacgaaaaggtggtcgttgctgcttgtttgcttgagcgggcggcccagaagcaagtcgtcggcagtggcggaatcgttgtctagcggcgcgaggagtgcatcggatgaggtgtggtacttgcacttgagggtggagttatggtggttcttgatggcattgttggtgcggatgacgaggagcctaacgatggtggcccacttgtttgccgaagcaagcgtgggcgaggaggatggtatcatcctcctcgggcatgatggggtggtgctctacccacagtgacaactggttgcacaccagaggcgccacgacttgctggacctccccgggatggacttctaatgagcgaccagtcgcgcgccttctgcttcaccacctgccgctgcagcacctcgtccttccttgggttccatcatgatgatgaaagggagagaaagaaggaagggagtgaagaagggaaagagagggtcatgatgtgggtcccaccgaactcactgacatgtgggtcccatctaactttaagtgccacgtcagtcgaaaacgtcatccaaacagtcttgggatcttatttgcactgattgggagttgaggtatgcgttatatctggtattgcggtttaggatgaatttcagacttgacgacatagtgacagatataacatgtctgcaataagttcactttaggttccttatagacttcaaattgtatccttgaactgcaatactagatgtaacatgtctctcaacttataatatcggagtacccgagatcccagagtagcattatgtctaattttggctgatatgatgagttgactgcagtcaactcgacaagtcattgtgggacctacatggaccctacatgtcaatcacatgaaaaatataaaaagaagaatagaaaatccatgaaatgccattgacaaacaccctaatcgaagaaatgccatcgacgaacgcgacttccagga

SEQ ID NO: 70143 - DNA, 1573 bp, Oryza sativa
gttacttgttcatacacaaatccaccaaacacaagagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcagtctccctagttctacttggacaaggggacatctatgggtataaatacaagaccccctagaaggagggaggacacggaacaatagatcaaggcacaagatcaacatacaagccaatatacgccaagacacgccgccggatattgacttcagaaataagcatggctagtcccctacggtgtctatggatactgtcaggagagacatagcgctgtctttgatctcgccggatacggattcaaggaggaaggctaccctgttgtcgactacgagtcagcacttcagaccgccaagtcgacaacagttagataggctaccccaaatattgtactggtgtgattatggtgaataaaagcaacgaccggcttcggccaataggagtagggttattactctgacaatttaggggcccgaacctgtataaaaatcctcgtctccatcttttttactacaatctcgtatatattctagtatcaacgatccccatactatgtaaataccggaatcgcgacatcaaacatccacagtcgtcgtcagatttttcatgttcttcccatcagggggtcatccacgagaaaggcaaccagctagctccggtgaagaaccctccctccctcccccttcgcatcgacaaaaaggaggcagctagcgagcatcctcccctatccgagatcattgccggagccagaaaggccatatccctggtgcttcctccctcccccatcaccatacccttggcatggagctcggctcgctggatccaccggcctatgattcatgctatcctggaccttgccggtcccaccgcctccgaataaggtaggaacccgttcccggactgcattgcctcggcccgcttgaggatcagacgatgaccatgctcgatgtgtggtgccgcagtccaccatgatccgaacatcgacaccgctaatgtgtcccagagctcgctaatgaggagaataagggaaaaaaagaaggaataagatgaaaaatttgatgacgattgcatggttttaattttgcaaaaatttaaatggcacctaaccgatatcgtgaacagtagtgtcatttttttcaaattggtaaatttggaatggcatgatccaattaacaattttttaatatatgacttttgtacatacatttgattatccatctttttttatttgatttgttattaatattttttttaatcataacatatactttttatgtttgcagaaaaattttgaataagacaaatgatacaaacatttatcaaaatgtccacgacatcatatattgaaaactagaggtattatattataatattagcgtataaattgtgaaataaacgacatgtgtattcagtttttaacgc

SEQ ID NO: 70144 - DNA, 7434 bp, Oryza sativa
tcatttgctttgaatgttaatcgctgttactatctagttattcatttgaacctgcaatttatagtcttttagcaactaatagtattgcatacacatggatgattgccatgcctcatgaaaagcttgtgcactcatctacatatagtttcttgcacttaatatgtaataactagcctatagagtcgttcttttgtgtggctataacctccctctttattgaatatgcttacatgtttgcagcaattagcttaaatttgcaataacaaaacaacgcaaatatacaattatagaacatacttgtcaggaagtgtaactacaacgttaacaaatttatcttgatttgtaattaacagtattatcaggacaactaataatttatcgtgcttttgcgtgactatcacctccatctttgttaatttttaaatgtgtgatttctagtaatattgtaaataggtttataaagcaaatatgtggtacgaagtgtagttacaatttaggcaaattttgctacaggacattgcaactttgtgattatagctgtagaacaccgcacgtactcacttttggggaaaaacactctctaagtgtgtttatttgccagtggacaccatggccattaaaataatatatttgtgccgacatggcgattggggcccaaaaattttacacggagtgaccaaactacccctggcgataggggccccatctgtcaggcttatcttctacctctggtcggggcagagtcggagtcgtcgccgcttgaccgccaaatccggctgctccttttgctctcgagtaaaattagttgaggggaagtcctccctttatcctcctcaaccgtttccagcaagaccatgacgaggaggcggaggaggtggagcacggcgacatctagtgccacggccgcaggaatatgccgtgggcgccgccggaccacccgcgcctcctagagttagaggaggcaccgctggtatgcacagcttcaaatcagccccaaatacagcagctccaagccctacccagcgcacaagccacggtagcaaagcgagcagcggcactgagggcgtcggcgaggggagcagcagtagcgatggagcaagcaggttctcgatgattgacggagcgagcaacggctacagtggagctggtcgcagagtgccggcgggacgtcggcgaagcaagtgaaaggtggcggaggcgagctcctcgcggcggaggcaagcatatgtcgcaaagcagattcgacagcgacgatgaggtgttggagatggcagcgagctccatcgtcatttctttttctttttctttttcctctgtgatttttttctgcaggatgaaagacttgatcgaatctgattttttttcaatcctgtggatcaattatcgtggatcaaatctgatatttgatttgaatatagctagcttagagagagaaacagacaggaagagagaagatgttcttgggtagctgtagagagaggaagggaagaagctgctgccaaacatcacctgaacgcgcaggggcagtttggtcactccgcgtaaacttttgggtcccctattgcctcgtcagcacgaatacattattataatggacgcggtgtccactggcaaataaccacatttagagagtgtttttccctaaaagtaagtttgtgcggtgtcctatagctaaaaccataaaatcgtgatgtcctgtagcaaaatttgcctacaatttattgttctgaaataaacaatactatcctaataacaaacaattaaccatgattatgctacattcgtcactctagtcacgtcttcgtgagacctcgagtagctgccggcaatcgctttatcttctaacattacacctttgttctttgtgtccactaccttgagcattttgcttaacccaacaatctcttcttgaaagacactcaactatcacctcaaagcatataggtagatgaaacactcaaagccaacttgttcgttacataaaattatttgagatgaaaggatttacagttccaagggtgtcctgtaattaaaatgtaaatcagtcaacagtcaaaaggttcatatctcttcaataattatagaaactaaaactatgcaaaatggcaagtaacttcatgagcattaaacgttgtagatatcttgtaggatcatttgcattgtcagatctctttagtcctggatcacattcaaaacaatgtaactctagggggaaaaaaggtaggatgctgagcaatatgaaattttcacttgaaaaaacagattatattgtacatgtgacagtattcatatattggtactataataataagataagataatagaggcttaaataaaccgtcaattgtaaaggagctgacagcacggacatgttttaaacccaacaggtgggatgagccaggtgcggttcatgccataggagcaaatgagtgatgacacataggagagcctggcatacaacgtaagtactccctcgatccaaatgtgttagacctattacttttgtcaccaagaccaaggagaaattaactcatgctgcatataacaaagaaaaatgagtgtataatacagcctatttagtgatgagaaggcagggagctagctagctacctttggtttgaatgactcagcctatttaccgctctctttgactggtcaagctattggaaatgaaacatgtctttagattgagcagagaactctatgcattcgaagctctcctagaaattaaatagacacctcatgttgaaatgggagcatatatgagttgagcttctgagtgatgagaagtattaatcctatagtggttatgcacaagaaaatttcttttaggagtgtgcattgctttttttgacaagatgtagatgttttaacagccggttttcagttttaagattctttaattccatctgatgttcttactttgtcttgcaggtgactgaacgtagcgtttacttgacggtgtttaggagaacctagtcatgcctggtgtttctttccaggtgattaaaacggaaatgaaattgtcaatatcatatcagtaggggtggctgattgctagtctgtaaatcgactcttctctgggtcaatctcgtatgctcatgtcggcaatgtatgccacgattctataaaacttgatattgaacttctgtttcctacagctgcaatgcccaaagttcatcgcaaattcttggcgagagaaggaaagctaaaaatctgttcggttgtagttccatataaccttagccggaagaggaccctctgactttcttccttctgactttgagtcactgatacgtgagtttattgggtagagggtccacatatcaatgatataagttaaatataagtaggttagagcatctctaacagtctatccaaatttgactgtccaaatgtctatttggccaactctccatttaatttagcaagtcaaattgtcttttactccaacagccactctattcgtcctctatattttgagtttattacaattgggctcacatgtcagtctctacacctccttctccctcatctttctcccattctctccaaaccccccttccctctctcatctgccgccgccgccccatccccatccccaccgccgctcgggctgtgtccccatccgccgccgccgctgctcaggctccacccgtcggtgccgctcttggcggcaaatccgtgcgcacgcaaggcaggctcgaggcgacggcgagggaaggccacaatggcggcgctagggcggctgacactgggaggacgacggcggcggcgctgtgagggcgacaacgacgacggagccgggaggacgacgacgtcggcactgggcagatggtggggcaggcagggagggagctctcttcgccggcacagggagggagctctcttcgccggcggaggggtggcgcggatgggcggcgtcggcggagagaatgctacgggcggcactggatttgggaggaggagagaggctacaggagggagagagaatagaggtggggcccacgatttagccagcgcgagcgactttggccagccaggctgttggagtgcaaatttgagccaaaattgctataatataacttggaaagtgggataaggaggctgttaaagatgctcttagcggatctcaatctaccttagcagattgggaaagaaccaccactccaccagtaggcagtagcagaagaattatctgcgagtttgttttctacaagaagaataaacaaaacctgcagggcggcgatggtttatcttctcttctctgcatagaagggagtggttcccccacccacgtaactgctactagaaaattgatcgttcgccctgtccttccagggaaaaaaaacgaacagtttctctagaaaaaccagccaatgttttttagaaactactccctctgtttcacaatgtaagtcattctaacattttctatattcataataataataatgttaatgaatatatatatatatatatatatatatatatatagattcattaacatcaatataaatacattgtgaaacggagagagtaaaaactaactgcctacttaaaaacacggcaaaccggtttgtttttataccattagatgacatgggtaatttgctagttactgaagaagtattactactgcatgaaaactatcgtgcatcgtatggtacaaatgcaaacttaaacatagtagactagccaacttgagggtttgtttgtcacaactctagttttagctccatctcttagagcatctccaacagcttctctaaaatagactctccaaacatccatatagccagctacccatttgatttagcaagttaaagttgttgctcgcttcaacagcctccctatctaccctctccattacaagtctataaccaatgggacccatatgtcagtctctataaccttcttcctcctcttccaccccattttccccactcatacataaaccttcctcctcctactggacttgcctctgatgctgcggcgacgggtgtgcgggacgggcttcagcgagcagcggcgaggcgacaggcagcggcgagcggaggccgcggttgcaacgagcagaggcggcgcgctgcgccaagcggatgccggcggctgcggcgagcggcggggggggggggggggggggggcacccctagcggaggccgcggttgcgacgagcggaggcggcgcgctatgccgagcggatgccgacggctgcggcgagcggcggggcgggccacgccgagcggaggccgcggttgcgacctgcagaggcggccgaatgaagacttctccttctcatcaccgtcccagcagttccaccactcgcacggcgtgccgatgcagcagcagcagcgagcgtcgtccacgcctatggggacgccgccgacgccgccgctgtcgacttcgtccaccgcggcgggcgctgggcacgacctgttcgaggcggcggagggcagtgctaaagagagagagagtgaggctactcggagggacggcggtgctgcaacggatggcaacgctgctactcctcgccgttgcatcggaagaggtagcggggagagcatttggccagccttggggatgtggttgtggctggctagatttagctagttggggggagtgtttggctaaccatatagcttagccagtgggatggagatgctgttggaggctattttttctctgctatggctaaaatttggcttggagagtcacttacccattctcttggagatgctcttataaaggagactagctagcttcactcagttgagctgggtgcctgggtaaagctctcacaaaatgaactaaagaggtggagctagatttaggctgctccactacttcactctagatttaacttttgaaactaaatttagaagttgtaactctaataaataggtattttaagaaccagttggtcagtagtcagcttctgagaatatgaaaaagctgaattttctaccttctgagtttctagttcattttataggttctaagaatcggaacgataggttgaactgtttaaaaaaacttctaattctggtgaaaaatctcccttagggcacccgcaatggttatctataagctttctataaaagatccatgtcagcatattttcctacttggaagagattaaatgaaaagagagagagtaaaactatctactaacttggagatagtctatagataaaaagaggcaattgatgagagagctatagatacctatgtagacatactattgaggtggtttactattaatcagtctattgctgagatgtacatgttttataaagagcacattactttaccgttgcgggtgctcttgcgcggccctcgaattcgcaattcgctcggcaggatttcaacattgcggcctactgcttctgcagcccatgatccacacacacactccacagcccacagcccactccatcctctctcccccaattccccatccgctgctcatcagtcgcacgtaccacaccagcatcctcgcacggtcgcgacccctcccgcacctcaccaggtagagagagagacgacggcggtggtggcgggatgttcctgcggcggatcctgagcggcgggggaggggtggcggcgctgcgggcggcgcgcgccgtgaaggagacgacggggatcgtggggctggaggtggtgcccaacgcgcgggaggtgctcgtcggcctctacacccgcaccctcaaggagatcgaggccgtccccaaggacgagggctaccgcaaggccgtcgagtccttcacccgccaccgcctccagatctgccaggaggaggacgactggaagcgcatcgaggaccgcatcggctgcggccaggtcgaggagctcatcgaggaggcccaggacgagctcaagctcatcgccaagatgatcggtccgcatttctccccctcccctacgccccatctccattcctgtcgcttatttagttacttcttgtattaattccttattcctcctactgatctgtcgacaagaatcagggtagttgatgtgtagatgtggccactggctacccatttctttgattcaaccagttatttgatccgatatacaactgatccgtggacaataacatcgtagcgattggtatttgattttcttttggctccctttaatagcactggtagggcaaattatcagcgttgacagtatggtgtttgccagtttgttgattggggagggggggggatggaatgctttttaggttgtctgctgtgctgcctattagtaaaatgccttaattatttttcagcgcttatttaaggatcatggatgttccattttaccttttggtcactaacctaagattttttgtgaactgactggtgcttgtaacttaaccagagtgtgttcattgccatattcaccatactgttgctttgtgtatgtctggtggagtgcca

SEQ ID NO: 70145 - DNA, 4097 bp, Oryza sativa
aacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtgacctctacgagaagattgtgaaggaggcttgatattagttgtctgtgatgccccagtaataattaggaaaaagaaaaaagagaggaagaaaaaaaaagcaagcagcaaatataatggacgcatagagcaaagctagctagcgtgcagcactagtctggttggcctttgggccttgaccggcccacgcgaggagtagcggtgctatcaacgtatcaggctagcagcaacaggcagccagcaaagcgcaacaagctagctggtcccacatctctagtgaagcttgagatataatactagcttacttatatattaacatcaaaattgaaacttttttaaagcgaggataaaagcacatagtgttacattgtaagtgtgttaacagtgaaatttggtaagcccctaaaagaattatcacatcaccaatagtcagattcctgctatatttggttaagaaaattaatctatcaaagaaagcttatccagaagtgacagagttcaagaaggatgcggcatgacaagttatctattaattagaaataatttattagttttcttttcatctttaggaaagtgtatttaatgtcctataaggacttatatgttttccttttatctttaggaaagtttctttattgtcctacaagtactagtatgtccccataggtataaatatgtacacatggggtcattgtaagagatctccacgatcaatacaattcgggccatcgtcaccttttaccttttctattttattttatcgtccgacgggatttggcacctaacgcggggctgcatcgcttttcgatctccggcgaaggggtaggtcaaatgttccgccggcctagacaattatatcgtctacgttggcgtcgttcaaggctgcatcaatacattcgacctcttggattgctcaggtttggatgatatatttgtctgcctttttatcatatgtcttagttaatctattcttagtatatcaatttagctctatcggttgtctctcgctttagggtttctgccggtatcggctaaattgttttactagattagattagataaggcatctaccaccttaaaaattaattagtcaagggcttgattgtctagatattatgtttcttttcatacttagtgctgcatcagttaagtttgatctactaaaccgtgtttagaaccataatctctagcctgcttcttgactgctaataagggtttcatcggggtttcagccaatgaggtatctagatgttgcatcggcttacaagcattacatacaagttggatttagctaattgcaacaaaggtttcactgtttatccaatcttgtggattttatgacatcagacctctagccgatgtatgctttaatcttcggatcagtgcttattctatcatatcatttctagccgactggtttctactggattatattgtttaattatattgattatcggccgattgtctttatatcattatatacattggacgtatagccgattactcgaaaccctatcgctatcggctggtatcggtatcggctagaactattccatcggcttgtcaaccgatcagctgttttatctattgtttatatatcttgtcggttgcaggatcaaactgactggcacgctcgcatatcatcaagatttggacctgcactggagctaagcagatctcccaggtcagtgtgtatttttagcatcaatagtatggtccaacaaattgagttgcgcctaaatccgcctttagaccctaggcatcacaaccaccttcagctgaaggaataaccgtcctagtgatcgagccttatatgaacaacttcaggtttggcttccaccttacccattccttaactaggggatttggaggtttgacggtttgatcggtgaggttgggctcttgtgtaaaccatttggaaaccggctcccaccttaccgtgagttcttcctgctgtgtagttgaacatccaaaaccctcggtacgcattcactctgtttcgtatattcaatctattcatgttttacgtactgtctagttttagtttacatgtatagattgtatgatacgattatgctagtttacatgttcaatcttatgatttatttatagaataaattaaatcaatatgtatatttttaacaagggtcaccctgactcttcgttggtatttgattagtgttgttccattaatcatgatgtgtactttgccggattccaaaagctgtttaatccatgtgatccaaactgaattaaacccctgtgcgatagtatggtgtagagacattcccagtttaaccatatgcacaattttagggtaaataaacatttgcagtgtatctactgcattacttctatgtgtttattctttctttattcacttttcagggtgctcagattgttggaatggttgcagaagcactgaatgttccagcaactgccaaactatttgattaaggccaatgatgtactgggtatcccccaaccttttattctatcaatgtgatttcacctgtttcagagtacttgttctgccatgttaccaagtttctgtgctctactccaaagttgaaaaaaatagtgatcatgctaatgtttttaaatcaatggaccaaaatttgttggatctttgaatcaatggaccaaaagaaaagcttgattcaattaggtttgttgatgaatctaggggttgtttagattgatgacattttaaaccataccaaattttctaaagttaccaaagatgtgcatacatttagttttgtaccaaatattgctaaatacataaggaatcctgcaaaaacttggcaatattgataacttaccaacattctagcattgccaaaatttgataatgtttattttggctataatctgaacagcccctagttaaacacctctatattttcatcttgcaatttctgctagaagtctagcccacaatttttttgagaattcccagctatgattttatcaacaattgtttgagtgccaagtatgacatatttcagatatggttccggttattgtcagttaaaaaagttgaattcttatggtagaacaatactttttttagccatctatgtatgggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtaccagccttgcagctgtagaagcactgcgtgcacgtgattgagaccaaaatgtaattgactctgtagatgtcgcatgcagtctcagcttatgagaatacactgcacttgcatttgctggtgttttcaggtaattcctttgtcatgttcataaaatcatgcatattttgttttgaaacaataagcacgtgggttccttgcctatcatgggggtgaacatatatacaatggtttgatttgatcgatcttttgttaatacctgtaagatggaattcctaattgaagcatcatactttttcattctgctatgtgccaagtttgtatacttaatcatagttctaaacatgcagggatggtttgaagctg

SEQ ID NO: 70146 - DNA, 16872 bp, Oryza sativa
cagttgataaccagacgagatgtggtgctgcgattgcggagctcagtagcgtgttcgttcagaagccggatcgagttgtgtcgagactccgcccgaatcgactatttatcaatacctatcggaagatcgggacctaacattcctcatcaccaagtgcagtggcgaggtcgcggagggaggtagccaagtgcaagtcatggtcctgttgatgtgaaaaacacacactggcctgggagatctgcttagctctagtgtaagtcttaaatcttactttcgggcttaaaggtgtaccagttgatttgatcgcaatcaacaagaaggaaaacaagaaaacaaagttaaatccataaacgatagccgatcggctaagggccgatgacatatcgttaatcattaagctgatggtatttacattagatcggcaatgtggtgtgaagcgtgacaaagtaaggtctactcgatcagctgtagacatcaatgatatataatctatttttaaaaatatccttaaaccaagtgattcggatagatcggacagtaagccgagacagtataaatcacttatgttcaaagatgcgttaagacaaagattatatatattcatagcatagccgatgaagtaaatctaatatgtatcggctagtactccgatactactctatattaagatattaaaacaagtaagatataccaaacaataagcttaatatagagggcagatttaggatataaagtaatgtatagagaacaatgcactaagatcttaatatagagggcagatttagcatataaagtaatgtatagagaacgagataacgacacttttgctaattggcgcgtacgtgttgccggtgcgcactcttccgacaagcccacgtgactacgtaaggcccatgcaactagcgggacgtgttttgactttttttccatggatttctcaatcacacgcgcatgattttttttttcacaatttttttctcagcgtgaatttttttaatcacgtgcacacgaacgtagagtaactaatccatcaagataatgatgataattaagataagatttgtttttttcaagatttttttaagtagtagattgaaaataaatttatacgtgaagtcaaattctgaaaaatttcaacctagatttgaaaactttcaactcgaaatttgaatttttttgaagtcaaaatttgaaaactttcaacttatcatctcggacttgaaaattttcaactcggatttgaaaactctcaacttgagatttgaaaactttcaactcggatttgaaaactttcaactcgagatttaaaaactttcaactcgtatttgaaaactttctactcgattttgaaaactttctactcgattttgaaaactttctactcaaatttgaaaaacattcaactcacagttcaaaattttcatatcaaaactgaaaactttcatatcaaatttcaaaactttcaactcaaaattgaaaattttcatctcaaattggaaaatttcatatcaaaattcaaaattttcaacttgaattttgaattggaaactttttactcaaatttcgaaatccttccactacaaatttagaactttcaactattttaaaagttgtaactaaactattttaaaagttgtaactaaattatgtatatatggtttttctttaaaatagtgctaatgatggcaattaatgctaattacttaattcgtgggtgtgcctgagcactggggagtcgagacggaaaaagtgtgcgctacttctcctccttgcacgtctgcacgaactaggcacccccagataactaaattccgatgctatctctatcgataatcacaaaacaagctagatattatagttctagatattacttaatagatcgaactcaactgatgcagcattaagcataaagagaaacataagatctaagcaaattgatgaaaacctctatgagatggtaaatatactatataatctagatcaacgttgatatttagccctatcagctatcctccaatgatagatgttgaccgatctaaggttagatagaaatattgataaagattatatagcacatacgataactcgacgattcacataaacaagattagagtgtcatgaagatgtaagcactaatcctgagaacacaagccgtcatgacaagttttacctcttgtcggagatcgaattaacccgatgcagcccaactcgaaagcaagaactcgtccaaacaatgaaagtaggaaaaggtggcgatgcgccgaaagtgttatacatggtcttgggtcatatttatacccaaaatacataatgtatccttgccggacacgactctaaatctgttacaaccgttaagatacgaacaagtcttttaggcgaactcttgccgataaatatctctaaggaaactattcaaaatatcctaattaatagatacaattgcctatccttgagcttattcaaaatatcctaattaatagatacaattgcctatccttgagcttatcctaatcatggcaatacttatgcagcacgttgatcaatcccgaagatgattttagaaccaccttagcgaaatcgattacatcggctattttctatccaatccaatatcagccgatgtaatcgctagccgatgccttccgtagccaatgcttactctgtttcctccaccaaatccacttcgatctcagcttcgaatttgatgcatgatctaccaaatttggtcttcaacaggtccccatagcttctccaagtgcaggtgcggaggataacatgcatactattttgtgcagaattcgtcagaagtagaaaacttcaattattttatgcagaaagtttcacagtgagtagaaaatgattcaatttcgagtcaaattaatgtatgttcctctgtatcttcttacactccccctgttcccaactcctctttctcgtttttcgtgcgcacgcttttcaaactgctattttggtgcgttttttgcaaaaagtttctatacgaaagttgtttaaaaaatcatattgttccatttttgaaaaaaataagctaatacttaattaatcacgtgctaatggattgctctgtttttcgtgcggaggagtttggttccaagccatcctaaacgaacacagccttagagtccttttggtctataatttgttgaaaatatggtcataatttggtatattttaatccagaaaattaatgtaataaacatgacatttgcaaatggcagtgatcctagcatggtgataaacatgaatatgctaacatgaacaaaagcatctagcaacatgtttaacaccaagattagagtagtaaaatacccagagaacgctctagtagatgatgaggcattggtattgcctccgttgatgttgacattctcggttccgcctcctccagtgccatagttccctccttttccagtagtgccgtcattccctcctgttccagtatcgccggtgctggtggaagacatcacgatgtagtggaagtagatgacgcagtgtagaaccgatgccgaggaagaagacgttgtagagcaatcgcactagtgagcgctccccaaaaacttgatcgcctgccgacttatgcaggtacacatgtggatggagttctggaggcctgcttgtcccgagcacccatgcacgctcagaaccggggaagcagaggctggcacagaaacagaagaacatagactaccaagaaaaaagaactgcgagaggacaacatagcagagtggtgtatctctgtctatccctagtggtgaagtttatatagtgcgcgagagagtaacgttccgaagaaatcaagtcagagttgaatttttcccgttagaggattaacacccgaatcaatatgattcatcaaatcggtattagaatgttcatcctttaacaaccaggtgctcagaaccgaggaagcaaaggctagtgctaaaatataatagaagaacagagactaccaaggaagaagaacagtgagaggagaacagagcagagtggtgtgtctctgtctacccctggtggtgccatttatattgtgcgtgagagagtaatgttctggaaaaatcaagtcagagttggattctttccatttgaggattaacgcccaaatcaatacgattcatcaaatcagtattgaaacgttcatcctttaacaaccgaatcaattcctttaattctcgtccattgcatatagttagagagagcagcagcaacgcaagccacgcccagcccagcgcgcgcgtgtggcagtcccaccaccatctcaaccggtcattgtttgcagtaggggaagacgacgaagtcaatggagcttgatctatgtgccgcccaccggctagagggcactcatcgtcggccgcatccgaaggcactactagggctggatccttcgtcggtcgataggcgcgggtggactggtggaggatgtgccggtcgacaaattcgtggggtgagagcgggcggcggtagtgcggatcctcactggagaactctgcttcccctcctcgtctccgtcaagggatccgccggtctggaccatcaccgctgcgatcgcctctgtttttctgtagataacgccgttgattttttgtcacacgtttgactatttgtattattcaaaaaaattaatatattttttgtaagttgttttatcactcaaagtatttttaagcatgatttatatcttatacatttgcataaaatatttggacaagacgaatcaatggcgccatccgttaaaaacggagggaatatattctaccgatctcctaaaataagtaatatcataaaatgcatggccatttgcaccatatttcagcatactttcggaatcgaaagattcagttataggctaataagcctggaacgaaacaaacaaaaaataatttatagatatagcaaatcccaatttttgtacgtgttactagagattcaaaactatgggtagaagaactatgatgaaaaaacttcagaataacttaaaatttaactaattttaaaattcaaattttagctgcgataattattcaacaagaagacaatgaaagttctgaaattgccttggtgataatgcacatatgcattccaggagagtacacatgcaatatatagccgctccgttgattcttaacactgtataacatctttgttgttttttagaaaaaaataaaataaaggaatttgaaacctatttaattagtaccaaaacctaccaccatacccccaatccagatcaaaatgtgcctatattcaggtgaagggaggtgtaggtgctaacgactgtgatgtgaccatggctaccttagatacaaccaaccattgctcacatcatggatcaagaagaacacttcaagatcaagccgtccaaattctggaatccaattcggccacctgctactgtgctaaattcaaatggccgccaaatgagcatacgagctccattttgggtccatgagtacttgatagaaagctcacgaagtcctctttccaacggatctagccttgttccaaaattctatcacagtcgacagcaattgcaaaaacaaggtgatgcgtcacctgtaatgggccaatgggcttgtaacttcgtctgggactccggcccaaatagggcccatgtggggtgcaccccaaccagtttgagcacgaccctaggcacccctagatcgtcctctgacctccttaaatagctatgtatcccttcatggtttcttgggttttgttatattaagtttagccattgctacttgcttgcagcacgcgtgtcggctagaccgtccgtctgcttgttcttcggatccccaacttatcttgtgtattcattcctatttgcaatttagatattgtttttatcttgttcttacttgtttcttcgatttgcttgcaggaatagagttgatctgcaatggcaagatcaacaacccacggagaggtgcatcgatcgctaaggcgcaacataacgtcttgtacagttgtagttgagtcgtcaacgtttatcccaaatcatagttatctgaactcaccgaaagatcagaccaaacaacagccttgagtgtcgagtggaactcagggttctatttactccccggattttctaggggtctatttacgaaataattttttcaaaaagactaaattgtgaaaaatccaatttttttcaggggtctatttacgaaataacattttcgatctatttagtgaaacaattccaatatacttagtgtaacatcgtgcaacatttaaaaataattcaataataagctaaaaaaaattcgtcggaatatatccatgtgtggtctcgttttaaagatttaattggagcgaatttaatggtgcaatcggatcatgatttagataaataattaaaaaaaaatagtttaaagtggttttgcacgcatacgtcatgctgatgtcagcgcacgagttttccacctccccatggggcacccgacgcgcagtcgtctcccttaaattttggctagatggaaaccgatcgagatggatatctagcagtgtgatcggtttgggggaagacactcagacactggtggtgagcctcgtctgggctatgccttgaaacaaagcacgcgtagagctcaaaggcatcgaacttaactagacgcgtatcaaaatttcggcagaaataatatttttaattttgttaacagtagagataaagatagagatataggtagataccactagatttgcactactttatttttaaattaaactagaaaaaatgtccgtgtgttataacgggtaaaatttattttaatcttattattgttatatgatttagttaagatgaaatcatgagctgcagttaggagtccgatcgtctcaagttagcatgtgagtttcttttaaacagatttcttatatgattccttatgtattaccaaaagtgaacgatcttaaaaccgacttaaatacggatatgtatttccaaaagcaagcgaatttaaaatccgactcatatacggatgacgtatcaaaataccggtaaaaacatcttcaatttttataatagtagaggtagagatttggtttggaaattgtttgaccctttaggttttaagagatccctgatttttcctgtccgaaccggattagggccatccatttgatgggatcagtatctgaatatgcttcggcaatgtctatagataactgcatgcgctcttcgttggatcggatttaatatctcccgtctatgtaggattggacttgtttacgtcgagagatcagccgatcgtcatatctatcatatatatgaagagtgcccatacgattttctttccaaagaaactattaatcctagcctaatggcgaaacgcaataatctatacctatactaatcgggcacttttttggagctctcacgttaaccagaaagatctgagcgtcaattagataagtcgtttaatctacaccgtagatcctgcaatactttaacatcgtgagccaatcaatcttaaactcagtgggctccttgcaaatcctatctatccagttatcgatggaaggacagaacccatctaatttatctccaagttccatcgtaagaaatcagattggaaattaagaagcgataaagaaacggcgaacgcgatcgagaagaacgtgagcgagggcgacgagatatgcataggctgcagtcgaccttgatcccagactgtggtcccgatcagcgacaatttgcctcaatcatgaggagaagttaaaagtttccagtgaatcagtgatcgctccagaggtatcattcatccctgttaagtctctggtttgacgtactgtttttactccataaagattgaataaattttaacctgaaacgaaatttaaccaaatgaattttgggagaaaaaagtttgctacaaaataaaaaattacttgcacatccgtcactgcatctgctacagatctattgctgcatctacaatatacatatatacgtattcctttgaatttgcatggtttgcatgttcaatttgcaatacatatttagcagtttatttaattaggacgcactcaatttatggttttgattgggatgatcaactatttgctgatcatcttttacatattgaatgtgtttttttattccattaaacttgcaagttctaagttgtcaattctgattttgacaagttgtttaatgacagtagaagcagataaaaatatattgatctataattctctgaatgcaatcaactatatttaattttccatatgcccggtatatcccgtatgcaatgcatatgtacatgtagtttgcagcttactgttcagtgttcatgttcattcgtttgggttagtccttatatcaatttttcctaacaagtatttcagttaatatatagagcttcatttacaagtataatttagcagcctaatttggagatacattttcttttatgaaaaccgaagggtaacttctatatattgcatacacttgcattgtagttaattacacgctaaatttcaaaacataaactataattacattataagttttaatatttaccttttgttttttagtacacagtttataaaaattaggagtaaaattaatttaattattatctacttggaagaggaaatgagagagagagagaagcatacttactagagtatcatataggatacatgacgtgactgaaactaagacccccataattttagtaatcctgactctttgggataaatattcttctcgataataaatcatgcgacgtaaagagaacgaaattcagaattaatcatacacacggtttatccatttgaactagctagaaacctactaagcgaataatcatgcatgtaaacaaatatttatcatgtactacgtaggttcatatgagtattacttgcagcaagagtaaacaatctaggcttgatctgatagacgtgaccaaattcacgttaaatagcatgtatcgtggcaaaatcgcaaaatcacaacattaggttttatttagggtttgtgaaaaaataaaacatgcaattggcaatatcgtggactctttaatttgtacttaaccggtacaaatagacaagagactatagatcactaattattattatgagttttgggaatgataaaacaaaaaagctaattacatatatcttatatcttctagggtccatactgagtataactattttttttaatgtaaaaattattaaattacagggtgtacttaaatttaaactcgaccacagacacaactaaatacttaattaattccagaattccacaatatcaaataaaaaagttggatgtatcacaaatttagcatttgtttgattcaaaattaataattaacaagtagtattcattctgtaccaaaatataacaacttctagcctttagaatttgtcccaaagtataacaatttaccaccaacattctcttcttaacgaatcataatcctccaccatttaatttttccagttatctccacttctccttcagccacaatactcccctatttaattgtaccaactttcttaataaccgttgtctaactctaaaaatgcttatattctgggacgaagggagtagttaactattatttcaatctaacatgctacaattcgaatatggccaacgtagtgaacgtatggttaaaattttgatctttatactaccaataccaataacccgtgcaaggcacgggttgacggctagtaactgtaatgtaccaccgacttcgggcgacaacacgaggcactccaagaagatgaagacggtcgagacgacatcttccggattgttctcactgcccatcgacctcgtcgaggagatcctcatgtggctcccgtccaggtcgcttgccaggctccggtgcacctgccggtcttggaacgagctcatctcctcgggtggcttcgtcgatcgctacctgcaaaatgcggcggctcggcacagcgcccccgctaagttggtgctcacgcccctgtcaaaacgacatgccaggagcttccacgcccccatgtgctgcagagactgccctaggatcattggcgcgaggccgtgccgcggactcgtcctcttctgccgcccgtgcgccttgacctactccgtgtgcaacccttccaccggcggcgtgctacaccttcccccgtgtcactcagagtggtacatgagcagcgcggggatcggcttcgactcggcgaccgggaagtacaaggtggtgcagctcgtagatccaagttccccgaaagtagtggggacacaatgccgtgtgctcaccgttggcgacgaccctttgggctggcgggagcccttgggcgaggcctgcacaatcctccaggaggaccacgctaaagaaggaggctgcatcgccgatgtcgacccggttttcgcgaacgggcgcctccactggacgctcaccccaaagttcctggtgtgtgacacacctcagggcatcctcgcattctcgatcggtgacgaatccttcgtgacggtccccttgccaccattcgcatcggctgacttagacgtgtgtagcagcagcgtctgcgttgcgacaaatgtgtaccttgagcatgttcggccgagcaagttgcttccaaagaacaaggaaatctttgcgccggccggcacggtcctggccgagctcgacggctgcctgtgcatggtgcgggacctccgccaccgccgcaacatggacttgaacgagaccaccatgttcgagatatggaagctcgggacctacgagaccggggagtggtcgctggactaccggatagacctaccccgagggtacagggccgcagagcgacttgtcacgccatggcttgtcatgccgctagcttacgtcggtggtgatcccgcctcaactggggggcagcgtaggaaggccgtcctgctggcgacgacggctcatgaggcgcatgtttacgacccggaagcggccgtgctccacagggtggcctccatgtcagacgacgagagccgcagctgcgacgcggcgttttacctggataaccgtttgcgtctcacgctgtaccaggaaagccctgttcagatggacggcatggaacacgatggtggtgatgccaagcttatcgggtattccattctcaactcggagcaaaattagttgatttaactatatgagacaacacatcagggacgggccccggatgttgagatagtaattttttttacgaccacaagtctaatatttgatatgtataataacacgtagttctaatagttgcatgatatacagtacatatagaaagataattatatgagcttcatgattgttatctaatatatatgatgtgggggcgagttccatctacaattgcaacgttcacatcattcttcgttctttagcatgtcataggtttctttctgagttatctaaagagcaaaagctagactttattgctctcctagaaacaggtaaagataagtttgctgattcatggttaaataacatctgtggagggaaatattttctttggcattggactagaccaaaagggagaagtggaggtatcttacttgggataaatttagaactctttgatgtcgctagtatcgatgaaggagagttctatattaagtttcacttaagaaataaagaagatgcgttcctatggaacctggtggcagtttatggggctgcacaagatgaatttaagcaagatttccttttagagctggtcaattcttgtagtaaggaagctttaccaatggtaattggtggagattttaatattattagaaatccaatggaaaagaacaacgagcgatacaatgatagatggcccttcttatttaatgctgtcatagacagtcttaatttgagggagatcttgctctcaggacgcaaatttacttgggccaactctatgccgaacccaacttatgaaaagttggatagagttttggtgagtaccgagtgggaaacaaaaaatccgttagtgacagttcatgctctttgtagagacctttcggatcacacacccttggtgctagacacaggaaaagggacacatagaaattctcaacctttgtttaaatttgaattgggatggttattaagggatgactttcaaaatcttttggtagaaatttggtcaaaggatattcaaaaggatattcaaggggcaacaaatatagaaagatggcaaaataagatacgcaggcttcgtcaattcctgagagtatgggcgaagaatttaagtggtgtgtataaaaaagagaaagctcgacttatagcaaaggcagatgagttggacaaattagctgagaccaggatcttgactagtcaagaactgattctaaaaaattcctataaaaatgccttagcccagttgttaagagaagaagaagttaaatggtatcaaagagcaaaaacaaaaagaatagtagaaggagataggaacaccaagtactaccatatgatcgcgaatggaaaacacagaaagacaaagatttttcaattagaacaagaagaaggggtgattaagggagatgcacaactcaagaaatatgtcaccaattattataggggtctttttggagctccggatagaaattgtttctccatgtgtgaatcccaaaaggatgatatccctcaagtgtcaatggaggaaaatactttcttaacaaaagaatttacagaagaagaagtgaaacatgttgtttttcaaatggaacataacaaagctccggggcctgatggtttcccagcggagttctatcaagtgttctgggaagtaattaaagaagacttaatgtccgtctttagagattttcatagtggcgagttacccctacatagactgaattttggtatcattaccttgcttccgaagaataaagaggcaaaatagatccaacaatacaggcccatttgcttacttaatgtaagcttcaagtattcacaaaggtcatggcaaacagaattgctctagtagcacagaaagtcataagaccttcgcaaactgcttttttaaaaggtagaaatattatggaaggggccataattctgcatgagacattgcatgagatgcataagaaaaagtcaaatggagttattctgaaactcgatttcgagaaagcttatgataaggtaaattggaattttcttcaacaagcgttgagaatgaaaggtttctcggacatttggtgcaagtggattgatcaagttgtgtcggggggtagtgtagctgtgaaggttaacgatgagataggccacattttccagacgaaaaagggtttgagacagggggatcccctctcaccaattttatttaatttggtagcggatatgcttgccattctcatcaatagggctcgagaccttgagactctaaatggagtaattcctcacttggtagacaatggtctctcaatcttgcaatatgcagatgataccatcttgtttatggaccatgatttggttaaagccaagaacctaaaattggtactagctgcctttgaaaagttattgggcttgaaaattaattttcataaaagtgagatgttttgttttgggaaagctaaggaggtggaaaaggattacaccactttgtttggttgtaagatgggtacttttccattcagatacctaggccttcctatgcatttcaaaagattgtcaaacaaagattagaaggatctagaagataaattccagaagaaacccagttgttggaaaggcaagtttttgtcgtcaggaggaaggctggtgctcattaattcagtgttgagtagtctgtcaacattcatgctttctttctttgaaatccctaaaggaattttaaagaagctggatttttacagatccagatttttttggcaatgtgatgagcacaaaaagaagtataggttagctaaatggaatgtgttgtgcagacctaaggaatgtggggggttggggatccaaaacctagaaatgcagaacaagtgtatgcttagtaaatggattttcaggttgatcaatgaagacggaatttggcaaagtttgcttaggaaaaaatatttgacaaagaaaaccattttgcaagtccaaaaaagactaggggactcacatttttgggctagtctcatgttagccaaagagtcttttcaaaggtttggttccttcttattacaagatggctcacaaataagattttgggaggattgttggataggagttcaatcctttgagaaggagtatcctaacctctacaatctagttagaaataaaaatgaggtggtggccaaggtaatgagtggaataccattaaatgtgtctttcagaagatcaatagtgggaagaaacttggaagcctggtatgagctagtgtcgaaagttgtttacactgtattgacagatcagaaagatcgcttcttttggaaaaacaataaagaagacattttcacagtaaaatctatgtacaagttgctcatgtatgaagggctggtacctaggaagaatttcatttggaagctcaaaattccacttaaaatcaaaattttcttgtggtacctcaaggaaggggtaattctcactaaggataatctagcaaagagaaggtggaagggtagcctaagttgctgtttttgtaactctaaggaaacaatacaacatcttttctttgattgctcaatggctaggtatatttggagtgcgctcctttttacatttgggattaggcaaccgtgtagcatgtctcaaatgtttgggaattggctgaattgtgttgaatttaggctcaagagaatattgtttgtgggcatagctgcatttctttgggcaatttggttatataggaatgttgtggtctttaatggctccaatcctacatctttcttgcaggtcattttcatgggaacacattgggcaaggacttggtctttgcttcttaagggaaccgatgaagaaatagttaagaactattgcaaagtgctggagaaagcgtgtggtggaattcttctccgtgtatggctggaacctgagaagaagattggaagcctagtcttttcttcatttgttgttcttaaaacctttgtgctgtcatctcttatgtaatgggagaggtcagttgatgcattttgtacccttttattatggagagtcttatgtactcgtgttcggatttttggctgtgtacaccccacaaaggtgtagaggccgtgtttgataatcctttatctaaaaaaaatgtgtagcacctcaaatagtgcatgattttggtcataaatttgaactgtgtagaagaacacaatacacttccatcatgtaactatatcattatttcgttagcaaataaatttatcttccaatgaaacaagtacctaacattaggatgcgcggcaaattaaaggatatggatattggatttgtttgttcctcttgcttctcctctttagaaagaacactcatatagcgcaacaacgttggtcccagcactcccgtatttttaaaatcaacatttttcttttcttttttacaaacacaatacaaacgttcatcttactcctctttagaaagaactcatatggcacaactaccttggtgtatggtgacaacatcgattgatccgattgctcacattctttaaaatcaacatgtttctttttctttttacaaacacaatacaaacgctcatcttgcttctcactaccgacgatcactgaaagaatatatatatccgtaaatgtgaacacccacatcaagtgtagaacttaaacttgaatgggtgggttctaccataataaatctaatcacttgagctacactcatttcgcaatcaatatgtttcttagaatcataactaaagaaactcgaagcaacatgattaaaaataatactgctatgtagcacttgatgtgatctgctcttttctcatgcataacaacaaaaggattcagatttgagcatgttcacactagtacagagaccgccattggtgccggttggaaatcggctacctattggtcggcaccaataagaaaagccgacacccatgccaaaatagaaccggcacctttaactttgctcgagccaaaaaaaaaaagagcgagctggctcgaattgagccgaactcaccatccacattccacagccgttcctccctcgagcccatccctactccccttcgtcaccgcctcttggatccgagataaactcaacaacaaactagtatattcatcaagaactagctcaccaagaactagcgaatagtacaaatcattaagaactcaagtttgggactagaactcaacaagaaatcaaaaagagaaactcaagaacacatgccacaggggtttcaaaagggagcacatgtcgccggccgccacatcgcccgcgccaccgccgtcctccacgctcgccgtcgtcgccgcatggggagggtgcggccgctgccgccgcctagttgcgccgccgccgcctctgccaggcaggagcccgccacctccccactagctcccctggcgtcggatctagcggaggggagctcgccgcctcccctctcgccggatctggcggaggggagagtgcggccaccgccgccgccaccacctctgccagccagccgccgaccatgggaggggagcccgctgccttcccactacctccccactgcctccccactgccagccagccgccgccgccacctctgccagccagccactggccaagggaggggtgctcgtcgctgccgccacctctgcccgccagcgcccggccatgggaggggagcgacgcgagagagagggagggagagagacgcgagaagggatgtgatcgatgtagataaggaccgtgtggtgtggacgactagataaggacgtttggtgggtgtggaccatgtggtgctgctgagccgctgatggctcgg

SEQ ID NO: 70147 - DNA, 2697 bp, Oryza sativa
  unsure (1)..(2697): unsure at all n locations
aagagcatcagaagcacgggagcaaaaatttgaagaaatcattgcacaagtcggaattgttgaagagaagcgtccttcacttgatgtctccactcgttggaattccacctatttgatgctttcctcatccttattattcaggagggcttttgattcattggatcggtttgatcctaactttaaagatgctccacaatttttcgattgggagaatgcagaagttctttgcaaacatctcaaggtcttctatgatgcaactgttgtggtttccgggacatcatatcccactgttactcgctactttcatgaattttggaaagtgaaggtgatgattctaaatgagtccaacaatgaggatgatcttgttgctagcttggtttctaaaatggatacaaaatttcagaaatattgggatctacagttcctgcagatttgggttcctgttatttttgatcccagatttaagttgaaattccttgagtttaggctgaaagcaggttttggagataaggcaactggtccaaatggatatctccctagaattaagaggacagtccgtacttggtttgctgaatattcttcacaaatttgtggtccaagcacaaccaattctcaagaagcatcaactagtggggtgaatgttggtggcagccaatttgctgactagaggcaatatcttcatgatcaaagcaagagtaaagtaaagactgagttaactagatatctcgaagatattcctcaagaaaatgatttccctgatgatgattttgacatactctagtggtggagggtgaactcttgcaaatatccaatatcatcacgcatggcacttgatttgcttgctgtccctgcatcctcagttgcatcagagtctgcattttctactggataaagaatcattagcgactataggagtaggttggctagtggaactgtggaggcattggtttgccttcaagattggatgcgagccgatggtatgaagcctactttagttgtgcattgctacttatattatgggccatgaacttatttatgttgaacttttgtattctgatgttttaggttttggtgatccatattcaattcaaactgatacggctgagggcgatgatgttaatatgcaactattgggtattcaaattacttgattttatatttctgtatgtctaattgaatatgggtactatgatgatctaataataatttacaatttattctacatttgcttcttaaatgagttgctagatctggaaaaagagttgtgtacacatgctgcattaccccctcaccatggtcataaaactgtaactgaaaattgtttctgttccttaaatagtactacataattttatcttcatttctaggtagtttggacctctctttttgtgggggtcagattcacttctattctgttagatagcttttaaattcaatccaagatgttctggcactggcaatgtagattatgttccaacttttaacccctttttgttgtcactgggcaggacattaaatcatttgacatctcaggcaaattaccatgtgagttctatgcaatctgggttctgagaaattttgctagttctggagcagtggtaagtggagcttgctttgtttcccagctcatatcagtgtttcccacacatgtcagattacatccaaaatttgtacgatgtattggaaatttagttgagcctgggatttctggacttcttttctgccgttgagcctgaaattcatatttgattttgcctggtgaattctgcatgagtgacaggaatagatgcaaggattaggcggctttgttgctgtcaggatatgcatgtcttttgagtccctttttttttcccctttatgctgttgttaagctatgaatattttggaaggggatttttttagaacaatttgattaaggatcggtggatttttatgccaaattgtagactctgcttttcgctgcagtcactgtctttcagaagatttcagggcccaagatggttactaatatttactgattttctgtttcatctgaagattcacctctgcaagcctgcatttttgcttatactgaagaactctgaatcttcatgcttgcataccatatatcgcaattttttttcctttcatcttggtttaattagcagatgtaattgttgccacagttgaagagaaggcagtaatttttcttgcattgacagtgacaactaatgctggatactaaggcagtaatttctcgtacgaattgaagcccatacgagagtgattacacatgattttacacgcataaacaccacacacacatttgcgggacccgcctgcaagccgccgggcaaatgcgggcgtgcggacgcgggcgcagcctgcccgctccagccgtgcgggcaatgcggacgcggcgcgggctgtccgcaaccgcgccgtctgcacccctaccgtctgcctccgtgtccgcttccgcgccgaggaaatcgagctgccattgcggcgtggcgcggcagcggcatgcgtggggagcgagcttcttgagcttccccgcagctgcggcggcggcggcggcaaggaatcgagagacggagaaggcgatggcgatgctgacgccgcctcgggcggcgaggggaggaggaggaaggangagagcggcttccattgctcgccgccggtagactgcgcggaatgcagcaggggtagtggata

SEQ ID NO: 70148 - DNA, 2005 bp, Oryza sativa
tatttgaatctgttcgcacatttttttaagctcgatctactgatctacactcttgtataagtaagatttaccttccttaactctgttaccagacgttttatacttatgaactcttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgcccacctgttcgcgccggtgcgcgcgcgggtgcgccgcctgctcgtggacaggctgcgggaggagcaccggtgaggcggaagcggcgccactcgccgtcgtagagacgtttcagtacgccatgttctgcctcctggtgctcatgtgcttcggcgagcggctcgacggggacgcggtgcgcgcgatcgccgtcgcgcagcgggacgcgctcctctacctgtcgagcaagatgcccgtcttcgccttcttcccggcggtcaccaagcacctcttccgcgggcgcctccagaaggcgcacgccctccgccggcggcagacggagctgttcgtgccgctgatcaacgcgcggcgggagtacaagaaacggcagggcggcgccaacggcgagccgaagaaggagaccacgttcgagcactcgtacgtcgacaccctcctcgacatcaagctccccgacgacggcaaccgcccgctcaccgacgacgagatggtcaacctctgctccgagttcctcaacgccggcaccgacacgacgtccaccgcgctgcagtggatcatggccgagctggtcaagaacccatccatccagtcaaagctccacgacgagatcatggccaagaccggcggcggcggcggcggcggccagcgcgaggtctccgaggaggacatccacgacatgccgtacctgaaggcggtggggctcgagggcctccggaagcacccaccggggcacatggtgctccctcacagggcggcggaggacatggagatcggcgggtacctcatccccaagggcaccacggtgaacttcatggtggcggagatgggaagggacgagaaagaatgggagaagccaatggagttcatgccggagcggttcctcgccggcggagacggcgagggggtcgacgtcacaggcagcagggagatccggatgatgccgttcggcgttgggcggaggatttgcgccgggctcggcgtcgccatgctacatgtcgagtacttcgtggcgaacatggtgagcgagttcgagtggaaggaggtcgccggcgacgaggtggacttcgccgagaagatcgagttcacaaccgtcatggcgaagccgctgcgcgctcgtctcgtgcccagaagggcctagatcaccatgtatgtatgcgttagggtcaccgtttcagtagcttagctcaat

SEQ ID NO: 70149 - DNA, 5359 bp, Oryza sativa
cattgaatcttgtattcaagttaggatttggttgaggagttgataggcctctaaactattaatcaaacaaaaaaaaagaaccaaaagttgacatatttagaaataccataagaatatggtacaatttgaaaacgtcggtgtgcaacaatattattttcatttacatttccataatttttaacatttttatcagtaaacatttccatattgctcgatcaataaaaataaaaaatgaactatttccatgagcctttttactatagggatatcggtggcttgtttgtcaactttagaaaagaggatcgggagtttagataagaaattgatgatgagatcaccatgagaatttaaattttagtcccaatcttttatttggtaaagatggtaggaatcgataagaagtttagttgggagattagatcttaaataaaaacagatgtttgagatttgtttaggcaaagtaaaaaaatgaatttcctctaaattaccactccctaccaagtagttcctctaccaagtttcaattcctcatcctcatcctactcaaactttcttgtctcccaaacaaacataatatttttatttaaaaagtagactaaacataatagcctcactcttctatgctcccaagcatcagctaataatatctctactcgtacagttttgcttgttttgaattttttttcgaaccttcttggtacgacgacactatttcggtcactccgttgttcatggatcgttctgcgttgcctagtctctcctaaaaactacacccaaacaaacggtccctaaaaactacacccaaacaaacggaccctagaagattaacgtggaggaggtggatcctcggccgtagagaagcacttacgggtgggcgttagggcgcatcttgaccgtccaagtagaatctaacgtctgggattgctggccagttgttcgggttttcctgtctctgattgattcctgaaatacattggagatcaagcacgagataatccgctacgaacagcatcaagcggcggccgttgagctgagaaaatatactgaaaagttttttcatggttgtttcgtgcataatgcctaactgagggcttgtttagttcacaaaatgaaaattttagagcagtcatatcagatgtttgaccggatgtcagaaggagtttttaacatgaatgaaaaaactaacaactagattgaaaaactgtagcacttataactaatcatagactaattagattcaaaagattcatctcgcaatttccctcttaactgtacaattattttttttaatctatatttaatactttatgcatatgtctatatatttgatgagatgtttttaggaaaaacttgtggggaaccaataaatgacacggcaagtaatcacttgtactcctcgatgatacgaattaccagtactcctcgatgcttaactgataaatgacacggcaagtaatcacttgtactgaacataagaaaatagacaactcggtgccgctagagtaatactggcatcagcagagacattccatgggcttaatttaattttcttttgtccggaactagtgacagtgcattaggagttcattcaggaaaagacaaaacacatactgcagtatcatacctagatgcatccaacttccaattctctgagccagcaaagatagggcatgttctaattcaaaactgcaaacaaactatagccgactcaaccaaagatagggcatgttctaattcaaaactgcaaacaaactgtagccgactcaaccaccaaacatatgagaggcagtaagggttgaagatccatggatctgttcaggcgatggtaacatcaactcttccggccacttggtccagatcacgccttccctgggaggtgatgagtcttccgctgacatagattagcacacgatcatcattataacagaagatacgccaagaagtaaagcatgaagcacttgtaaattaccccttggggtcgacatcgatgatgcccatcttctgcagctgctgaaggatgttgcgtgagatagcgccgctgctcttgcagaagtgcgggggacgtgagccattcctctggcggccaccatagatcttctggaagccacctacaccaataccctgcctcaggtagatcttccttgcaatcgaggctacagaaaacaagcaacaaagtcacaatcatattaacagtgttatgctcagatccctcgttgtgattccttaaaagaaagtgagacggccaggcattcatgttgacaaaggaacatgaatgctgtaaaagaaaagggtactcaccagccctcgtgtagtaccagtccggatcataaggagggagctccttgaacctcgcagtcttcacgatgtcaacccactcagggagctccatctataagagaattttaattgtcaaaacttagaacaaagaacatacacaaaggccaattgatgtaaatggtttcctatcgtagttgtaatttgacggtaacataattacaaagctttatttcttttatagcatcaagagtgccaactaaagtccacagcacagtgcaacaaagaatatatttaacatgaaactaaacagaatagataatcacggaatttgtgaccagcgtgaatattccacaacaagcggtacgcaaggacttcatgcagcagtagtcaaatatcatcacattacatttcttatgacttaacgtgaaacatttttatgcatgcttaaccaacaataaaccacatcttgacaataaagagtatttagctcaacacaaaagaacaagtaaaacacaggacgacctggtaaaaagatattcgaaggttgcctaacaacaggagctcctggctggctacaaacaactgtccaaattagagtcgagatctcaatcacataacctaatcacgaaaaatcaacatactgcaacgccgcatcaacatcaacgtaaacgaaatgaaggacacaactacactaagcaacggcgcatccaacatcaacgtaacgaacagatcggatgcttgtccctaagctaagccgcagcagcaaaaggaaaccgtgattgcatccgcacaaggctcaacaacaccgaatctccataggggcgggggcgaccacatcccatccatgatctaccaagaactcggatctgcgtggaaagcgcaaggtaagggcctggatggttggttggtcggttgcttaccttgccggagcgcttgaggtgggcggagtaggccttgacgaactcatgagggttcacgtccttcaccgtcctcgccgtcgaatccgccatcctgccgccgccgccgccgccgccgccgtgggggggaggagaggagagaggagggagtgagggtgcggctgcttggggggctagggttttggggaggagcggatgggagcggatttatacagcggcgggtttggttgcggggcgtcggatggtagatggacggctgatatggcctgagcgcgtgggtctagggtccgcggatggtttggtttgggctggaggtggtgtacgtgggctgagttgggctcctcatgactcgtttggggattaccaataggaataagttcactggaagtccctcaacttaacagcgagattttgtttaggtctctaaactacaaaaaccagaaatgtgtaccctaaacttatagaaacaatgcattcatggtcctagtcagcaaaaaaatttaaaaaaaacgtggggcccacatgtcagccgccctctgctcttttcctctgcttctcttctctttaatctcttctctcttatcttcttcggtgaggggaggccggcggcaggcagcaggtggcgggtggcgagcggagcgacggtgggcaagcccggcgacaggcgccgggagcggagcgacggcggcatgcgagagcggcagcggtcggcgggtgctgggcggagcggtttgggagggagagggaggcggctggcgagcccgttcgagctcacccggcctgagcgcgagctcgccccgccgtaaattggtgtgctggtggaggtgtgccaccggtggacggcatgcgtgaacgacgacgaggaaagggggagagcaacggccgacgacagagaagacaggcgagcgcgacactgggctgatcaccctcgccgaccaggcccctcgctccgcagcactcgctcgccgccgtatgcccactgatgctccgcgctaccgcgctcgtggaggaggtcgagcagcacgatgacgccgccggcggtgaagaactggagcatgacgagcgccgccactctcgcccaccgcccatgtccagcttcgctcgcccgtcactccgctgccgctctcgctcgccactccgcctgccactctcgctcgccgctctccgcgccgcccgccaccctacccgccgctcccgtcgtcccggccgcctctctccccctctcccgcttcttccatgcacgctgccgcgcctgcatctgtctgcctgctccgcgccgcccgcctgcgcgctcgcttgccgcccgccaccggcctcccctcaccaaagaagagaatagagaagagagaaaagagaatataaggagaggaaaagaggatagggcggctgacatgtgggcctcacttatttttttttattttttttctgactaggatgccacatcagcgaaaccacctatatatactgccataggaccttaagtgtacggtttctgtaagtttaggggtacacatttctggttttatagttaagggacctaaaaaaaatctcgttgttagttgagggatctttggggaacttattccccaaacttattccccaatacgtccactttagggcccctcaatttatcgccgagtctaaaattcgtctgtgaacccgtaataccaacatgacacgtctctcaactcctaaaaccagtgcaaataagatcccaaggtggtttggacagcgtttttagctgatgtggcacttaaagtcacataaaatcgtgggacccacatgctagtgagtgttcggttaaaaataaaaatttatagtgtgaatcacatcatcaccccctctcgtccccttattctctccattactcctctctttccctttcaacatcgtcgtcatctaaggtggctcttgttgtacacaagatggttggggcggggcagcagtggcaacatcttagacagtggtgtagttggaggcggctgcaacagtagtgcggccaccaacggggtggattggtcagtttgtggctgatctaggctaggaagagggagggtgagcgagagcgaggtcgttagaggagcaggaggcgctgcagtggtggaggaggaggaataatgaccccgcgggcccttgtgatcgagtggtagacgtgatgaggaggg

SEQ ID NO: 70150 - DNA, 2038 bp, Oryza sativa
actcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctatttattcttcttggaacctttaaaaattgaattttatagtttttagagattattgtcacattgggtttcgtttttataatttgtagatgtctcgtccaacgttgtcattatactcctctaccgcccgtccactgtttcttctttttattgtcattgaaattttaaaaatcaaagataattatcatttgggtttatttttactttttagaagtcccgccaaaccgtcagcggctttgccattgtactcctttacaggtcacccgcagcctccgttctttattgtcattgagattttaaaataaaacatgattatcatggtttcttttttactttttggaagttccgaaccttaaaaaattagacttgtagttttattattttataatttttagaagtcccatcaaacgatgccactatgcccctttacagcccgtccgccgcctactctttaatgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttattttttttaaaaaaaatagttaataccgtattgtgttcctttaatgtttttatttttattttcaatttcagttgtttgaaaattgtattcctacttaaattctcttttaatttttctaattttggatattattttatttttttaattcgaaattttaattattcttgtattgggttcttatatggattcttctttcaatattgcttattttttattccgaattttatctaattttcaattgtattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttaatttaattttaatccgaattttaattaatttcgtaatgggttcttaaaaggactcttctctttaaaaatccttaattttaaattcgaatttcagctatttttaaattgtattcctacttggactctcctttccttttctaaatttggaatttattttaaatggaatcccaccttgaactctctttaatttttctaaatttgggtaatattttattttttattctaaattttaattaatctcggaatgggttcttaaaaggattcttcttttaaaaatgcttatttttaaatcctaaatccaccaattttaaattaaaatcccacctggactcctcctttaatttcctttggcaaatttggaattaattttaattttaatccggaatt

SEQ ID NO: 70151 - DNA, 890 bp, Oryza sativa
attcctgcagcccttgaacatttgaacacctgcatgaagtattaaatatagactaaaaaataactaattatacatattacgactaatttgcgagacgaatcttttaagcataattgctccatgatttgacaatatggtgctacagtaaatatgtgctaatgacggattaattaggcttaataaattcgtctcacgtttactgacggattctgtaattggtttttttattaaatgcccaaacaccccatacaacactctatataatacccaatgcgacgtgccaaaactttagacacctggatctaaacaccactctgttccttctcctctataaatggcaccggggtggtttgtcggcaccaaaggcagaaaagaaagccaatggcgtcttcaggcctcgcagttgcagcaacagcctcgtcagcctggctctgctgccccaatcatcacatccataccagcagcagcagatctcgcaagcatcttcttctccatggcctgtacgggtctgcacctgcacgtactaggtatagtagctgcaactttattcacaatgtgatgtcacgttattatatatgtttcgtcgtcaatggcggcgaaccttgcaggggacgacggccgccggtgtggactgcggcggcggccaccgcagcagcgccggcggacacggcggcgtcggcgcggcgggagcaggtggagatcgcccggtcgctgaacgcgtgggtggaggagaacatgctcccgctgctcacccccgtcgactccgcgtggcagccgcacgacttccttccctgctcggccgcgggcggcggcgaggcgctggcggcgttcacggagggcgtggccgagctgcgcgcgggcgccgccggcgtgccggacgaggtgctggt

SEQ ID NO: 70152 - DNA, 20878 bp, Oryza sativa
aatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccaaagtgtccaaatgatatgagaatttcccaaagtctatagttataaaaccacctaatgttgcctaattaaattgcgaagcatctacctagaattatactagggataccatgagtagagtgtccactagttggggttttgtttaatctagggtgaacaaggtaataataataacaataacaataataatatggtcataacaaaggtaaataggcatggctaagtaaaacagtgataacgcggggatttaaataaagcgataatgcaataatttaaatcaacataattttataaactgggattcaatatgatcaagatgatgtgtcttgccttgctcgttttcccaatcgacggcttcgacttcaatgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaattttcaattaaaaattcggattattgcgtcagccgaggggcgggcgcgcggaccgggtccacaggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcacccgcgccccgatggtcgccgccggcgaccaacggcgcggcggagtggcacccgagagagaggagggaagggggaaacgaaggggacggtccacggctcaccccgagacggcgaaggcggcggaaacggcggacggagcggaggaagacggcggcgcggctcgggatgacgagggcgacggtgctccggcggtcggcgagcgaaacggaggcgcggacgaggtcgacggcgatgcggcgatgccgagggaggtggcgccgagccgggaggaagaccggagcgacggcggcggcgaaccgaaggtcgacggcgacggcggagagagaggagcacggcgctagcacgattccgacggcgagagcgagcggcgagcggcggaaacggaagagcggagctcgggcaacgaatatatagcaacgggagggggagagcgcggccggggaggaaggaaaccggccgcgaagatctcggccgccattgattgcgccggcgatgaatgcgggcacgattcgaacgaatccgagggagagagagagggaaaagagggggaatcgggagagggaaacgcggggaataatttccccctcttgattgcacgcggggcggacgggagcggcgggattcgcggcggcggcggcgctagggcacggacgcggcggcgggcgcggcgggaggagggcgatgacaggtgggccccacccgtcagcgagagtggcgggcgggcccgcctgtcagcggcgcgcgcgcgcgcggggagccgatgggccgagggggggaagagagagagagagggagggaatgggccgagccggcccaagaaggaagggggagggggaaaagacttcttttaggattttctttttataaacctttttaactttgttcatttcttttcaattattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaattttgaggatagattttagagtcgatttgggacgcgacagcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggagtggcgggaggaatgcgacgggacatcgctgaagcagaagaaaaaaccagaagacgaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgtgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagttaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctgacttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaaagtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgatcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgtgcgttaattacgctcgccgaccgaagcggcgttaccgtatctccgggcgagacaaatctgctcacccagattcgcgcgctgctcaagtggtgtggcggtcttgaatagaccgcccattatggacaaccagagttaccaataccaaggtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacacaatcgcccacgtggcctggcaccttcggggacgtcgggcccgagggtgaggtgtccgccctccttctgattccccccgagggggggtcgggttgcgcttgccccgaccccgagggccgaggcaccccgaccccttaaggaagtctgcgccgcatatatgggataagtgagcacaagctgtgctcacctaacagcatttattgcggtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctgattagatgaataccaggcttcatcctaaccattacaggcaaggtgttacacgaagaagggcaaacatgcacgttgttaaactgacgcgtggtggacaagaatgaccggtctgacactggtcgcgtcagcaacgggcagccacgatcccacgttgcgcccgtctccgccgggagtggaggtaggtgtgggctgtcccatcgaagtgtcattcggacggcaaccataccaatctccgttcataaagagaagaaaagtccagtttggaaagggaagggtgcatgtggtatccccttgaagtataaaaggaggaccttgcccatagagaaggggttggttgattcttgccagattcagagcttagaacgggggagaggtgggctcacactttgtagctcattcatacacagatccaccaaaacacaggagtagggtattacgcttctcagcggcccgaacctgtatacatcgccggtgtctcgcgtttcttgctagcagacgatctttccacacacagagagagagagcttgagatctcaccctaagcccccggccgaaccggcaaagaggggcctgcgcggtctcccggtgaggagccacgagctccgtcacatacatatgtatatatatatatacatacatacatacatatgtatatatatatacatacatacatacatatgtatatatatatatacatacatacatatgtatatgtatatatatatatatatatacatatacatatgtacacatacacacgcgcgtatacgtatacacgtacgtacgtgtgtgtacacacgtatcaggacatggagatgttctctttattccgttcgaatattctagctgatcggatcggctcgatcgatcgattctcgcgtacgcaactgggcaatttggcggcggtcgttacgactataggtgcccgcttgtgttcactatacagttagtaaaacattcattttgttaatccactctttagtacgtcttgaccgttgacgattgcccaagcaagccgcaccagtacgttcagtgcatacaaggactgtttgaggaaccttttgctagatgcatccgtttttggcagacaagttagccaatgagactcagcgagaaattttatattggctcaggcacttctgaaagcgggttttataaaatggtaccaacaaagtgcgtgttctataatatatcatcaacaaagcttgattcttacaataccttcgaacaacttgtctctttttcttatatgccatcatcattaagtcaacaattactcaaccgttaagggagaaaaaaagattacttttcacaaatctcaattttgcacaatgccatatcgcactaaactgtcttggatgatagaaaaacaagtggtcctatttttcatcgatgagaaaaaatagtggatcatggcaaatgaaattcatgggtacctattataccctatgggtaaaatggataaaattgagattttatcgtgcgacgtggataaaattgagattttgcacaatgccatgtcgcactaaattttcttggataacagaaaaacaagtggtcctatttttcatcgatgagaaaaaatagtggatcatggcaaatgaaattcatgggtacccattataccctatgggtaaaatggatattttctcgcccttaatggatggtatataagcaagaaaacaagttattcgatgttatataatataactcggtttttccactggtatattataaaatccataccttctaaatgatataaaatttattatctctaaaagaatataatatatttatgttatatcaatgactgaacaggaaatactatagaacggtatacctttccaacgaaataaatattgcatgctgatgtcagcacgatatcgtaggtatcagataggtacctaatccggtacctccagtacaagacataatatccataggtaccatgctgatattagcatgataccataggtaggtatcggatttggtacttgggatatcagacatgataccctctaagtatcagctagggcgttgaaaagtgcagcaatggctagggcaacaacgagtgaggcggcagctacaattgcagcagtgggagagctagtcagatccgccagcggcaatgacaggagggacagatacggcaggctctcctcctatgcggatcccgccgcctcccccaccctcacacatggatctagcaggccgggctctcctccacgcggatcctaccacctctccctcccctccctcatgcatagattcaatggtggcggcaatgggaggggcagatccggcatggctctccccctctggtttggatcccaccgtctccccctccctcatgcatggaacgtctcccacctccctcgcatatggatctagcagtagcgacaacgggagggacagatctagtgggctctcccctacccacgtggatcctatcgtctctccacttcctcgtgtgagggtctgttagcggggggaggccgggaagggcgtcggtgatgacagtgatgacggtcatcgggaatgggagcagtgtggtgacgacggccgcagagcacaggagcggcatccatccctttttattctaggtttttggaatctttgttttttggaattttgatttttttttcaaaaattccttttgcaggcaaacgacataacgtgctcacttgggaaaatcccttttcgcacgaggttgtgctgctgcccgcaaaaattcctattttcacatacaccttggagcaagcagttgctatatatacccccgcctacgaaaatacactttagctttttggaaaaactttattttagtagtgtcgggtatatagtgacccggccccgaacttctaaaatcgtgcaaattgtgtcccacgatagtattgtaggcgattttaaccgacgtagcgcctacatatgttgtttgatttggtcttcatcccatataatgcttatgtggcactagaagaaaaataataaatgaaaacaatagtgtgacccatatatcaggtgatagccaacaaatatcttgggccaatatatcatcaccgaccttctatctctcccccatcttctctaccacctgcacactaagctgaggtggccgtcaagctccttgcgcaatattggcttggtctccagaacggtcaacagtatcggcagtggctccacgttgtcgacaaggtagctctccttgtcccctgaccacctgtctaaaccatgtcctcctccccttccccttcttctcctatgcaccctccttggccctgacgtgcatgcagggatctcgggcaatgatgcggccgctagatgttgatagattcacatcaggcggtgctctaggttggaatcagtctagcatagaggttatgccggtggatagtgatgctgatagctgctggcgggaacagtagtggatggggagggaatggttggggcacggggaggagcaggctagggttcgtaggagtcatggagatgggagtagggttcgtgttcgggatacaaagattgtcgctctctggcgatgagtggaaatagtgggagtgaaggggaagcaagcgatgtggcgttcagcacgaggaaggtcggtgatgatatgtggactccacataattgttatactttttctagctggtcacccactggacatatgggtccaactgatatttttttattatttttcatctagtgcaacgtatgcgccatgtgagatgaaaaccaagtcaagtcatttaataacatccacaatacttccgaatgatgtaatttacattagttttagaagttaggggatactttatacatggttttgtaattgagtgatatgaaatggaactcaacccatatttgagggacctaatgtgaacttttgaccaaccttaatttgtactagctctttgtgggcttttatttccaggcttcgcctggctcaagtgagcctagagctttgagtccacgttgaaacgcttgatattacaacttgcatgcgtcaagctaccaaaatcagctcctgagaacgtgagagccattttgatgtcgaatcatgctgtggatatctttgacgtcccatcattcttagacggcacaaataaacttgatggatggaccgaccagtcgaagcaagcaacatttcaattggcgttggaacacgtcagttcggcaagttgccaaatttatgaccaactatcctgaaaatagcccagtaaactattcctagcacctgagcaccatgtccttatctaggtagtatgttttttcttccttgtgagaatttgcaggctattatatttgcaataaaatgaaggaatactaagctttaagatttattgttgtgttttgcgaatatgttatagtagaatttatagtcaaagtgtccgtgtctaattcaaatatggaaaaggatgtgatggctcgtcttattagatttcttgtggtgaaatttgttcacatgggtttaagttttagacttgagacatgtacttgtatttatagaattattttttcgatgataagtgaagtactcatcaatcagtaaggcatccgttataactttcattaatgaaggtggtcgtagaagtaggatgtgtatgtatgtttatatgaataagtgtggctcgtgtatatgagctttcacgtttgtgttgtatttcgcgaggatctatacttataaattggaggcgcaagatgtgctttaacatgttatgaggcattctgtttagtaattaaatattatgaagaaacaataagtagatttcactttggactataaccacttttactaaattaatttcacgtaatttacaaattcattgtaaatagtatatatacattcactatcgctatgctttgctcattcatgctgctgccggttatattctatcctcatcagacgaactatatatcaatagaatatactccatttttagctatgtcaaactaaacaagaaagaatactgcgcagctaatgacggatggaattatacaggagaataaaacatataagttatggatggccgacaaaattaccaagatgcagcagttgtgacgcttttgtttaaacttcggaaattcattgtgtcctgatgcaatgattttgttttctttaaaaagtataaaaatgcatgaaaacgtccagcgatggaaatgaatgttcacacactatcgtcatgagctagggggtatagctatatgttttttttttttttttggcggggaagctatatgggtatttgagatgtccaagatcatcattgaacatttatcaaagcaaaaaaaaaaaaaagaaaacgcccattctaactagatcaagaaagagggagaagaggaacttaaaagaaatacactgatgtgagctaagtgcgcaggagatgagaattaagcggatcagctcgagagtatagcgtcaaaaaggtacgggatgagttagcgatggtttggctaaataagtagtaaactacccctatttacattgaactttttccagattatccctctgtacggtagactgggaggtaccaggcatacctcccaagcattgttaaaggtctcatttagccaaggctctgttggtttgttctggtttgactctatgtactgttagaattaaatgaaatatgcccaatataattctagtaattctagaaccacgtagccagcccatctgatgggtgggcccacttacacaaaccaaatcatttacacttttgtcctcgcttcgggtaaaagggtaatccgggagtggcatggttggagggacaagcccttataagttggttccatccttgataaactagtaaggtggtatactaaacatgcgtatacaactcacatgggtcgcacaggcctcatcctaattgggccaggatgtcatagttttcatctcccatctccgagatagacatagaactctctattctgttcattttcctgatactctggttctcatcaagtttttggcaagtgcttctttggcgcgattgctctgctacgtctccactgcttcctatgcgccaagtgttttttgtttccttttcatcattgtgactgggaatggcaacggaggggagaacgacgggaacggtgacaccaacatcaaccccaacaccaacaccgcctctggatcccgggtatgtcactctattcactttagtgttaaacatgttactctatcatctttttattcacatctcatgtttagtattttgtttttctagtttaaaatacttccaacatatgaattatgactatacttccaacaggtactatgagcggagagcaagatgcttagaaagatgaacatccagcttggcccaaaaactggcaaggcatgttttcatgtttcttgcggggattaaacttttcatataaatcggtgcaaaaacttagttccgatcaaaaatttgaaaaatgacctaaaaagagaatttcttggtccacatgaatatgacgaaacaatgaaccatagccgaagtttcttatatccattccttcttcctctcatcacttcctagtttcctactatgtgccactaacaagaagacatgaacactataagcgtccaccaaaagagaaacaaatagaagagccttcagcccttcgtgctgccaacgcttttaacccatagtggatatatgtcgtcccagatcgattgatcgagtaacgaacagcaagtagccaagctgacattccccggtttcagagttcagaccgacgacgatgccaaaacgacgtgtgcatcaattactgcatttcgcccatgtcagctcagctcgatccgatccattcatgccacaagtcagagcggcatctgaacccaacaagtcagaatttgttgcgtcgcccaagctacacagttgctcataaatacacgcagagtcgcacagggaatgagatttgagatatcatcgatctggtagttgcttccagtctctactctctactccttgctattgcattccaccagttcagttcggcacgacttatcgacgacaagatatatggttaatccggcgacgatgatttcacctataaatacagggcagccaccgtgcatgatagatcatcgctagctgcagtcagtcaccacgtcaagccagtggacacgacaggcaagacgagagagctagcatggctttagctcacgaggtcgctttcgaggtgaacctgatcgaggacgacggcggcctcgccggctgggcgccggtgggcacgcgcacggcgctgtcctcgcacgccgagcgcgacacggccatgctgatctcgggcgccgtgtcggccgcggagccgaatgagcgtattagacgatcaagcggacggtacatcgtcgcgtcgcgccgcgccgacgaggaggacgggctgcggcgcgcggttccggcgggcgcgctcgtgccacgggtcacgtaccgtgtcgtcgggtgggtcagcgtgcagggccagggcgacgggaggcaccatgcggtgcgcgtcggcctccgcgtggacggcgacggcggcgacgacgagcgcggcagctggctagactgcggcgcggcacgcgtcgaggtgggcggcgggtgggcggagatcaacggcgcgttccggctcagggcgagcccacgcgtcgcggctgttcacgtccatggcgcgcctgccggtgttgatgttaaggtgatggatctgcaggtctacgcgacggaccgcaaggcgcggttgacgcagctcaaagagcagactgacaaggtgagtgagcaatcatcagctcactccgactccgcgcgcacgtttgcatgatcaacttcttcgttactgctttacgtgctaaattaatatttcctccagtcatatatagacaagtgtcgtttaacaatccatgtaggcaatataaattacatttgatcacaatttctgaaaagaacaaaatcattcgtaacatgtcacttatttggatttttaattcgcggtaagaagtcaaatgactttttggaaaaaacctctaaatgaaatggccgtttaagaaagtgactgatatttagggggaaaaaaatactccagttaagtgatgaattagcaagcccaaagtaaaatgacattccctggatgcgctcatgcaggttcgcaagcgagacgtgattctcaacttgggcggcggcgcgaccatggccggcgcgtcaatccgcgtggcgcagctgctggagaatcgcttcccgttcggatcctgcatcaacaagacggccatccgaaaccccaagttcgtcgacttcttctgcgagaacttcgactgggccgtcttcgagaacgagctcaagtggtactcgacggagccgcagcgcgggcagatcaactaccgcgacgccgacgagctgctcgacttctgccaccgctacggcaagtcggcgcgcggccactgcatcttctgggccgtcgacggcgacgtgcagcagtgggtcaaggacctcggccgcgacgacctcgccgccgcggtgcagggccgcctccacggcctcctgtcccgctacgccggccggttccgccactacgacgtcaacaacgagatgctgcacggccgcttctaccgcgaccggctgggagacggcgtcgcgccgctcatgttccgcgaggccgcgcggctggacccggccgcgcggctcttcgtcaacgactacaacgtcctgcgtgggaacgaccccaacgcgacgccggagaagtacgtcgagctggtggacgcgctgcggcgcggcggcgcggcggtgggcgggatcggggtgcaggggcacatggacagcccggtggccgggcaggtcatccgcgccgcgctggacaagctcgccgcggcgggcggcgcgcccatctggatcaccgagctggacgtgagcgagcccgacgtggggctccgcgccgacgacctggaggtggtgctgcgcgaggcgtacgcgcacccggccgtggagggcgtcgtgctctgggggttcatggaggggcagatgtggcgccgggacgcctacctcgtcgacgccgacggcaccgtcaacgaggccgggcagaggttcctccagctccagagggagtggaggtcggacgcgcgcggcattgtcgacggcgatggccgtttcaagttcaggggcttccacggcacgtacgtcgcgcaggtgacgacggcgacggggaagatgctcaagacgttcaccgtggagaaaggggataattctctcgagttggatttggatatcgaaatttgaaggtttaatgtgatgatatcgtcctagtcgtaatgtactgtgagcttaaagttcatctccatcgtgctggactactgaataatgacgtgcatgcatatactactgcgcttgatacattattgtgaaggaacaatggaacatggattaattagttcagtaaataaaaatgatacgattggatataaaatttataaacgagaagttgttggtcgcttttgacttgtttttcctacttaaatttctttaaatttgatcaaatttatagaaaaatatagcaatacttttaacacaaacaaacatattatcaaaatatattaaatgttagttttaatgaaattaatttgttgttgtagatattgttaatcttttctataaacttaggttctgtttctttcagcttgggattattataatccagattattgggagtaagctgaaagaaacagacaacttattgaagtaacttattataatctggagtccaacttattataatctgataaactcatttaggtgagctttttccagattattgggtgaaaaattacccaccatgccaccccactccctctttagggcctgtttggtatagctccaactcctaaatttaactccaggagttgagtctggagtggagttgtggagctgcctaaacccagctccacaactctagttcattttgtgagagggctccacccagctccactcccagttttggtggagccgaaactgtttggctgagctccagctccagaaggggtgaagctggagctggagctgtgccaaacaggcccttagacttgcaaacccaataatctaggctctaataatctagaaaagaaacaactaaccgcttattctactacagattataacaatctagcttatagtaatctgactcaataatctagattataataatcccaagctgaaaaaaacagggccttagtaaggaaaagtaaaaacaactgataatatgaaacggatagagtatgatatatttcaaacgataagttattatattttaacatacatatcaaagaccgaataaattcaacatctactatattaaagtatgaatggagtagatgtttatcatggatggaaattacacgtaatagctataatagggttatcttcgccttctccgatcccatccttcacctcaccgctgcccgagcacaccattggagttttgcgtgggcgcatgaatggtggtgacggggctcgttcaggtccctcttggcgcttaggatggttttggccaaggtatctctcgttggacctagagttgtgtctggatccgatgacagcaagtgcggcagctgccagccactccatgttaggcatggtgttggcacaataggactttgctggggaaatcgagggccgcatctaagtagatctaaggtgatatcgatggttgtgcattagtagtgttttggaatgattggggcagcgacaggatggcatggcatagaggagcagtggctacaacggcggcagggcgggctagactcgcatctccgctagtgaactgcggctagccgttgatggtgtacaacttgttagccttcttcttgtggctggtgagcatcagcggtggtgtgatgagactgtagtgccgacagcactggcatcatcgtgcatcggcatgttaccgagcagatcattgagagcaaaggggccaacaaggaggtaaccatgcactaggctgaccttgatgcccttgagcagtgggctcatggcagtggcaaggatggaggattagctaggcggagctggtggcatccgaggtggatggatacaatctaatggctagatcaagtaactttttggcgagcaacgagaggatgagggcgggctcctttagtggtgccaactacgaccggggtgtctggatctatctctctggcgagcaaggtagctaagtgaggagcaacatcggcgagttgatggtgaaggcggtggagagggtgtgacgataaatctagggcctaactctcactggatccaaggtgtctgtgtttgaagttgttcgtgcaatgtgaattgcgttggagaggtctcttctttcttctctgcctccaataaatgacgttgtcgagcaaacgcactagagtcaggagttgtcgaacctaggccgatttgatccgggcaacggtaggggtagtggtgacgaaggaggtaatcaaaggtggtggatggaatgcagatggggatggggagtataggaccttaggttgtgaatcaagatcgactcagtgtggttgtttggcgcggtagtactcatcaagcagcatgaagatcgaagcttagttttctagttctttttttgtcgttgttttgcctcagttatgagaggtggaatctaagtattcctataaaatttagctgtatatatccatttgtagaatagaagctagatttttatccattattaaaatatatatatatctaaacttgagcagtaactattcccttgggttgagaagcattgtatatacaaatggggagtattgtatcttgtgctcaacttgatatgggcttgaatctcaccgtcgatggcaattaaattaaccatgttttcatctaagggagttgtatagcctaattggcagccaaaatgggttgttgaaaatcaaggagtctataggcgtatttctcaacagcaggtagtacacgtgaaacagtggaccacatttttgctttcatcaggaaaacacaggtaaatctcgttcctttaggtcatcccagccctccatctcagctagtgtctacaacattaaatccactgtcatataagcaaaaatctaatgtggcaatagagttaatgaggagaaagggtaaaaagataaagaaatcatttctcatgcaagaaactgtctctacacaggaactaaggattaaaacaaggggatatgtgaatgaatggatacacaataaatgccattggatgatattctatttactacgcctccattaggcatatactccctccatctacttttgatagtcatatttccaaatccgataaatttatttttgatagtcatatttcaatccaacaacctatcctcttaatagctttctcggatttaatgcgtgactctccattcttccatataagattggctgcgtgggcatcgagaaatgtaaatattaatgaatcgcttgtttacgaggaataactagtagcatgtttaaatggatgataaatagaattacttatacttagtctgtgtgccaagatgaaatatgatgatcaaaagtagatggagggagtagtttcttatatgacatgaccagtatggaaactacttgatagtttctgggttgatattggccttggaaaatggaaatgcaagcatatttactgtgaagaaatgattggtgcaactgcattttcctatggacttatgccagattgacatgcaatacatcgagatgaatgctaaacacagctaatctaataacaaaatgagactcactgttatcccccagaatagcaaatcggaagtctaagggcattctcaacccatggtatccatgggtagtgtctagagcagtgagaaatcaataaatgcatatatggacactagatccccattgcatcgtttctataccagtttccatgggggaagaaaatttaatagttctttgcatgtaacattaacacaggaggatcagctgtggcaagcaaacaacctacaccgttttggtagagtaattcaaatgttacataccaaatgagcagatatatgaatgtgtcaaaaacaaaccaaatatataacctctgacctaggcaattaatttgatcaatcatgcaattcatacagatgacaatccatccatctcattaaaataaaaaagagatcatgtgcacatgagcaggttatgctgacaccaattaacttaaagataaataggtacccataaataacaaagtagcagcactcaaactggtagtctttcataacatcagtttgtcagggttatggataacacatacctaatagtagttgactaaatctcggcatgacccaccacataccatgtcttatacggaaataaccttcggagataggaggagttccgcataaggaaggatgaatagagttctacatggaaacgacaatgactactcggattgtatccatattggtttccctagttctacttggacaaggggacacctatgggtataaatataaggccccctaggaggagaggggacacggaacaatagatcaagacacaagatcaatatacaagccaacatgcgccaagacaagatgtcggatatcgacttcagagataagcatggctagtcccctacggtgtctacggatactgtcaggagagacatatcgttgtctttgatatcgccggatgcggattcgaggaggaaggttaccctgttgtcgactacgagtcagcacttgagatcgccaagtcgacaacagttagatagactaccacaaatattgtactggtgtgattatggtgaataagagcaacgaccggcttcgaccaacaggtgtatggttattacccgacaattttggggtctgaacctgtataaaaatcctcgtccccatctcttttattacaatctcgcatatatcctagtaccaacgatccccataatatgcaaataccggaatcgcgacatcaaacgttgatagtggcgcgccaggtagggggattttggtgcttcaggattttgacgagatgggttcaagagatggattcttcgccagcaaactactcaacgacttcgtatattgggtgatacgacctgagcgaagtgcgttctccgatggatcgggatcttcgtcaagcttcaccaagtcatcgtcactatggatattttgacgagggatacttcaactactttggatccgagaagtctaacccgaccagagtacgtgccccgacgagatcggaaccatcaagattgaccctagttcaagattttgtcgcagcggaaaaccaatggtatcgacggcacgtgagattgattaaatatgagttggtcatgttcccgacgaggtgtcctcggacacatcggcacaattcataccgagatcaacggcgcactgtttacttaggttaagaccgagaacatgcatgcatgcgtggaccagccaacgtgtttctgcacagtgcatatgcaaattggtttggtaagacatctatgctactcggacacgtgcacagaaggtaattagtgagattgatttctaaattaatctactaatttcatagatacattcggcatgtatctacaaaggtacgcaatattttatatgaaatttatcgtacctatttttcaagattatacaatattgtcatatcaataatttattatgtttacctagagcatgtcttttatacaatatctattgtgcgagcatttctgatgttaggccaactacggtctaacgctgggggctcgctctattttcttctgtatgaattatgcttgtctacggtttatataagagagaattccttatatgccattgaaatttggtctggtccttgatatgccacacaaaattggctcttcccttatatgccattgagtcaaatttgagcaccctctcatgtcactcacgtgagttgaccgtgtgttgactgttgctaggatctaataacttgtcagatttttgcagaaatgacaaaaatagcctttgacccaaacttgagaaaatggcccaatgccaagtggcccaagtccaacatccctctcctcaataggggaaaccctagatcgtgcctgaccaggacgagaggaggcgcggctcccctgaccaggcggcgcgattctcttgtgcgcggcggttgtgcaggcggcgcggcgagggcggcagtccggagcagggaggcggcggccggttgcgggaggggcgaccgcgggagggctggtcgctggatgggtggcacgggagcggcggcgtcagagcaggcaggcggcaggtgaggtcggcagccggtcgcttgggcggcggcggcggccggtcgctggagcaggggcgatggccggtcgctggggcggcggcgacggccggccgctggagcgggggtgacggccggccgctggtgaggggccgcggcggcggtcgctggaagggctgcggcccgcggccggtcgcgcaggagctgcggcgcctggagtaggccggcggcgggaagaggtaggcgcacgcgatgacttgacgaaaatgacaaggaaaatagagaaggcaagccaatgtactcccaaatcttgggttcctgaagggtatgtatcaatttttccccctcttgtgattgttcagatttttgcatatggtggtagcactggttaggtgtagttttgtggcatacagtaatcttgttgcatgcatcgtgtataggatggatcctggtacaacatatttgttgaaaatcaggctccaagggcatcatagtagagagaacttcacctataaaacagaggaggtggtagacagtgacaggacaaacttcaaggactttattgatgacattagggagaagtacccatggggggtgaatgaatttataacagtgaactactatgattcagtaaacaaaaactatcctcaagtgtgctcagaccaatgtatgctagaaatgtttgtcaagaatgccaccaccaaggaaatatctatgttgattcaagttcatagcaacaatgagccagttgtagctcttccacttgctgattggccaacacctgaaaagatagctagtgggacagtacataatgcggctgacatacatgaggtgccatccactccatctcttgcagtgccatctcaggctactatatctcagccta

SEQ ID NO: 70153 - DNA, 861 bp, Oryza sativa
attcctgcagcccatctcaatcgggccactttaaagcccatcaccgatgactcatatcggtgtcgggcttttgttgatggccgtgagagataacttttacttaggtcatttttctatataacttttttttgaacagttttgtcaacgggggatacccgtagaccggatatagagggtactagggtacgctggtacaatgatctacgtaatacgacatctagcagacagaaaacaaagattatactggttcaggccccttgatgggtaatagccctaatccagttgatatgggattatatgatggaaaccacagattacaaagggaatagcggaactcgatgataccgacgagatcgtaatcgatcaggttcgcttagatctcccggcgacttggctcctgtagacttcaactccataggctgtggtcgatgtgttggctatgagattcgatgccttaggtcctcctggggggtcccttttatatcgcaggtcaactggtctccaagtaggactcggagacatcggacccggcatgatacaatgatgacccagttctgtccgagtaggactccttccatctgtaaactccgcgatgaatttccttaacgtatgccgaaaacgtccgtatacgcgcaagtataccatatcgatatgtgacgtatatcgaagggtagagggtataccttacccataaccctgacagtagcccccgacttctgcttaaatgaactcgtgtaaccgatcatgacttctgatgtcgaggttgttgtcattctcggtgtgaggaccgagagacgaggagtaatcgacaacgccaagcgaagctcaacagtcacgagtgaatttaaattgaagtccgaa

SEQ ID NO: 70154 - DNA, 43094 bp, Oryza sativa
  unsure (1)..(43094): unsure at all n locations
caagcttgacaagagcaagttcgagcaacggctgcagctctgggcgctccgcatccaccgcgagctcgcctacgccgtcacccgactgctccgctcggggtaacttctctctcgctggtcgacgaatccacgatccaatccattcaagaaacggagagcatagccctaggattgtttgatgctattagtaggagcgaggggtagtgctgaaagctgagctgagcttgtcttcccccctgtttctaggtacctactggacaagccgcgggtgaagccagtcgtggaggatcccgagagcgacaagaaccggctcgtcgtgttgtcggagaagatccagaaccccggtatgcttttccctctgctctaaaatttgcaccaaatcgctcgactttgcaaagtagagcttgtcaattggacctcctgtatgtatgtttttcaggctgtgtttgttcttggtagcctgttcttatctggaattgtgaattagaactaagcaaatattgtgagttgctgtaaatatttgaatgccgtcaccaatacttgattgagtctagttagatccatttggttgctcatgtcttgagtaccatagtttaccatgcttgcttagcgccttttgatcgaaagaaaacttctctgttttagtgtttctaatctgtttcgcctctgttgaaagaatgcttacgcctggtttttggaatacagacctgtctgatattgaggagaaggtttacgattcactgaagcaaatttgcaacattgatgttgtaccttacagtttgacccttggttattcttactggagtgcaggtcggtttaccatctaattctctaagatcttatttctgttcttttgttgcagtgtgttacttaggcacattcaatcatgttttctttatgttatttcttgtgcaaagtagtagatggcaaattggtcttccaaatcaaggacttcttttcaaaagttccagttttctagttgtgaatgctactaatattctcttcttcatttgtgtaggaatgtaggattccatattgttaaagctattttgatgtgtagtgctgaatttcatttgttgggttttcatcccttttatttcctgtagatcatattctgaagcagatcttgcctgctggagtggaggtaccctcttcttttgaaacaattgttaagtatactaacttcgacagtgcttcctttctgttgtccctttccattttttggtggaaccttgttactaatagtaatttttatggtacatgcaggccatgttgcacatctgaacatacctgatgacttgcttccatacaaagatgtcatagcaaaggtcatctatgatgtaaggatatcttctcgagtaacttgctcaattcctgattcatcctttctaagtacacttaatatgatcaaagcacatgttcatgaacatgaagcatatctacaatttgtttctgaatgtaaaacagtaaggggctttagcaactctgattatagagagcaaccacaaatttacatttagcatgtggcttcatgcacaaaagaaagattctgcccatgattttactattgtaatgttcctaaatgtctgtcttgattgtcttgttttcatcctgtgagcagagaaccattcaactgtcacatggaaatagctaaaatagaattgcaacccatgatgtgtaagcaggaggcactgtaaaaaaacaatagacacatctagctattcactgtttgttctctaaagcagcaggattattcataactggcaagaatactatgtttgttcccattattcagataaaatatttttacatggttatatgcagaaaaattatccaaggattcagactgtggtaaataaagttgggaccattacaaacgagtttcgagttccgcagtttgaaatcttagcagggaaaaacgatatggtaactgaagtaaaacaatatggcgctacatttaaacttgattatggattagtctactggaattcgaggcttgagcatgaacacatcagattggtttcccttttcaagaaaggagatgttatatgtgacatgtttgctggtattggcccattttcgattccagctgcacagaaaggatgtattgtatatgcaaatgatttaaatccagacagtgttcgttatctaagaacaaatgcacagattaacaaggtggacgattatatatttacatataacatggatgccagagtgttcatgcaaaatttattggaagtgccttgttcagaaaataagtcagactctcaagttgctgctaattgttctagtgaagacattgaccctgctaatgaaagttcgacttcaaatggaaatcatagtggtatttttctttctctcctcctacatattgctttgttgcagattcgttcttcatacacatgatgaagctatccacttcctgaactcatgtagatgttcaagagagctgccataaggatataaatgactcatccatgataagcactgcgacaaaaaggcgtcaagaaagctcaaatggaggtaattacgtcatttattatgtctttaggaatcttgcaactcctatgtctgtcaatctactaagttaataacaactgtgataagcatgaagattttacctattatgttacttgtagtagagttacacttttacctctcctataggtgatgggtactgccaagaagatgctagtcatacaaagaagaggaacaacaaaagagtaaaaggctcaggaccaccacctgtcaagccatgggaacactttgaccatgtcgtaatgaatttacctgcttctgctctgcagtttcttggtaatgtttttgtacttttatcctctccatcaagcttttctgttacattctaatgatcacattatgtgctgggcaatttgttgggttacatgacatgctcacaagccatgttagtagtagaccattgataacatttctatactcaagacagcagtgttgtcctttttgttcttttgctaaaaacactagaactgaatcttcttcacagatacattttgattgctcaatgaagtccaaaacttaaccacagatccttcatctgtttgcaataaatttctgcaatactaaaatgatttagattaaccaatgataggcaattgtaggcactaggcaagtgacagcagggcataagcatatgggatctgtcatgcacaaataattatctttgaattttaaatttgtaacaaaaatgaccatcctatgaaaagccacacaaatagaggtgaaattttcttagaaagcagacattcataaaccatgcagtggcggaatactgttgaagcgggaaggtttcttttcttgtgaattgtgaagaccattccagattcaatggaataagtaactgtggataagtatcatacttggatgcatgtattgcaagttgccaagtttgttcctaggatttctacagtctgcatggaatgctaattttgtggcatttatacgacattttgtggcctaagtacgtgcagtatcaatctctagttcatccatgagaccatgactatatgttcttctcagaccctctgttggttttgaatttgttatatgatggggaatgctatttcaccaatttaggcccacattcttccactgatctgaaacctctttctccaaattttcaaacgaccaatttgaattgcaaaattttgcatgcctgtatttgtttgtcaacatgacattcactttcgccttcaaggtcattgttctgtgtcaaaatacatcattcatttcaatccactggcaattcaagatttgtctgctgatgggggagttctcttttctacataaagtacctttcgtttgtgttttaatttttataaactctgcataacttgccacgtgggcctggctcattcatagccataacatgtgtctgtaagttccaaacatgtagttgcactcttgtatttgtttgatgcatttgattctcatgttactaagtattgaactgttacagtttctctttgagtctttgttctagtccataattgtagatctgctgtgcagattgtttcagtggtcttgtccaaaagaaatactggaccggaccattaccttggatccactgttattgtttcatccgttcaagtgaatctgaagaattgatattatccgtaagtccatacctctttggctgtttctcaacatgagataaatcgcttttatatgctcttatatattttgcgaggcatttccagtttgttttaatggcccatttcccctttcaggaagcacaaaataaattgaatgcgaagatagcagagcccatattccatagggttcgtgatgttgcacctaacaaggtatcctctgtctcatataataagactaagattcatgtttattgtctgcaagattacatgcacaaatttctttattttgttgatcttaggatacagaaatctttttcatttgtttgagagcacaatgtatggcccaccgcccataatattttcctagcagaaactgtctcttggtgaatggtctttaagaactttgtggttagccaccaataatagtttttctagttttcctgcataatctgggaaagtaactaagcaatggatatttttttatgtttgttgctagttcttgtgacacctaatatattgtgttttatatttcttgcaggctatgttctgtttaagttttcagctacctagcgaatgtctcaaggatgaaactgaagatcacatacaatcagttgactgttagcctcttctatacagtactcttgaagttgtattagttttgcctgcagttttggaggttctataaaagaaatggcgatcatccgatgtctcctgccaagatggaacccagttgcatctcatggtgaaggggaatcaatgcgatatttttgtagactttaaggtgctttgcatggttgaaatcaattcggagccctatccgattcagaaatctgctgccgtaggtttgcatatctggttgcagggcttttcatgtctgcgctgcttctggattccaatgccttatcagttttttctagagtgtgggtggagttcatgtaaaacgggaaaggatagtagttcggaaaattatactgtccattatcgttgttctctgtatttttagttccagattaatcctattgtttacatcaatctcatggccgtttgccagtgtatttatgttcagcccattttcccttgtgcttgctaattacctctgttccaaaataagttaatctagcatggaatctgataacttatttgaggcggtatacaggctggtgtttgcctttcagtcttctttctgtactggtaatctctttctgtactggtaatctcggaagattaaacataagagcagagcctggagctcattttcagaaaaacttatatcagattgatcactgatggcatgggacggaagcagagtggctcaaatatgtcacagttgagcaggactaacgttaaacacaaaagctagcatacaagcagaaaacacaaggacatggcaaaacccaagaacacaggaggaggatcttctcctctggaacgaactcctcttcaagattcaaccaagatcagggacgatgaggtaatcctcctcgtcgtcggggagctcgacgcgggccttcttgctctggcggaagccggtgcccgcggtaaaggcggcggcggcggtcctggtcggcggcctgtagtacgccacgtcgttggccgcctgcgaagcgaagagctcggggacctccgccgtcgtccggccggcggcggtgccgcccttgggcgcctggttgtggaacaggtcgatgtcggcgaaccactccagctcctggaacccgagcggcggcgacgactccttctgcagctgcagtataatcacaaggcgtggttgcgccatgagaattgagaaagagggaacccaaagcatggcatggtggtttgatggtttcagtttgtgtaggtgcttgccttgtcgccggtctcgtagtcggagaactggaggagctcgtcgacggcccagccctgcggcaggaactgcggcgagggcgtgtcgacggcgacggtcggggccggctgctgatgatggtgatgatgctcggaggagcccatgggcggggcgtggtggtcggagtcatgggcgtcgctgccgccgtcgcagggcgaggcggaggcgaagccgacgcggatgccggtggcgaggtagcgctggtggttgccggagagcgtgccggggacgtggatgggctcgtcgcagtcgcggcagaagagcgcgcggtcctccacgcagaagatgaacgccgccttctcctggcacacgtcgcagcgcgggagcctcgccgagagcgcctccagcggcagccgctggtgcttcccggccagcttgttcgccgcgtgcacctccacgtcgcacgccgcgcacagcgccgccttgtccgcgcagcacaccaccgccgccgccgcgctctcgcacgcgtcgcactggatcttcatctcctcctcctcctccccaaccaagaacacaactcaagaacaagataagacagccgcaaaggtgtggctgcgcagctgcgtgctgcgcgtcggcaatggaaaacgagcggcagaagaaggggatccagaagcgcggctcggctagtggcgcatataaacccgtggcgcgagggagcacgcaaccgcgcggggcgcgagcaatcaaccaaccaaccaagcgagcgagcagcgcgcgaaacttgtggtggagaagaacttgtggacgcgagcgcgcggcggtggactactactagtctgcgcaagtcgcaactcgcaacggctttttttgccgcgatcgcgcagctgcgaagattttgatctcgatctctgctgactcgactggccgatacaagaagaatggagtagattagtaagattcacgataaaaaataatggaagcttatggctggctgtagctcgtgcagggcgcacaggggtcgcagcctaagcatggccacccattcgcgtgcatgcaaaattaatcaaatcagatcaaatcagattggcaatgtactcggtgttggtgtgcatactttgcatgttgcatcggtttctttaatctaggagtaaaatgcgctctagcgattaaattagttgtgaatttgtgatcgacgtttttgcattgtttttttaatatagggggagtatcatactgtagggattagattagtacgtgatcgatatttctatttcgggtggctatgacttactgaggaactagtagtggaaaattccttcaacttgaaccgagtgcatgatgcaactgtagttggtggtggactggtctgtgactctgtggtaagtacgtttaggaggattgcagttggggcgataaaccaagctggggtgatttaggttggtgctgggtcattattgcaaggattatcggtcagattggcggtgtccctgtcgtgataaatgatcaagtttctggcttttttaagcctccgctgaaaaaattatgaggttgtttctttttcgtcttgttatttttgtgtaagcgtatagtatatcagtttgtcagctattctgcattctttgccgacatgggatactgttagtgatctgttcctcaaaccacagttgctattgttaggttgtggacacgatccttctaatctccaacgctgtagtattactgtatgcaactcaacgctgtagtattactgcatgcaactgtacatgtacactagtacaaattcccagtggaccattgcttggctagctatcacgcatctgttctctaagcagcaacttgttaagatataaagcacgctcgtgaccacgaaaaaagccccctcttttcctgccaaaaagcccctctaatcacatcatcaagacatcaaccctgccggccgccaagttgctttcagtaagtttcagcgtttgtggctgtggatgatcgagttccttcggggagggagagatcgagatcgaataataatcccttacaactccttatccctttaattaacaacgtcaatatgttgaaccggttgtagtcctttcgttctaaaatataagaacttaaaatcggataagacattttctattactaccaacttggatacttggatagatagactatcaagattcatagtactagaaaattttccattcaatcttaggtcattatagtttggagatagcagcgtacggctccagctacgcccaccgccgtttggcctattctatttggaaattgctacatacgattggtgtgtacgacttgcatccgaccagtacttacccgctccttgctctagcccatatggagagtagctggctcgtactccctccgtcccaaaaaaagacaaactccagtttccgtgtccaatgtttgactgtccgtcttatttgaaaaaattatgaaaaaaattaaaaaaataagtcacgcataaagtattaatcatgttttatcatctaacaacaatgaaaatactaattataaaaaaaattcatataagacggacagtcaaacattggcacgagaatccacggtttgcttttttttgggacggagggaatatgaagtaaattgattgcagatacgacagggtcggataggggttgaataatagggtcggatgtatagcagtactcattctattttgcaaatttctgcatgtgatgtgaggcaggcagctcaacttggcagacgaccgtggtgaaaaatccgaccagtgtttagacttgtgtcactgtacagttggcttggattattgcaatgcaaagcctcgtcttttcaagtataaatcagcccggccatcacggcatcaatcacccagctagcgccaataggattagtttcggaaaaaaagaacccagcacagcaccaatcattcagagatcatatcattaaataagaagaggaaaaaaaagatcgagagccaacgccagccacacgtacactgcctggtagtagtacagtgcatgcaccaagctgacacagctcgctgctgtggcaggcgcagcaacagggagtagcgctagtggcaatggcaaaggccgaaacgggccggggagacgacacggtcacgagctccgcattcaatttgccgacgacgacgacgcgcgacgacgtacgagacgcgaccgctgagccgccgtgcgccactagctcgcccgatcccctctccctctcctgtctcgccgcctcctcgtcgccgccgccgccgggtttgcctcttgggcgctgggcctgatcacgagcaggcgcaggtgcatgcacgcctcctgtcgcgtcgcgagtctcgaggccgcgatccgcctgaaccggcaggtcaggcaggcggctccgctcgctcgctcgtggccgtggacgcacggcgagtccgctttcgctgcgtttgcagcgcattcatgtgcagaggtcgacatgggtttaggctgggacgaagagacaatgtcgacatggcttgtggcttgggtttttttttggctgtttggataatacgggggccatggaaaaagtgctggggcattttgctgttgtgtgtactgtgcagcgtgaattggatggcttgttaaatttttgacgtggaatgcggagtctcttttcttcttcggtcgggacggggcctttcatcgatcgttcacttttctatgttcctagacggggttgcaattgcatgtcaatgtttcgcacggctgataaatttgtggatgacaaatttagcgcaggtcagctgagccatcaggtggagtaggcatgtagcctagctagcgggagtaatcgtccaagaaaacgtacgtgagagatgagcgagagtaccacattcactttccaagatcgtttatctagtgtacgtgtcatattgagacacggttcaaaagcaagagcacacgtaagctatctatctggagtactgtaagctatggtcaaactatcataaccccgaatgtttcattaagtgatcgaaggatattagagatcgacattcatatttggtttgagtattatcttgccattgtccaagtatgtggactgtggtaaaccatccgaaaagtaccagttataaccaagtgtgttacaggtagtatgcacttatgcaaaattaggcaaaaaataggttaggtgagatttaagttctcattggttgctcatattctctaataagtcaacatgactaattagggaataaaaattaatttacaggtaaaacttttatatatgtgttattatcacttaaaagtcaatgtaaaaaaatacgttgaaaatatcttaaaatccacttcaaaattaaatttaaaaattcaaactttgatatatttttttggcttattagggtaaccaatggggctcaaggaggtataataattttaaggataaatttaagatctaattgttcgaacgctaactttaccacaagttaatttgtcaaaagtgtggcaacaaattattcataggtgtagcaaaatttagctacaaaatcctatctttctataaagttagcctactacatcctaaggctcaatatgtaaagatgcaacatcatccactaacatttactacatctcaaatctcatgcaagcatgctaatttattaatttttagagctttaaaatgcaagcatgtgaattaaattatcatcccacataattcacataatattttaatatatctctccatcaccttttataatatcctatatgcctatagttcatcctcacttaaattttatagctttaaaaaatccaagcatgttaaatcatcattccacataattctcaaaatatttcaatatatctctccatcattttgtataatatctatatacctatacaatttattcttatttagttaatgttatttctctcttctctcattaagccatatcacctcaattgcttctatccctcaaatgattaatctatggttggaattatctctcacattttcttctcttataaagccacatcatattacttttaaatttgggtcatcattctatatactgtttaaattatgataaactacatcaacttatgcaagtttctatcatctagctatcttacacattatttctattttttattagggaaaattggaaccatgccattatcatatcaatctcccacagctacgcgcggggtttcacctagttagcatataatatgtgagccaacaattaactgaattgtggctagtgtttgttaggcaagttcaaccaaacgctagcataacaaagggtagcgcacgtaacatgtggcgtggcaaaccgtgacagtgaaccgaatctcatttgaatgggatgattcttaatggagtttctcagaaattacaaagatttaaatgaaaatcatgtataaaattttatgccatacaaataagtagatgttaaagtttgaagcaccacattaacgctgagttcgataaaactttttggctagcctaatcaccaatgttctaaatctccggctaagcctcttaacggttgtgctctccaacagctaagagcggctatagcgggttatagctacaactaaggtatttagcagttttaaaaaatattaggggaaaaataaaaaaacttatagaatttgggctaaaatttgacatgtgactcactatttgattgcacatgttgctgctcgaggtgccgtaggagccgccaccgtcgccgcttgggggctggaccgtagaagccactgcagccacttgggggcaggaccactggagctgccgccatcaccacttggggcaagactacgttggagttgccgccatcaccacttggggcaagactacgttggagcagctgccgccgccgccgcttgggggcaagagagtaggagccgccgctgccaccgccagtcaccactgctgggggtaggagccaccatcaccgggagagcacaattctggagttgagactaaagaggagcctcgcacgagtagggggactagggagtgtgggggatttagggtttggttttgagctgaatttcgtggaccacgatgccaaaagcccattttcgcgggccatcgctaaatgctgtatctattttctgttagtttagcggctatctccggctaagcacaactattagcgcccaataaatcttagtgtcaaaactgaagtctcctagctgtcccctccctatccgctatctccggctatagtggcagtatagccagacatttagaacattgctaatcacccatacaaagcgagatggataattaagtattaactgttataaatttaataaatagattatttgatttttgtaaaaatatatatatatatacttcctccgtctcataatatagcaacttaaaactgaatgggtacaaatttgttgtactataaaatgtcctacattgttatattatgggacgaagggacgaagagagtatcatatttagcagtttggaaaacggtgtgagaaaacgagagtccgaatacttcagccgtcgcacgggcgcttgcgattgggctgcgcttcgatcttcgcggcccaatcacacagaaagcacaaagatgattgggccgttggaccgatgcgtgattgccatttcagcccgcacttcccaagggctccaagcccataacgcctgtctcacaaaacgagtagggccccacatgtcagtggccgtgagggagcacaacccgcatccggtaaaacccacccgtccccaacctctccgtccaatcccccaccgcgccgccgcatccgcctccgccgacgccggcgccgcccgtggtcttcctcccgcccgccgcgcgccgggagatcgatcgtcgcagctcaccggatatggcgtctcagccgcccgccctcgatatcctaggtactctttgcccccttcccacccttcgttttgcgccccccacgatctcttccgcgaggttggctacttagtacttacctagtctaccacccgtttgacgaattgctcgacccggggcaaccgcagtgcgcgagccggatggattcagcgtgtggtcgggcccgccttacccgacgggctccgccccgccggtgaggctcccgaagacggcgtgcagcgccacctacttctcgagcgacgggtcccgcctcctcgccacggtggcctcggcctcggccacggtctacgactgccggacgctctccgtcgtcaggtcgttcgagctcccgggcctcctcgccgccgcgctgtcgcccgcggggacgttcctgcagaccttccagaagtcgtcctcgccgcaggagaagaatgtcaccgtttggcatgtcgacaccgccaccgcgctctaccagcactaccagaagaatatgtctaaggccacgtggttcgttttactgcaactttgcttcttagaattatgattcttgaactcccatgcttaatattacaatctgatttgagagcttttagtatgtgcatgttttctggttgtgtcataaaatttttccgcatattatgcttgtagaactttgtaagaaggagcgtatattttctttagttgcttacattctagtgcatttgttgttgcaatcattttgtctatagtaatagcagtttgaaattataattgtaaatgaaccttgtcaatgctcatatgctactgcaagtttgtttctctttttatgcttctaatacaaaacttctgaagaaaataattctagtaagaaatttatcctatgcacacgatgctttgactggatactggttaaatttgttgatcctgaatttgtgagtgcagtattacttgtattataattctaaatggattaggtgaaaaatatgacctacagcagcctgagagaacttgtattcatgaatttgaccaaatctcgattgccaaatggtttgctgtgtttaaatttgatggaacatgtcatgttgattcacaggccaatggttcaattttctgcggatgagtcagttgcttgccgcatgatgactaatgagatacaattctttgatccaaaagatttcacaaaaggttttgtgtacaagctaagaatgcctggtatagctgctatgcagctagcaagtgcaccgggatctcatgttgctggatttgttcctgaggcaaaggtctgatttatcacaaccactttgatcatgctttcacaagacacaagtctcacaagctgattgtttttttatttccttttttctctttaagtagggtgttccagctagtgttcagatcttttcttgtgacaaggatgcacagggccaagctgttgcgcgtaggagtttttttcgctgttctactgttcaatttcactggaataaggggtccactgggcttctagttgttgctcaagctgatgtggataaaactaaccagagttactatggtgaaaccaagttgaactatttaacaactgatagggcctttgaaggaattgttcctctcagtaagtactaaattcatagatattgatgactgtttctctaatatctgatcattaagcccatcgttaactggcagaaaaggatggtccggtgcatgatgtgcagtggtcttactcaggttcagaatttgctgtggtctatggatgtatccttgcagtctcagtttttacatgcaatgcggtaattcaagtttaatatctcaaatactttgtgctccctttgtctccttggagtgttccttgacagaatctcagttatgccggccagagcaacaatattcaacaaaaaatgcaaccctcttctggagctcggtgaaggcccctacaatacaataagatggaacccaaaagggcgatgtatccttagcaataatttgatccagtagcctttgctgtgtggtctgctttgaagggaacacactctttataaaagttggtctgttactgttcaagtatagccatataaattttacaggtcagtcatgatttgcctggtgatatccttgacctcattttatcgaccagttatcgttttagcagggtttggtaatttgcctggtgacatggtatgttactacacgactaccatatttatatgagccttttacctttatatgggaaataccaccgttttcttgatatactcttttaggagacaatcttaaacaaactagaaaagctaaaaaaatgatttaatgttgctaggcgatttgcaaaatagccacagtgtaactgacagagtattttctgcctaggcattctgggattattcagaaaagaaattggtaggaaaaacaaaggctgaatgttctgttacgagtgaatggtcccctgatggtcgccattttatgactgctacaacagctccgagactccaaatagacaacgggtacattttttgcagcctttggagtattaatgaaaatgggtagcatcattgtgatctttatctttcctattacaggattaaaatatttgaccacaatggatctctgcagttcaagaagatgtttgaaaagctgtatcaggtatcaccgggcacctgttcacctcagtgtgaccagtttgttgtagacgtgcatgctatgttggttctgcatgctaactcctaagtcctaaacaatttgtaacgagttgataaaatatttccataatcacacacactccatccttgatttttctttttttttgaattacacaggctgactggaagccagaagcgcctgaaaaatttagtgacattgccgacctcacgatatcgttgggtagcataaaaattgaagaaacgaaaaaacaaggttctttacactttcttatattccatgttagtaagttctggtcaattgatttacatacttcattttctgtatagtttcagcacagggttctaaatcagcacaaccatcaagcaaggcccctgcaaatatagcagcgaaacctacagcatatcgaccacctcattcaaagaattctgcagatgttcaggataaggtatatattagagatcaattagtaagccgtgttagagttgcaacaaaaagaagtgtgcataaatcttgtttactatttgttgcatcgttgtgctgagtaaatccttggttatgctggctcaattgctgacttatagtttatacacatccaaggctgcaaaatccctatccaagcaaactgctgtggttttgtgcagaaacaagtagtattgtttgttggtcgcactcggccaaatatatttggctcctttttttccccgatgttttattggctctatttcaagttgttaaagaactcaaatttttgatattgtctattggcttaacacatttgtttggtgaattgcagctttttggtgggcttgcttctacggggttagtttcttgatcgataaattagttttcttgtcttgttttatgtaattatttttacctctatgcatgatcactaacattgcaactgggacagaggagagatgagcaaaaatgcactgagaaataagaagcgcagagagaaacagaaggagaagaaggctgctgaaggatccggagcctctgctgatgacaattaaatccacttctactcagtgaaatggtgtctcaatccagaaaaatggcattttgccatttgaaatgtaatcacgcgaatatgctgtcaaagtaacactgcctgggaaactgtccttgattccgcgcgattaatgcaccctgcttcttagatctgttgtttcttgatacaagaacggctcgaaattttgatagtttttgaagtttgaactgatggtttgtatgacaaaaccaaaagatactatcaaagctactcctttcatttcgttagtaactgatgattaatagaacttcactgacgatgtgaaaattggagaacagagaaatacgcatggtatcatgtgaaaattgatcaaggaatctttttcacgtggaatgatagtgaacttatttcggatgtacacgtctatggttagattcatatataaaagtgagcttattttagaatggggggatatcttattttgatgcctagtatagtcgacacgcgacaagaatgtataattcgtgttgagagaataagcactgtggtccgtactactcgttttacattgaagattatacatttggagccacgttgtcaagggtgacccattacattccaacgctaaggaaaccaaaccaaaatgcacaggaaccaagctacaccgcttgaacttcaacataatctacaatttgacgcatatgacatgagacatcaggtgattatatatgcgatgtcatcaacttcaaaacgggcatcatggttctgactaagattgtgcttaacagaactgttaaaattctgcttaacgatcaacggagaagcgatcactgccccgggcaaggaacgctatccagattccaggtcattgcaccagccatgaaaacagtactgctcatcgccacatccatgtgcttcagaaggccaaaaaggaacaagggagcacctgaactaagactcctgcgcatgcgggcgccaatttcctcggcagagttcctccataagatgaacaaacttttgaggctgttgccaccaagttggtttggaggtggctgctctttcatactggtcttcttgtgagccttcactttgcataaagctctctgagaaattgcgccatttttgcatggcacgtttcaaccgcgcagtacgcttgccagtaacaagatatctggtgtagtccctggcgaggcgatacagctcctcacctctgattatatggatgtactgcaatattacacaaatacaaattagtttcttaatatatatttagtgcctgttgtttattttgaagctacattacaccgactttttctgtgactacaccgagacttttatggaatacccagataatattgctcttaacagtgaaatggtgctctcagtctccagtttctatgcagtttcaatgcatgtagcaagtcttttagtgcattgaccatggagctatctacaggtaagttgtttcgacattacagtatgtcgttaatagttaagctaatcataataagatacttggaaagcaggactatgctacaaattggggtaaaagtgaaagtgtcagaagaaataacattcggaaagagagtacaaacaagaatgtaacgttagttaccacaagaatgaatgcaacggttgctaagataacttggactagttcatccaatgattccttgaatgattcatcttctgggccaccagaatcaccactgcctccacgacgatttcggtttcctccacctccaccagatccttgttctctcagcttagctatctgttctttcagcaagtcttgaataggccgtggctttttggcatcatccatggccttcttcaaagattccataaagggctgcaacaaggcaatatacatgcattgttaagcagataattctgcaaagcaagtgcaatgctaacagaaattaaatctatgtaaaaattgtaaatgcatgtttctagcaaaaaaaaagtgtagtgcaataaactggaaatgcataaccatctctccatataaacttatgtattttgtttcagtatgctagagtactgtttcaatatgaatagcaaactaggacgtctcaaataaataagatgggccaacagatgctcagatccagtaatgaagtactccctccgtcccatcccctcctaggttgaggttttttggaacggagggagtaagtaattgtcacattcagaaaaagattatgctcacgtaaatatgagccacaactacattgacttcacttaaggtcttacaagatgacaagagattgagagtttaaccaatacaggtatcaagagatataaaatagaaggaaacaacagtttgataggcagaagtttgttttgggagaagatggagcacatatgaaaaaaaaagaaaaagaaaaggggttgagcaaattgatactacaaaaattgcaattatcaaatcagaccatatgttccatgctccatcatacattcatgcacaaaaaggacatgccagagacttacatcattttctgcctctgggttcacctttccactcgaggcacatagaggaggaagctttttctggctagcagcaacaagaacaagtcgcgggtacacctgcttttgaagcttgggaaatcgaacagaatgtgtcgttagggaatattgaggatgagatagtaatctgcctgtcctcccaagaccagcgacgggcctatccacaataagcccactgttcggcttgcaagtgaagtagctcatgcttttctatttcttgaatagttagatgcaccagatcctagcctgcaaatttttcaggcagcataagaacttctcatgaattacagagaagtgctaatctatcggaagatacagaaactaacatagttcaatcgtgtcgagtggaaacatagtgaattttataatagaaaaaagggaatgctgggctccccaactccctctataaagcattaagcgatgaatatctacttatatataccaaatattgcaatgtagactttctaaaaaaacagatgaatttgaacccttctgtctaatcatacacatccccttccatataatgaggtaaggagattgtccagtgtgacatttgcaagcaagtcataaatactaactaacctgtgtacccaaccatccaatatggaaatcacataaaataagtgacgtcttattgaaaataagactgttataggagtaaatagaactctacaatagaaatgttgtcatgagaaaaactctggttactggacatgaggacacaaaactacaatactaatcacataatcccatcaactcattggtgccaaaactatgccacaaatcacaagcagaatgccagaccacatgcattcaacatgttggaatggacggcacaatgcacctgtctttcttgctatttcacacagagggacaccggacacggaaaatcacacctttttttcccaagcaagtccaactcaagaaccaaacttaagctgagggggtaaaccacagcgcaaggcaagcatctacctccaccaagaaagcaccgccaaataacgaattgaattggtgcaggttacctcgaacaccaacggtgatggatacgtattccgtaaggtggttcatggcggtggacggcaggcggcgaggcgggggtgcggggttggtggttggacgggcgaggcggggtttccaagaaggcgggtgacgaggagaagacgaatcggaataccaaactagcttctcctctcgctatccccacaattccaaaactatccccacaattccaaaacgagcgaacgcatcctacccacaaagaggcacaaaccaggaaccttcccggcggcggcgacgacgaccaccgtccggagttaggaatcgggctgggcagtgtgggggtgggcgaggagaggagtttccggtatgtaaagggattccggggcagcacgccggaccgcctccgccgccggcgcggcggagctggctgggggccggcaaggatcgtggcgcgcggagaagaaacacgacgcggagattgaccggcgaggaggaggaggaggaataatacgaggagggtaacagggattaccggagaggacgaccgcgtcggcgccggcggcggccgggcggtggtggtcgtcggggttcgatgtgcgcgtcgaaccggggaggggggaggagaaaggaggacggaagggataagaatcgagatgcattgtatttttagatgggtcgcacccgttaggaaaccggtgagccttcaccttgggccccactttttacagcccgtgggccgtggcgcgtcttctccaacgtgacaaaggaccatgggctttaataacgggccgtcttttatgggccacctattccaattgccaaagatggcctaaatgcaaacagatgaacaatgaaaatgagatggagcgatggatgtaccagggttccaaaaacgaataccacgcccgagtggtcgttaacgatgaaaactggtaagatttggatgcattttgccggaaatttgaatttcagtttaaactctttcgaaacctgtgagtttacaaggtggtttctggatttaccatggcatttttaaacccgatggagaccctgtgcgaactgacagtaatagggctggaaccggacatagcaatggcaacacgcgtctcatgaaaccagaagagcaagagcaatcgatggctttgcaatttttcttttcctctgcacatggtgctctcgtctcatcgagacaaggggagaatttcgtcgccgtgatcaacttgcatgaattttcgctgacaaaaaaaatgccgtgagcgtacaaaaatccccctcctattttcgccctgcacggaacgggttgccctctcccgcgcgcgcgcggctcttccgccgcgccgcgcgctgcaacggagctcacctcatgtgcgcgtccgatcctcgcatcgcgtacgcacgcacggcacacatgaagtcggcaaagttcaacgtcgatggctacgtcgcgcgcagcaaacacctgcgacgacgtttctacttctagatgcccatatccactagttcgtcctgcctacgaaatatatccagtaggagtgaaccaacggcacgcacatgagcaatttagtccacacaagtggacgcggttcggttcggccaccatccaaccggaacgtgcagatgccggcgtacgtacgtggacgtcaacgcatttgaaccggtcctcgtttgaacaatctcgcgcccaaagtcagaccatgcatttgccggtcgttatcgattgtcctcaactcctcatccatgcatcgcctgtcagctctataaagccacacgagccaccggaagcttgacatcacaattaaagtcacagcatagtaaccaaccgaaccaatcatcagccatggcgcgaaggctctcgctgctggccgtcgtgctggcgatggtggcggccgtgtcggcgagcacggcggcggcgcaaagctgcgggtgcgcgtcggaccagtgctgcagcaagtgggggttctgcggcaccggcagcgactactgcggcacggggtgccaggcgggcccctgcgacgtgccggccaccaacgacgtgtccgtggcgagcatcgtcacgccggagttcttcgcggcgctcgtcgcccaggccgacgacggctgcgccgccaagggcttctacacccgcgacgccttcctcaccgccgccggtggctacccttccttcggccgcaccggctccgtcgacgactccaagcgcgagatcgccgccttcttcgcccacgccaaccacgagaccataagtaagcagaaacaccaaaaaaaaaacatacagtataatactaccagtagagaccacggtatacctaacatgacgataacgttgttgcagagttctgctacatcgaggagatcgacggaccgagcaagaactactgcgacgagacgagcacgcagtggccgtgcatggcggggaaggggtactacgggcgcgggccgctgcagatctcgtggaacttcaactacgggccggcggggcagagcatcgggttcgacgggctgggcgacccggacgcggtggcgaggagccccgtgctggcgttccagacggcgctctggtactggaccaacaacgtgcacgacgccttcgtctccggccaggggttcggcgccaccatccgcgccatcaacggcgcgctcgagtgcgacggcaagaaccccaccgccgtcagcaaccgcgtcgcctactaccagcagttctgccagcagttcggcgtcgaccccggcagcaacctcacctgctaattacagggattgacatatgctatgtatgtgattttgtacgaataataattgtcataagtaatcaaataaaatcgtattgcattacgtcaacgttgtttgcggcataggagtatatatatttccgtggacagattttctttgtcgtctcagtcaaattttgtggctcctgaatattttcacgtgacttgtttgtttgtttgttgtgtttttggatatttctccgccatgcaagatcttttcgttggggaagctgtcttaatctgtttgaaccgagtcaccgagagtgtgcagcaagtatacgatggaaagtaagtatgactagtaagaagcttaagtcgtgtacaataaatacttgagatacttttgtgtcatatatatgtttaactatttacgatggccatcacccatatttgcaatttttgagagtattctagtatgttaataagctcaatatatagtatgttaactatgcacgaactgcatcgcaagaataaaagtggagtaatttttaagattaactttaaaaaagcttatgataaggttaaatggccttttgttcaacagacttaactttaaaaaagcttatgataaggttaaatggccttttgttcaacagactttgaggatgaaaggtttactcctaaatggtgtcagtggatagcttcttttatacaggggggtcatgtgggtattaaagttaatgatcaaattggtaataactttcaaactttaaaaggtcttaggcaaggggatcctttatctccaattctctttaatttagtagttgatatgcttgcattgctaattaagagagctaaagatgctagttttataaatggggtgattccttatttagtggatgatggtttatctattttgcaatatacggatgatactatcatttttctggagcatgatttacagcaagcaaagaatctgaaactgattttatctgtgtttgaaaagctatctggcttgaaaataaattttcacaaaagtgaattattttgttttggtcaagcaaagaattattatgatcaatactctagtatctttggttgtaagctgggtgcttttcctgtaaaatatcttggtattcctatacattttagaaagcttagtaacaaagactggaaagttattgaagaaagaattgagaaaaaacttagtagttaaaaaagtaagcatatgtctgttaggggtagattagtgttaattaattatgtactttcaagtttagctatgtttatgatttctttttttaggttcccaaaggggttcttcagaaaatagattattataaattacgcttcttttgacaaggggatgatcataagaaaaagtacagacttactagatgggatattatttgccaacccaaagatcaaggcggcttgggggttcataacctggaaattcaaaacaaatgcttgttgagtaaatggttatttaagttaataaatgaagaaggggtttggcaagacttgttgaagagaaaatatctttataataagtctataacccaagttgttaggaaagaaggtgattcccatttttgatccggtctaatgaaagttaaggatactttcttgaatatgagtttttggattcatgaataatagggaacaaataagattttgggaagataaatggttaggtaacttgccttttaaagataagtatccttccttgtataccattatccaaaggaaatgttcttcaattgctagtgttatgagttctgttcctcttaatgtgtcttttaggagagcattagtgggtcagaatcttgtttcttggcatgatttgtgtgcttctattgttcatatccaattgaatcactcatctaattgttttaaatagaactttaatcagaatggtatgttcacggtaaggtcaatgtatcttgctttaattaataatagctatattgagagaaacaagataatttggaagctcaagatgccgcttaaaattaagatctttatgtggtatttgcttaaaggtgtcgtgttaactaaagacaatctagcaagacggaattggaatggtagtttgagatgttgtttctgcatgaaaaatgaatctatccaacatctttttatagattgtcattatgcaaagtttttatggagagcagtccaattctcttttctttataccttcctagtagtataacccacattttttatggttggcttttggggtagacaagaaaaggagtaagcttgtacttgtaggagcttctgcaatatgttgggctctgtggttgagcaggaatgatttggtttttgataaatcaccatccatttcttataggcaggtaattttcagggcaacatattggctctgatactgggcgcaactacaaaagtttgaagaagacagagagtttataaaatttacatgttgcaagcttgagacgacaattatgcaactttttgtcaattatagttggagattcacaaatagacttcaataatgtgttctccttattttagtttcgttacttattttgttcatggggtgttctcaatgatttgttgaactacactcttgtttgagtgctaatatgcaataattggctgtagttctcttgagcaaagaccgggatgttatattccattatctaaagaaaaattcgtatatcattcctacaattataaggctataatctacaatttctctatatgtattttgttagttgtggggtgtttggttgcatccacgaagcctgactcacattaggccatataaaatagtcatgcactagcccgcgagctaggacgagacgatgcaaaagtgtcctcccagctacgctgagcataaaggtaggagtcgagtattagagtgcgcagcccggcccacatattatgggccacccatgtcacattgggtctactccaccacaggtctatcggagtcacaactttaggtcttaggcttacacaacacaaagtctttcgggttgtgtaggcccatgacctaaagttgtgactccggttagacctgtggtggagcaggtccaatatgacatcggtggcccacaatagatgggctaggcaacgcactctaacatcgagcttcacaactcatcttgccccgcttgatgcagcgcgctacatccgcgcgtgcatcaggtgcatgagacgctcgatgagatcaccaccccgccctttcccccttcctcgtccctggacagagagcgaagccagaggtgatggcttggcgatgagctcgacggaaggaacgatgatgggcacggcagagggcacctttctatccatggccgtctcgcaccttcttccgccgccatccccaacatgacggtgatttagttatacagtgaaaaccataccatgctagttttaccttttctacaataggaatggacaatttttcagtgatatatattcgatgttgtagtattgtaaaagctgatgtgtttccttaccattgtattaagatatgtcacattcacttaaaatctcttatattttgggacggagggagtaattcactatcatgttcaatcgagctagaactagagttattatcagaggaaagaatttgtaaaaaaaaaaaaaaaattggcccaataactcgagcccagaaaattcagcgcattcaaatgggccatggaagagggaatgtcgaaatggcccaactcgaattcagaatagagcgccggtcgctgctcgaaatgaacactgagccaaggctattttatttgaacttgcgttcaccggccggttaactttgctttcctactgttaatttgtgctattatggcagcttatctacatgcatgtctaatgtcaactttgaaagtgcaacaagcatttcgtgagcaggaatctcctgctcctcaacatacggccccaaccaaacaacaaccccaagttatctgctagttgtcggttgtcgcgttaacttcggctagcttttgccggtgaattcctgccaagaagaaataggtgccaaatttaaaggtcgaccctatatagcaatagcataaagttactactactaaaacgtgttaataagtttttcttttttctaaaaaaaaatacgtacttcctccgtttcacaatgtaattcattctagtatttttcacattaatattgatactaatgaatctagatagatatatatgtctagattcattggcatcaatataaatgtgtgaaatgctaaaatgacttacattataaaacggaggaagtactatatatatgtcgagtgaaacgaaatataatgcatgttaaaaacagaacaaagatggatctggcatcacaattactccaataggcaaggtaaccttaagcttctcacattgttccagcagaaaaaagcagctggatcactacaaaaaggaagagaagcaattgaaaccgaagaaaaaaaaagaaaaaaaaaaggaaaaacgacagaacccgatcaggacgacaggacagcttcttccaaatgcacgaaaccatggggaaaaaacctcttcgtgcaaagggagctctcttatcttcgccccttgcacgtacatacatacgcatgcacgcacgtctcatctccagcttaattagctagtgaccggggcctttctggctcggcccggccgggagctgcgccgtccacgccatgaccgtcgtcgtcgacctcgccggcgacctctcacgcagcgtggcgtacgccgccgcgtcctggctctggactaacgccggcgccgcccggcggccaccgtcgtcagctgctggccgcagctgcctcgcggcgtcgacggtggcggcgcactgcagcgccgccacggcgaacagcaagcagaggaagacgaagacggacgccgacgtcgtcgtcgtccgtgctgccgccgactccatagctctgcatgcaccaaagcaatgcaactaattaactgttccggctactatagcgccgaacgctactttggccttgcagttacacacaaggtcacactgtcactatcacagatatatgaactactccggtattgattttgtttgattgcggagtggagtagaccattaatttagatctgttataaaaactcgagtgttttgtcggcatacaacggttctgtgatccgtgagttcgcccgtattaattgtagcgcgaaaacaaaaccgggggaggatgccaactcccctcatcttttcacgagagcaaagtctgaggcacatgcatggcgatcgagtacatgaaaccaaggctacagatttcgtgcctattaaaatgcacactgccgtttcaaccaaactaaacgagctagagtagtagctacagcgagtgtgtctgggttgtctgcgtgtccagttgcagggctcgctgtagattcggagcacatatagtagctgcagtacggttggacactgtagaggtcgtcggcggcgacggcgccgggatcgaaggaaatcacgcgaccgcgcggtcgtcgtcgtcgttgcacctagctgcatatgcttgcactgtttgcacagtacgtacgtacacttgcagcgcagtagttgcatccgcgcggcgccacggagttggccgagcgcgaacacgggcaagctaggcggcgtagtgtacgagcggttcgtcgtcgtcgcggctcggaggacgggggattttgttagtttacggcgcccgacgacgggactagctaggggcctagggaggtgtggcttttctccggccggagcagagcacgaggaggacgcagattacgcatttcgtgccgcgatacaataccggaattaactaacccgtacacgcgcatggcgcatatgggccattttcacgtgggggcccggtttgccgttgaccaccttgcgcccgtgcacatggccccgcataggtggtggtctattagtttgattgttttttaggttctcaaaacgccgcatgagctagcaccgtattattttatacgcctgtactctgctcgtcgttactgttaacgggtttcgttttggaacacgaacagtcaaactaaaagaaagacaaacaaatgagtcttcaagaattgaaaaataaattaaaaacggagtttggaccatggatggatgacaatgtcgaggatggccaaattaatagatctgccatctactatctccggtttcattttaatgacgctttggacaatgacatactctacaagatatacctttgaccttatttttctattataatatatacaataaataaatgcatgtttatttttattatagtgttttgaaagaaaaatctatatatgtttttctagtttctttaaactaaatatattcaaagttaatgatggtcaaagttataaaagtttaatctcaaccttgttcaaaacattaattaatatagcaccagaggtcataaaaattagtgcggtccattttcttgaaaaatgcagggcctcttaaatacggttgatcagctgtttagaaatataatatcgtatgataccgtctttgcatttaaaatatgtaacatatagaagtaggaaattactatgcatatgacccaaccatataacttacgtatgattaaatttgatcaacggtttcctttagttaatctatggctgcatgttagagtcgtacgtctagcagaagtaatagcgaagcttcagacgcttatgacaaactaggactgattaagttacggctaagtcgtagaaatacgaacaagaaaaaaaatagtttatgataaaaaaatatcttacggtgttattattagagcaggtataataataggcttttagccagctataaacatattttaatgagataaacgataagagagaagagcagcaggctacagatttgtaaccagctgtagcacagactccaatacacaatatgtgtatgacaggtgataccatatgttaatattatagtaaacaactattgtatgaattgactattagattggctatagataaattggagctagtagtggactatattattaaacttgctcttagcgacttagaaaacaaaatatgataaaaagaaaactgctcaacgctaatctttaaaagttaaaatttggctaggacgggcctgccgacgagagttgaaaacgaaagcgtaagagtaagaccaggattatatatccaagtggaaacgttcggcaagttaacggtgagctccgtttccgcgtccggctggcggtgcgagggcagccgagaagagaaggtacggtcacagggccactcacgcacatggctgatcatctccactcacatccctctttgtgatggtacgccgcatgccaacttgccaagctgctcaagcagtccaactttgacctgcagccatccgcaccgatctgcctcagatttgcaacgcgtgcagtataagttcattttaggtccagccactgagtctgaaattcatctctggaccaaaataataacatatataacacatcttttaactttaaaaccaatataaacttgatcccaaaatagcttggatgacggttttcgactgacgtggtgtttatgtggtacacttgtacttacaatcataagaaatggtgagacccacatatcaataggggtgtaagtggctaacccgcgaaacctatttataggttaaaataagccgcgaactcgcttattttgacctataagtgggtttacggctgacccacttacacccctacatatcaatgagtatccggttaaaataaaataaaaaatttacaatggaacttaccgtcaaattaaaggatctaaagtgaacttattcctaatgcgtggccacgcgtgttgggccagtcggattattcccacccccacattaacacataacatacaccccttacacagttacacttgtcattttgcagttgcattgacaaaatcaagcggataatgagctaacaagcattgcgagaacgatatgcgggcatattatagggtgaccaaagcctgtccgtccgtattctaacttgtgaagttgtgattctgtgactatatacagtttacagcatgcagttataaagcgtgtgttcttggccgtgaaccttctgatcatgttagacgctgaactgctgctgctgctgctgctgctatcagcattctggcaaacctgtcagcatgattgcagacgctcatgttatgcgaaaaatgttctgttaccacttaccaagaacgaacagattggtccaagtgtaatatctaatttgtgagggttctgtatatagatcttcaggatgttacaattcttctatttgttggtgcgtaccactgtatcatatttgttcaccccacggctctagtgtcacagaccgatcgcgcttctctgactttacatatttgttcaccccacggctccagtgtcacagaccgatcgcgcttctctgacgtaaagtcagagggacgtatgttactgatgggtggacccaacctttatgggtcccacatgtcagtgataaagtctctttgaagtaagactcatctgtcacggacagcttgtacatctgaatcatggtttcagaggtagaaatgtaaagctacaaattgcattcaacgtcctaatttggtatttaagaattttcatggattttaatgtttaattctacgattcaatctggaatgcaagaattagctagtcagagggaatatgcctcctatgagttaaacgtatcctcaagtgtccacagtggctaaatatatcaggaaatcaggctatgtgaaaattcccatcccttctttaccggatgtatcatgtaccaccccgattcaccgaatgaacaaatgggtttcaagaggagaggatatcttcaaatttaaatttggatgatctgagacataccacaactctttaacacaattttggttgtacatgatcagcatcaactagaatcctaacttcacgtagctattacatcagttccatgttcattggtggtagtgcaaatggatatactcaggaaataagcatctttcccacatgaacctctgaannnnnnnnnnnnnnnnnnnnnnnnatgctaaaaccctcgaccatgtgtctagcgtcgatgccgacggtcgtcacgcctgcagtgacagaaaatcaaagtcagatgcacttcaccagaactctgagcagtgctaagtaagaagagtttttgttctataataacaaaaaaaaagacatacgaaaattacacatttgctgggtaccttgactagaaaatttaattaattcatataatacataatgcacagaatggaagttagtattgaactctacacaaatatatacatcccaatattttcctgaagaacatataacactttgatctctgaagaacatatttctatatttttcctgagaaattttgaattatcataatgaacctggtgccttcagttgacttactttgttttagcgcggtagtaaaatataacagaaattaattttgcataattccaactttatctgataagcaaattaagtaaatgtaagcatacccgtatcgatcatagtctctggaacggtccctaggggagcgtgaccttcggtagccccttgaatcataactatgggatctccctgattctctgtccttgtccgacctactttctctgtcatggtatcgatcatggcttctcctgcggtcataatccctgtccctatcacggctgctgcctcgatctcctctatggcgatccttgctagatgctctgtcacgttccaggctcctgtccctggacctagttatattagagaaaattggaacgtttttagtgccacacatatgaaagaattttgttttgctattaatcttagttttcttaagaattctaaaatatagagtaccttctttcatgctcagctcggtctatcttgcgccttttgtttttctcttcctgtacacattttaagcattaaaaaaaaaaccacatcttcatctccaataaaaagcacattcaggaacaaacaaaaaaggttaattatacatatccatgttagccaaaacctcgtaaaagacaaccaattctccaggcaaatcttgtttgtagtgcaagttaacttctctgctaatttcttatctacttagtagcttagtcagttgatcagttatcatgccctctctattctctctctttgtgacttgacgtttgaacctttggatcctctgaactatattttagacttattttattattaatatctgttttccagtaggacaatcctactgttcccataaaaaggcccttgtctaacatgcaaccccaccggacttagctccattcaaaatagcacaatttcgaaaaacctcacctgcagttcggataacttctcacgtatcagcatataacccatatgaagtttccctccaaaatgatctgccaaacgccggtcactgtttggaagaaaattgtaagctaagatattaattgtaaacaacacgcatgctattatgtaaaagattgtgataatttattagaattcttaacaagatatctataatccacaaggataaacatgtataaaataaacacgcacattctttagctgcaaaagtaatcctcgaaaaagtggacccaaaagcctgctggtgaaaaggagttacaggtgttcgtcaaaagctgaagcacttgaaaccccaaaattctcgtacattcatgacccccatgcagaaattgatggtgaagttaaaaaggataaatttacctgtcatatacgctcaagaatgctccacatatgtcacacaggcgcaacttttgatcagtctaaacagagattgaaaaataaaaatcatcaatataaaagcatcacaacaaaatgcatccacagttcaacacagtgataatttcttggagtgaaaacaaaacaactaaatatatcaattttttatgtgcactgcaatgagcgattcaccacacttacaatctgaacgtgagttgacatctttgcagagtccggaacaggctgtggccgagcaccaagctgtttaaacatgacaacagaacacataagagagatatggaacactattcctttgataacgaccatagaggatttattcctaaatttctaatcagttgcaccaacaaaattaaaagccaaggtcgatcaccttctttagagcttctgcttcatccaaaagtttctgagcttcatcgatcattccattctcacctgttcaatatggaagctagaaattaatgaatttttgtatattaacgatgaacagaagacaatgagccatgtgctttggtagttcaaggaaggaatatatagggagcatgattaaaaaaaatcaaacctagttcttctgcctttttgagtttttcatcaatcatttcttgtgtgcgtgcatctggagcagcagcaacaggtggtggtggaattgattgattagcagtttggagtgaagtcattagtgagacacggtccttattaaaagcttcaagtagatgctttgcctgaaagggtatgaaaagttatacaaacactaatatgcctgtaatcttccggtggcaaaccattgtatataaagcaatatgatggcaataaatttagtcatataaaaatatgaagtcctcgcactacacaaactccattgtggtacacatatttcatgatcattgatcacagggacaatacctgctcttcagccctctgttccttgagcttgtcaacctcttcagtagcccgaattttgccctcagtgtttccctcaagatctagaggaagagacagttgatacaatcaaactcaagagaacaaaaggagttgttttatgtagtgtactcggaaattattcacaacggcaggcaaagttagaaagattgagtaacaaagagtcaaagatttaagaaacaaaatagcgagggggaaaagcaaaaaatatttgagaaagaattggttaatttttcctaaatcaatactatcccattaggcacaataaagaataatttgataaattatgaaaaaaaatataaagcattcattttgattacggaggtcaaatttccatacttttatcatgatttcagcaattgtatgaatgtaaaacattcttaggatcatttttagtttagttccttcgacttcgcttatttaaaaaactccattgattaaacacaattaggcagaagccaatttggtccatgcaaaaagccaaacacatatttttccgaatatcttctttgtctagagacatttccttgttgaatgagataaagagttaaagcgaatatgtcatgaacatgatgcatcattctctctaattgaataattttcaggagaaaatattaataaagatatggtcaattcaagtggataggatgtggccatgatggaatttcaaacaaaacaaaggtaaacatcagatttaccaaaagcatcaatctccttcatcttctccttgatttgtttggagaactcaatcacttctttactctgcatttgtacatacatattgcaacttagtttatctccacagtcgtgggacccaaggagaactaactattataaaggaatatacctgtgtgacttcagtgatggaaattgctatagctgccttggcatcgtcctcctctagacgtttaagggctctctgaatcttcctttcacactccgatattagtctttctatagtttcttccaattcacggtcataattgtccatacctttggctttcgcttcttcatatctattactaagttcaggaaacaaatagaacagagctcttgcactcaatagcaaacatacagtacagactagcatgtgtcacaggtttaccaataagaacagccgaacaggccaaacactttctatgggttctggttttgagaataaccatactaaatctaaacttttaccaataattcctcaagaatcttctatttttctcaagttgacctcgaatcatttaattttggcaagaaaagaaaagggtaacatgtgactgaagccaaaaaggaaaaatattcacagctggcatgatctaacgcttaaaagaatgccggttcttgtcaccaggcactggcaggcactaaaatagaattacatcactaatattattcataacgtaaatctttcagaatgtaaaccttatacaccaaattgttgtagcatactcaagcatcacaacagttaatgttagcaataagtaaacacaatcaactccataaatatagatgccacatggcccacatctaaaaaaatttagaagtaccaaaagttactaaatatgcgttgaaggccatcctagccgaacaaatcgcagaccaaacatcccacaccatcgataaaatgtctaattcgtcgctctcgccttagaaccacctcggctgagcactccgcttctccgattcaaactaaaccgtcaagcaggttgcatggcacaaatctatttctattcacacacaaaatctaactgaaacatactaaaccctagttaccctacatgaataatttgaaggggatctccaaggatactccttgcgcagctgcagcgagtgcatcttcgggcatggccccatgtccatcttctgcaaaaaaacaaaacaacgcaggcgcacatcagccacgcgataaccgaatccgatggatggagtggggatataggagggggctccgccgcgaggggatcgagagtagcacggggaacgcacggtgagctggaacaggtcgtgggggcagaggccggcgaggaagaggcggcagacgtcgcggtcgtagtacttgcggctgacctcccgcacgtcgccgttgcggttggcgcccatgagctggtcgagctgcttccggatcgcgtccatggcgcaccgtcgcccccacgccccgtcgcccccgccggcgctgcccctcccctttgctagggttttgcttggctcgaggcggggctggttggttggttggtttggtgggcggcggtgccggaggaagaagaagaagacggctaagcacacccccacacaccgtgccgtatccattttcgctccacgggccgtcggatcgacgatgcacggtccagatgggctggatgggctacagaaggacggccacgcggcccatgagtccattgatgacctgttctttccttcctcctcttctcgtgggccttcttctctctccccctccccgtggcgctgacgcgacgcgctctcctccggcgaggtctctgactctccagcgctgcgcggcgccgtatcgccggccgcgaactcgaggctgggctgggcgggcgtatcgttcctgctcccggaggtaaccaccctcccctcctccgcatcctctcgacggcgcgtagccttctgtccgcctctcgtttccggcgtcgcttcgcttaccagttgctaggatcctcgaggtgtgcggcggtgttcccgtttcgtccgatgcgccgattgagtcttcgattgctattatcataggagatggattgtttcgtccagttttcaacttccgttttttggctccttgcatcgttggtgttgtgttgttatttggtactcgctactccgtatcccagtgtctccacattttcgttggcgttgtgcaaagcaatcatgtcaaatgtgtgggatgtgaagtgctagattgccaaatatctcattcagttctagatttttccaatgaccaattcatatatttgtatattggagtaattgggtttgattgtgctatagcctattgcctatagtagttggaattggttttgttgtgcatggactgtattgctggcagtggcattattgatctctagatagttgattcatatgaaacgcttctgactaggcgatgtgcagcccaattgtgagccacgtctagaagccatttaggtgttgtttgaacagtgacgcatctttggagaaccttacctgcataagttttaggcttcattgctttgaaaattttatgtatgttctttataagaatgcatgagcatatactagactaagtacataaatggtttgcttcattggaccttttcagaagactgttatgatgatttgaactactgcttggtattacaatggagaaccttgaatgcacagttgggaaagatggcttaaattttcagtgcaacctgtgtgattcagatgtagtgcattccatggcagaaatcctgcttcgtggattggcaactgcctcagttgacagcactactggtgatatcttcaagagcccatcttctgtagctgttggaatgaagagcgagctagcagaatatttgattcaggggtccatgacgcttgttcgtgaggctgtcgacggaggcgaggatcactcagaacaattaataaaagcatccaccatgccgacggagttcctctcagacttgatcgatggttttgtagcatcaaaacggaacttgttgagccatgtgtctgggtttttgtctagcgaaacccgcttgaacaaaattaaagacttcatacagaagctggagatggagaacttctgggcaccagatgttagagaggctactgcagggactattcttaagagtatagacatgaaatgcattatccattgccctgagagatttgacacacaagataagctggctgaacacaggaatctgtgtagatttaggatagtaaactgcaaaaatgatggatgtttagcttccttttctgctaatcacattgagaagcatgactctgtctgcccattcaaagtcctaccatgtgagcagttgtgcgagcagcatgttatgcggtgtgagatggacaggcattgtgcatcagtttgccctatgaagcttattaactgccctttttaccaggttggctgtgaatcagcctttccgcagtgtgttcttgataagcattgttcagagcgccttcaaatccatctgatgtatattcttgaactaactacaagacatgatgcttttgttaatgatatgaatcaacgattacacctccttgagaaggttagtattatttgtactgtaccctttgaagccatatttgaactatgcttatagcttaccctcctttcctatttagcttgatatctgctcagtgtaagattagagaataaaggattaacaattattcaagtattcaactcaacagctagaagcagtatgtaattgtagaactaatgaaataatacccatggtttatcggaaggcaacccaggacaatcgaagtatggaataccttttttcactcgttttgttggaggactgcattgaatttcattgacttgagacagagaatgagtacagttgggctagagcacacgcaatttttttcgtctgaaaaacaagcaactggttgtctgtactcagattaatttcctgagcttatggctctgacaattctagatatcgcaagcagtgggtatatttttgtttacaccaagttgtaatttttgaatcccgctggggcttgttacccataattattaagggaaatatgcatgtatttctgatgaatcagttcccaaataggatatctggattaattactattttcaatcttattacaggcccagtcactgaatgaactctctggggctttagataacagaaccctcactctaacagcaaaggagcaagaagcaaagatcaagaaactcgaacaggatctcaaagtgcaagagacaaagctgaagaaacttgaaagcgagtttaagtcagggaaagtgtgaatacatccttcggccatcccggctaaaaagaagtgtgaatgcgtgatgttgtgattatagtgttactgtaaaaaaccagggcgtcatactttagtagctgtaaataataattagcacctccttacagtttaccatacttctgtgtgttgttcatgtacgataagaaaataaggtttagaaaagtcagcttctcttgaattcttttgttagtttgaagtaacagtgtttgatcttttctgtatcatgcagtaagtacatatatattgtggagatgaagttcatttggatcatctgccatcttcttcaatgtgctggaagtatctgtcggtgggaactacacatgggtttacaactacagtttttcatgttaaagatattgcctcaatttcatgactggcttggttgtttgactcttcttttaggacatagtcacaggcagcttccaaaatcttgcaaacctctctcctgtactgcaacatatcatgtcaagaagaaaccattaaatcctgtttttggaggggaaacaaaatctttaaagtgtctctgttaccatatggttgcataattagagggctttgtggtacagagtgccctagaatcaattgttatcacccatttgtcttgcatctaatttttcagtggtggtgactgcttttccacggcattaagatcaaggagttcttaagtctgggaactttggtgactggtgaaatcattttacgaagtgacacaggaggttagaattctgaactattgttcatccctttttttatgccatagagttgtgaaatttgaagtagaataatgtgttcctagtctcatattcattttaggccaccttaagatagtattagcatacctcatcagttgctccagactttattttggattgcaaaatgcaccatttcttcatgtttactcctataatgtgcataagcataatgtaatatttaacagaaacatcttttgctagcaaaagtttagcttaatacaatgtatagccaacttaccaatctttatatcaacttgacatgttgaactggaggttgttcttagatgccacctgcagtggatctatgaccaaggtatcaatggcaattcctctctcaggaaaaataattacatcttactgggaagagtgaatattttgtggttttatacagagaaagaaatggttaaagacgggccacttggtctcctcttcattagcattagtatctattgtgcaaaatgagtactttactatattaacttcttagacaatagaaaagattgctgaaaagacatagaaacggagaagcaagtaacaagttctcacaaaattactactttcctgaccaaacaatctttctaatatttcaaattttctatttctatttgttcgtgttgtcaataatggtggcaaatacctcaaagtaagaaccaaatggaacatcatgtgcctgatgctttgtctcatagatctgaaatgagatagtaagtcataatttcattaaagaagaaaaatcaagaaaacctgattcacagtggacctatctgttactaatttaatcttaccagatttgttttgttctttgagaaagaagcacgttgccattctgtcactgcagtatctgggggacataaaggactgtggcatagagacctgaacatcacttcgcggatcttgccgccatactcatctgaggggtaccacttgctaagctagagaatgaaaaatcaaaacactataaattaaaaaaatgttggttatgctaccagtcactagattaacacatccaaggattgacatagcaaatagaacatgcgattggtgctactgacaaaataggaacctttaaatctgtatcttttcttccatgtcgatactgctggaaaaacattgaattgtcacctaatatgatactgaagaacttctcagatgtgccagggaaggttttctgatggacaatgtcatgttgaaaattaggggggaaagggataacaaattgtgcattgaatatgtaggaaaacaacttgggatgctcacactggttgcatctacaagaacatgttcattgatgaaaggttggaatgcttttgcttgttcaatgcttctttctgctgtctttaggtcatctattttgctacagatgacatcgctgcttcttctttgttgaagtgaatgcattctgacctgtttgtaggaaagcattacagatgctcagataatttctgcaaaatcaacagaaaatattcaagctagaataatttctggatacctgtttttcagcttctaaggttgccctgtaactctgcagagcattctccagggcccgaaatgtgcggtttctattccagaatgatgtgaatttgtacctgattcttcctgagaaatcaagccaggtattttcaacagaaaatctctacatagatttctaacatgaatagttaatctaaattgtatactccctccgtcccagaatataagaagttttagagttggacacggttattaagaaagtaggtagaagtgaatagtggagggttgtgattggatgagtagtggaggtaggtgggaaaagtgaatggtggagggttgtgattggttaggaagagaatgttgatggagaagttgttatattttgggataaatcctgagggctaaaagttgttatattttgggatagagggagtatctattaggtttatgattttctttgctagcgcaacttttactggtaaaagccacttcttttagagtaactcaacttgaaaatgatacagttcaagctctctggagttcaaacttgcacaaatgtggtaattcgattctatgatattaaactacttttccaatttaggcattttcttgaatccaacgttttaaaaattatgagattgagccaataaattaccattttgactgcatgaagggggtgttccatgaccacctgaaccggtacgaagaaaaatagtaattgctgggttgataagggaatgctgacttctttttatctgcgggataaagtgatgtggatgtctactatctcagctgatagaaagcaaatactaagtccacggaaagagcttcgtaggttgcatacctcatctatatcttgtaatggaataatcacctaaaaaattgcaggtcttagaaagcgaactggaagttctcaaaataaaagtaataagctcaagaaaatcatctaagggataataagtgtgtaaatttacttaacaatatttccatgctgttattgatttaccatggagataactagaaaggagcataaataacaatgttcagcttcaagtaaaataattaagcaatgcatgtttcttcagatccatgtactttacattcaactgtttggagaatacattggagtggaagcacagatgccataaggagatgtacatacgcccatggtgcaggaaagacctctccagagcacaagaataactttggtgaacaatctggaagtacaagagacagatggaatgtttcagcataagaaacatgaatcatcatgaggaagagtcaattctgatgagtatgaaatactgtataagcaattgtaatatcaggaattaatacttcatcatgaggaagttcaaatatagcttgtagaaggccactatcttgagttattggcaggtattgcttgcttagcatcatcgttctctcggactcgattccaacacattggtcaaacagactggagaaagaggggaaaaaggaaaataagaagattgcttatcatcaggtatgctcgttccccaac

SEQ ID NO: 70155 - DNA, 1676 bp, Oryza sativa
cgagtagtctttcgtactcggctatgttattggtcgccctgaagttgaggtgaattgcatgcttgaattgttctcccgaaggtgatgtcaagatgaatcctgcccctgctccttggctgttgagcgcgccgtcgaatgccattgtccacgtttcgctgtcgattttgttgtctgacctgttatcagtcatagtccaatcggctacaaagtcggcgagtacctgggacttgatggctgttcgtggcacaaagtgcacatcaaattggcttagctcgagtacccattttgcaatgcagccgacaacgtctttgtttttcacgacttcaccgagagggaaggaggatacaactgtgaccctgtgggcttggaagtagtggcgtagctttcttgatgtcatgattactgcgtagagcagtttttggatctgtggatatcttgtctttgcatcgtggagagcttcactgacgtagtagactggtcgttgcaccttctctctctcgacaacaatgacggtgctaacggaatatggcgtggcggcaatatagagaaataattcttcattaggttggggagcaacaagtacagggggatttgataggtagcgcttgagtgcaatgaatgcctcttcggcttcctgtgtccatacaaatttgtcttgcttcttcagtagagcgaagaaaggttgtcctcgctctcccatcctagcgacgaacctgcttagtgccgccatgcatccggttagcttatgtacttccttgagtcttgtaggtgacttcatgttctcgattgccttgatcttctcgggatttgcttctattcctctgccagagacgaggaaaccgagcagcttgcccgatggtactccgaacgtgcacttctatggattgagcatgaggcgatatcgtcggaggttgtcgaacgtttcccgcagatcgtcaatcaatgagtcgcttgtattggtcttgacaacaatgtcatcgacgtaggcctcgacattgtttccgagttggtcgctaagtgcgccctggaccgtgcgctggaaagtgtttcctgcggttattagtccgaacggcatcttaacgtagcagaataccccaaacggcgtgatgaatgctgtcttctcctcatcctctttcgccatgctgatttggtggtagccggagtaagcgtcgagaaagctcaacaacttacaaccggctgttgagtccaccagttggtctattcgaggaagagggaagtgatccttgggacacgccttgttgaggtcggtgaaaccgacacacattctccatttcccgttggccttccacaccatgactgggttggctagccattctggatggagtacctctccgatgaaaccaactttgagaagcttgtcgagctcttctcgtatggcttgttttcgatctggtgcaaatctctgcagtttttgctttactggcttggcgtcgggtcgcaccatgagtttgtgctcaatcacctccctgggtacccccggcatgtcggacggctaccaagcgaacacgtcagcattgtcgcggaggaaggtgatgagcgcgagttcctatttctcgcctagtgatgccccgatcttgacggtcttgtcggggttggcaccggagagtggaacaatcttgattgcgccgtccggtttcgacgtcttgtttcttttg

SEQ ID NO: 70156 - DNA, 1812 bp, Oryza sativa
attcctgcagcccgccaatacctcgcgtggcgtactcgttgacgatgagccatagtcttcgagcaggtgcaggactgacggttcgtggggatcgatgtcgattacctcaacgaatcgatctgagatcagcgttgctccttgttccttgtcctcatccctgagggggatacgtgactgttggaccttaggaggtgacgtcttcatggcactgagaaataccttgcagcttgagaggtcgtgattctttgtcttgtgaataggacaatagacatcacgagttggagaagtacgctgaattccacgctctttgcaggcacgaatttcagcgtggacgttgagaaaaacctagcaggcttgcaaggtgtgttttctggttttttggataggacaccaggaccttgtcacctcggaagtcatcctcgtcggctcgtgattcttgtcggaaagacaagatttggccgcactaggatccttctcgggctcggatgtcgtcgacgttccgttctccgcttcggcgggaggatccttcgacatggagtcgtcctgggttgtagccactgcgttctcgcttccgatcattgatggaccagtcgagatcagcaccatggtgtaaaccggtaagacgatttcgccgacttgagtcaataccagcattgttgaagcaggaactccttggttgaggttggtgttgacgctgttgtcgacgaagctggatgacatagtagtagaaccttgagcaccaagttcccctacctggcacgccactgtcgacgggcgatacccgtagaccggatatagagggtactagggtatgctggtacgaggatctacgtaatacaacatcaagcagacagaaaacaaagattatactggttcaggccccttgatgggtaatagccctaatacagttgatatgggattatatgatggaaaccacagattacaaagggaatagcggaactcgatgataccgacgagatcctaatcgaacaggttcgcttagatctcccggcgacttggctcttgtagacttcaactccgtaggctgtgattgatgtgttggctatgagattcgatgccttaggtcctcctgggtgggtcccttttatatcgcaggtcaactggtctccaaataggactcggagacatcggacccggcacgatacaaggacaacccagttctgtccgagtaggactccttccatctgtaaactccgcaatgaatttccttaacgtatgccgaaaacgtccgtatacgcgcaagtataccatatcgatatgtgacgtatattgaagggtagaggatataccttacccataaccctgacaagtttgagtttgaatttgaaaatatgacaacttcaaacaattttttaaatactaaatgatttcaaatgaaaaaactatcaacaacaaagttgtataacataccaatatttacaacttttatttttattttggtatttttctatataacattgttttgaatagtttgaatttgaatttgaaaatatgacaacttcaaaacaatattttcaaatacgaaatgatttgaactaaaaaagtcatcaacaacaaagttgtataactcatgaagatctgtaacttttattttggtcatttttctatataacgtttttttgaacagttcgaatttgaatttgaaaatatgacaacttcaaataacattttcatatactaaatgatttcaactaaaaaagtcatcaacaacaaagttgtataactcatcaaggtctataagttttattttttgtcatttttctatataatgttttcttgaacagtttgaat

SEQ ID NO: 70157 - DNA, 7312 bp, Oryza sativa
attcctgcagcccctaatacttgtcgtatcaacaaaaaagcaaaccagacaaccaaccgatatccacaaccatctcaccgatcatcacccaatcccgccaatttagccaacagcagcgttaaagcaacacaagctcccgccagagattccacgcgcatgccatcatctccagcgcgcttcctcccagtcccagccacctaaacccaaaacccaagccgcacttccgcggccgcggccgcgcccggcgcccggcacacgggcgatgccttcccattccccccgacgaaatccttgagccacctcgccaaccgcggattcccccgacgaaatcgcctagggggcagcaaatgccgcgcggtccccgcacccgcaccaacaacagagcagcagcccccccctccccggatcgacggtgcgatttagggctcacctggcccggcgtgagggaggtcgaggcggccatggcgatcccacccgcggacgcgatcgcctccgccattctctctacagcatccgccccgcctccttcctgcgccgctcggatccagccgcgtacaggagccgagcagagaagagaagagaagaagagagggagaggacgaagaaaattaggtgcgaagaaaaaaaaaaagagaagcgcggtttaaagcggcgggtggatgtgcgcgtcgtacgagggagcgcgagcttgccgacgctgccatgtgggaccgagcaagagattccacggtcactgacagtgggggcagtgaggcatttcagagcttgtgggccccacacgccatcggatttgcgagtgacggtgtaactaaacggatgcttagtttggtcgatttaggtgagaagaagaagaaagaaatatttccgtttttattatttctctctttacacgaaaattgcagctttgtagattacaggattgcccctgtcggtcggcgagatcttgttgcacttgcacccctcactcactctgctagtcttcttaattccttcgcgtttagtacttgtgtttgcgtttttcgatgattatcactaacttaatctccccgcaaagaaaggcactaactttaatcggtagtactgctccgtttcttggatttcgatgcacatcaattcgtcagagcatcctgtctgtagtgaatagctcgccttaattaagaatcaaattcggaatttgagatggttagcagcgcagatgcccaactggaagtcaactacggcaacagatggtgattttctcgatcaaaagcccatagttgtaattgacgtgtgttgagcggtttatgcgatctgaatcaaagcgataagctgataacaatggcctctttttttctcatagttggcttgtaatatgcgtctacgtggagtatacaaaacgccattaatcggctttttttcacctgggaagtgggaacatgtttgcccaggggaacaggaaataggatttttatgttcagtgcgagagtcactagtctcgtcggtagttggtatgcgccctaacccaccaactaggatgcatgtcatacagatgcaatggagctagcttagtacaggacttcggctgcgttcgatcgtcgcttttagatgttagttttgctgtcacgtgaaattagatgtgtgattagcatataattaatcgagtattaattgttactccctccgtcccataatataagggaatttgagtttttacgtgcaacgtttgaccactcgtcttatttaattttttttaaaattattatttattttatttgtgacttactttattatgcataactttttgttttttatatttgcaaaaaaaagtttgaataagacgaatggtcaaacgttacaagtaaaaactcaaaatcccttatattgtgggacggagggagtcaaacttagaagtatttttttaaaaataacttctatataaaaaaactttcacaaaaatacgcaatttgataaacatgctaacagaaaaaacgagtaagttgtagtttagatttggagctttagaacgggaccttcgtctatttgtggtgatgcagtgccaaacaagtattttccctccatgtcaaaataagtagctgtataattcaaatttaaactacacaactagatttatttttggatagaggtagcatgatggtaacctgatggtgatagtaaaaaagagagaaaatgacttgtgtgaatattcctttgaacttgtattcgtggatacaatttatataattgatcaattgttgataatgaaacttaattagtgcttcttagcaataatatacttggcatgagcatgtgtatgccactcttctccaaaagaaaaaaaaaagaaaaacctcaaaagtcatacccacacaaaacaaaccttttaaagtacagaaatttaaaatgattttcatgaaaattagttagaaaagtgtgaatccacgtaaaagagaataaagggcctatagccaagtggttaaaagagtctcagtagtaccttaggtcctgggttcgactctccatgagagtgattttttcaggatttaacggcttttgtgctttcagtggtaggcgacgcccagtcttcgaagatgctcataggggtagggatcaccagtgacaagttcttcctatgagacggaggtgattagggagttgatgtgcggtaggcgcaacatgccgccaataaccaacccaaagctacctcgccacgagctcgtccccaaccatcccctccgcaatgccatccacaagttacatctccgtcacgccatgcgaaacaagtagcccgttggcggccacccttttccccacctctcattaccctctcgttattgctcggaggcctagtgacagataggaaagataggaagatgaggaataataccacttacgaccctttcagtttgcaatggtcgttgccctttctaatctaccgtggcctcatcccatcgatcgccacccctctccaagtcgttgccctttctaatctaccgtggcctcatcccatcgatcgccacccctctccaagtcggtgactgtccttcttcccaccacttgtcgcctcctcacagggccagctctaggtctagacaagttgtgcaaccgactaggacccagagtgaatggggcctatcctaatgtaatgtaggtcaagagtaaatagctgagcagtgtgccttcaatcaactgatgtatggacttcttgatgacctatcccattccagtcgtctcatcccgaggccaaaggcgtcgagcgggagcaactcgccgtcatcgccgacgactccttttcgacagacaacagtaaatgtgtctcttcctttgatcaacaattcatctcagttctctcttctactcttgcctggaccgtacgctcgtagcaggcagcagtgtggcacccagccggccaggccaaagagcgcaggaagcaaagtagcggcagccttgattgaagactatgtgcataggtacatttacatactagcagtagattttatttctcaatttataaataatcatagaagatgatatatcctactccctctggtttcattttaattgacgttttggagaatgacacagtctatagtttatatgtttgaccttatttttctattataatatatatataataaataaatatatgcttacttttattatagtcctttgaaagagaaatctatatacgttattctagtttctttaaactaaatatttttaaacttatttatggttaaagttataaaagtttgacctcaatcttgtccaaaacgtcaattattatagaaccagagggagtatctggttaagatgatacatcctatcgggcttttaggtcaagatttttagtgttcttgccttctattttcctttctaattgcagttgtaagattttaatccgttagatgatgatgataattgtgatgtgttgtagtgaaaagaatattttggacaatattgagcacaatattgttcttaatgattttgaataaagaaatgagtaaatttcacaatggtctgccttttcttaccaatgttttacattgggctagggttaggtcaaaattttcactaacaccatatatatttgccaagagttgcactttgggctaggctccaggatttgagcccatctggatgagcagacatcttctccctcccacaagggcatgcgcaacctcgccgccgccacttctgtcgctggtcgggagttgagtgcaaggggacacgatgggggttagccaaggagaagggcgatgcagcaggcactgctctgttgttgttttcccttgctgtccagtagttcaaggggctgacgagattggctagaggatagagattaagcgcgccggcgaagtgagtggcggagtggttattggaaggaaaagcgttagagttggggacaacggccatggccatgaagctgacagtggcagaatcaaggtcaatgaaacaacattaggggacaagtgcttgttcttcttctccagctctagcatgggattgacatgaagctcgtttcgcgtgtgattgacatatccagttgaattaggggcagggcatagcaaacggtggagaagctgtgctccagagttggaaggagagaggaggctcccagcttgcccatttatctcctaatctcgctgacaagtgagccaccggtccaaactgaaattttttgctgtaagacctagcctaaagtgaaaacattgtctataggatggtccaaactagaactttggtaaatataactagaccaatgtgcaatttactctaaagaaattccagaagttcttttttaatcacatattggatatttgccgttttctctttttgaagcatcgtcaataaagttgttggagtttagtggttatttgccgttttctctttttttcaatttttttcaatgaagcatcaacgctatttatcgatattaagaccatattgcaatgtcacgttaggggattaatggattataatgtgtcttataactaaaaggaaatatctagtctaagggactattgtttcgagtttgcatagggtcctagaaaacgtagtagctttgccccctagtttgctacatctctatctatcagacggcttggtgttttccgtcggctgccggtcgaaggcttggtgagaatgtgagagatgggaagagagggaagagggaggatagaggaggaagaagaggtggttgttgacatgtggggcctattggacacgtcagtcaaaatcgggtattataaacctcggatacactgttttgcaagttaagagacgtgctacaattggtatcgcggtacaagaatgtaacttgaactcggcgtcaagataagggacctaatatgaacttattccaccataaaaaaaagaacttattccacgatggaaagctcttcttgcgttcagcagccagtagcccaacaaggcccattgttcgggttaaacgaacccaaaaccgtacgaaagcccgagaaaattgccttcgtctgcgccccgcgggctctcgtcccaaccgctcaccggcttcccgcggcggcggcggcggggctccatgctcacggtgaccctcctggacgcgcacctcgcgcggtgcagctcggcgcgccacctcctccagatccacgcccagttcgtcgcgtccggtctcctcgccgacgccttcgccgccagccgcctcatcctcttcaccacctccacccgcctcctcccgctcccgttccaccactcgctccgcctcctccacgtcgtccaccgccccaacgccttctcctgcaacatggtcctcaaggcggcccgcgagcatgggctgccgcacctgtgcctcccgctctacgcgtccatgtccgcggcccccgactgctacacccataccatcctcgccgccgcctgcgccaccaggagggccatcgaagaaggccgccaggtgcactgccacgccgtcaggcacgggttcgggcgcaacctgtacctcgcgaacgcgctgatgagtatgtactccgcgtgtgggtgcctcggcgacgcgcgcaaggtgttcgacgcgggtcctgtttgggacgccgtttcttggaacacgatcctggccgcgtacgtgcaggctgaggatgtggaccaggcggttggggtgtttgcacggatgcctgaacggggtgctgcggcggtgagttcgatggtgtcgctgtttgggaggagaggaatggtggacgaggcgaggaaggtgtttgatgtggtggagcgcaaggatgttttcacgtggactgcgatgatttcttgctttcagcggaatggcaagtttgcagaggcgttggctttgttctcagatatgcgtggggaggggtggcctgtggatgaggcagtcatggtctgtgttgtcgctgcctgtgcacggttggaggtaactcggaatggggagatgtgtcatgggctggctttcagagctggccttggctcgaggttgaacgtccagaacgcattgatccacatgtactcaagttttctgaatgttgttgcggcacgaagattgtttgacagtggccagtgtttggaccagttctcttggaactcgatgatagctggctatcttaagaatggctctgtcaaggatgcaaaggaattgttcactgtaatgcctgacaaagataatgtttcttggactacaatgatatctggttgtgtgcaaaatgaccagtcctcagaggcactcactattttcaacaacatgcaagcccaaggaatcaagccagatgaggttacgcttgtaagcgtcatctctgcatgtactaatatgtcttctctcgagcaaggcaagtcaatgcatgagtacataagggaacaccaatataccatcacagtcatacttgggactagcctcattgacatgtacatgaagtgtgggtgcttagaatctgcattagaagtcttcgatacaatggaagaaagaggaacaccttgctggaatgctgtcattgtggggctggccatgaatggtctggtgatgaagtcccttgacatgttttcggagatggaatcatctagcactgccactccaaatgagataactttcactggagttttgagtgcttgcagacatgctggcctagttgaggagggccaacatttcttcaagttgatgcagcacaagtatcacattatcccaaacatcagacattatggatgcatggtggatcttcttggacgtgctggatatgtcaaagaggcagagaatctgattgagagcatgcccatgtcaccagatgttccagcatggggtgctttgcttggttcctgctggaaacatggtgataatgaggttggagaaagggtggggagg

SEQ ID NO: 70158 - DNA, 670 bp, Oryza sativa
ccagcagaggcagcaaaaccagcaatgattcaaacaagtagtgttttgctaggccgaggaagaatttccatatcttaagtccatgcatgccgtcagcagagggcaaaacgtcgtgtggctggccaaatagcacagcagcaactgctgctttcttccttgttacagggcatcaccaatggacacattagtttggtgatatcagctggctgtatctatcttataatgatggatgcttatgtcttatgtcttcatgcggtcctctattgatttaagggtttcatggtaaatctgcctcatctatactaatataaaaaggaggagttgtgcctagcaatcctacatgtgaaatcacctcccatctcatccgtccatctactatctcatctcatctccaccgtcaattcgtttcgctatcctccttgctccaccgattccaatgattatagcgaccttatcctctccaccgtccacgcgcgagcctgtgccatctctgctgcgcaccccgcctccgccgcattcaatccatcgccgcaacgacaaatcctcaaatccgacgcgctctcccaatcgtcgtcgttgcctcctccactccgcctcggtcctcctcgcctcctcgctcctccttgcgtggcgccgctccgccgtcgtccccttgcttcgctccccctct

SEQ ID NO: 70159 - DNA, 18778 bp, Oryza sativa
gaggtctcccgacgtggctgatccccacgggctgggtgatccaggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtgaaaaggggatcgatgtttggaaaatctgcagctgatgggatcagctaggcccgggtggccgtttgaaagttgttggcccgggtggccgtttgaaagttgttggctgggtgccaatcttgaacaattcaaaagactgatacattgtacatactccgaccggacgagacgcactgtctcatccgtgtcgtttgagaagcactcacttagttgtttacagaaaagagttcaaataaaatcaattgcaaaaacaacagcctttccttgaagcctgcattaaacacttatttcccatggcttgctgagtactcccgtacttacccttgctctatataaataattcccccccagttgctgaagaagatgaagcggatcctgctgatgacgagttcttctaggagcaagccggctatgatgagttttagggtttcggcctagttcccaagtcgcgcctgtgttgtttggtccaagtattggcttccgcttcccttttgtaatgcagttgtgagctcgggatctgtccgcagcccaacatgactgtacctttactctataataaagagacctctgttgctgtgataatctgtcttcctgtgataccagcactgtttcctgggactggtatcgattaacaggttaatttggagcgtcacgggctagttccggtcggtactagttcggggcgtgacagagctcatgacgaatgcccttggtgaaagcggcgatgatgacatccttcgttgattcggagatcttgttgcgctgctcagaaaaacgtccgatgtaatctcggagggattgtctgggcttctaaataacgttgtagagatcaaactgggtgccggggcgttcaaaggtgccctggaagttggcgatgaagtggtcgcgaagctccgcccaagatccaattgtgccacggggtagcccgtgtagccaggaccgggcagaatctgctagggccacgggcaggtagtttgccatggctttgttgtctcctcctgttgcgcagatggcgagaccatagacggtgagccaggactcagggttagtggtgctgtcatacttctcgattccagtcggcttgaagccagccggccaatccactcgatgcaggtcgcttgtgaaggcagcaactccatccacatcatcatcgtaacgatttggtgaatggtgggggttgtagcctcttgccgcccggcgctggttgatagtctcgtgaagatcgatgggatgcctacggtgtgggaagcagggatgttcagctcgactctccttgtgctggtcagggggcgagtggacagatcgtttgccatgatccctactcctgcgattggatccctcgccgacgacactgaggcttggttggtgatagtcttgagatcgaagaggtggaactcggttgccggtcggcgtgcgggtgctcgtggagttaactgggaccgaggcggcgatcatggttttggtctggttcaagatgttgacgacgtaatcagcctgattgagtgtgtcttccgtgaggagggtgtcgaggagggtgatcgctgcaaccgcgttctgttggggggtgcgaaaaaccgtcgtcccctcgacgtcttgttgcccgatgagctctcgtgctcgtcgtccagattccaaggcgcgctgtcgtcgatcctcagccttcttcgtagcctgttcgcgatcttgttgttcacgctgtagtcgttctcgctcttgtcgttgtcgttcttcctccagtcggtaacgttcagcttcttgtcgtgtgcgttcttcttccgcttctcgggctcggcgctgttctgccgtctcgttgtcggccatgaatacgccgaaaaagagaggcgtgtagtcgtcctcgtagctgtcgtcgaagtcatcgaagttaccgtagtcgtagtaatagccgaagtcgtcgtactcgaggatctccgttggtcgagaactgacaccgggggagctgaggtagccgtccagttcttccgtcgagaccatcccaagaggttggagtataacaccgacctccctagagttagattggatcgaagccgaagctggatcccgcctaggccttcggggagaagatgccttggtggtgaagacagcggccagatcatcggggagtctcatcaggattgagggatagggtccatcgtcttgatcaggtcgtgttggagtagattggatttcgtccgagtggtttggggctgactcaatcgagatgatcttggggtagatctcggccgagttcggaataccgaacggggtggagacctagcctctccccgactggttcggctccgagtcgaggagagaaatcctgccgaagtcattggtgatgaagtcgaggctgccgaaccagaacgcctgcccgggtgggaagacgaagtcgtcgatgccggagacgaaacccatcgcactagttggcaaaaaacttgacgctacccctacctggcgcaccaattgtcgaaacaagatttcggcaatactaaaagggggtggctatcaagctagaaaagtggatgggtttggagacaaggaagtttatacaagttcaaaccttcttaataagaagtaatactctactcttgtccggggtttgatccgctgtcacatcctgattttcgttttaggatttataaattattattagaatttatattaaatgttcattaatttacatgtgaagttaaatgtgggaaataaaatttcctaaatataaagcatggctggatttaatttttattaaattctccgtggttaattatactctctgaaattttctcggatttttcggagctcaattcctaattttaatcatacaaagaacatttcagtaattacccacaaattaaattaatcattaaatggtctgattataatcttgttaagtactttgagtgtccaagtattttcaggatttttcttgaaattatttgagcattggaagtatttttaacaattgaaagatcattcagtgattaatttaattggaaaattaattaataattctttcctttccttcctttggttgtcaatccttcccggttcactctccccgtccgcggttcatcgtatccgccgaccccttttgccaccgcggtttcgttttgtatgacgagccgagtcctattctctttctggtttcgtttcctcttcctttcccaaaacggcaccgcatctgtttcccccacctttcctttctaggcaaccttctcctcccgtatctttttcccttcctcctctcggcctcctcccagccgtgcgcctctcccctctcccagccgcgcacgccttccctcccctcccccctctgccgtgcctcccttggccccacctaatcctattcaatcttcccctatataagccgtcctctcccctcctgtttcctgtttttttttgtgttgcagccgcccctagcctcctcctcctcctgtttagccgcctcctccagcaccctagccgccgctgccctagctcgccgccgccgctagccgtcacccctcgccgtcgtcatcttggtcgtcgccgtcgtcttctccggtgagctctcctctctcccatgtcatttaccggtgtagtttatccctagggacttaatccaatttaatctaatcttatttggccctagcgtcgagccggtcattgccgtgcaccgcacccgctgttgtccgctgctagccgccgcgtagccgctgccctagtgcacgtactgcagtcgccgcgccgctgtcgtgcatcgctaccgctgccgcgttcctggcttagcagagccattgctaccgctcggtagccgtcttgctaagtcgttgttgagtcgctgccgctgctgcgccttgctgtcgtgctgtgccgtcgctgctgtgccgtgttgtagccgtgtgccgcttaaacctagccgccgctttatcccgttgctcagtagtcgagttatctagccgtaggcaaggttgtcaagatcgggatactatgtagtatcgttttgctcaaagtaatatcgtaccgtaagatcgtatcgtagtatcgagatactatgatattttctttttttaagtttaattaatatttatattaattatatatatagccattctatataaaaaatgtagtaatgatatatgtcatgcaaatagagatatttatcaagagaaaccacgctggttttgatatatttaactgaattttatataaatttgagcatatttatttacattattttcaaaccatgttattttaaataatattttgtagtatcgtagggatcgtagaatcgggataccacctaagatttcgtaggatcgtgtagtaatgaatagtaggatcaagatactataaaaattaggatactaggtgggatcggtatcgtttcggcttagtaggatcgtagtatcgtaagatacttggatacgaatcgggatactgacaaccttggccataggtgcaactctaggttcctaccggcctatcgtttgccgtatcggggctttatcgtgaatcgtttctagcccaccggtttagccgcagccgttgttgagtcgttcgctcgttcgttggaacgaggtgttccccgtgcttcgttcgttcatccgtgtggagtcgtcctttagtttagagctgttcagagccaccggttccgttcgccggtttcggttgatcatttgggtgatcccgtgtcacgtagaattgactcgttgagtcggtatctcatgaggcccgcttgccagatcaatccaagccatccaatcttcgtcgactcggtcaagattaatctcagcaatccaaaattgatataaatccgttctcttttttcaatggcatattattcctttttaatatatgtcatctaccaaatatgatctaatcttttccggaggttgctttaatcttttatctccattataaatcatttgtaaatgatttaattaatttggaatagtcttttctttaataggtttaattggaattaaatcttgtaaaatttgtaattaattcatatgaagttggaatgaggcagttcaagtctcataattcatctaaaatcatgatctacatgcttgtttacttttcatgtactgtttatttggtttttattagtctttttctccgttttgcgtgttagcttgtcgtttccgtcgttacgaaggttcgcgagtgcgccggaagcattcaagaagattaattgaagaacaattattgcaaggcaagtcacacagatcccaaacacaattcctttgagcatgttgattctatatttaaattctctatttattttaactgtgcatttattttcgaatgtcaccgggtggtgagcctttcccatttaattatggccgaagatgactttattttcctatgggttataatttgattagctagaaccttatatattggtttgatccagcaaatgttatatatatataattgcttagccatgcttagaaacattagctcattaatgggataaatcatgcttcactattacttatggttatatttaatggtagctcacgatggttaatcgtgttatgttaattaattgataattaaaacttgtcaatggtgggttgtgagcacatggttttgatggtcgtgcttatggcaattaaggaccggttcgcgagctactgttgtgagacattaaccgtaccaaccacaagccagcgtgggcaacggctttaccttttgtatagcatggttcattacggggtgtcagactgtgaagcggcgagaagtccgtgggggtcgctggggagtccatgcctttggttattgagggggtgattatgatccaggaacggtgcactgtggtgagttgtgttgtgcagagggtattgtcacagcctctattcggatactttctagtatccgcgacgcatagtagacatgatgtttaggctgtgtcttgtgggtacagtggtacacctctggccagagtaaaactattcgaatagccgtgcctgcggtcatgggtgggttgagcaatgtttttcgtgattagtctcacatctctcacaataattattgatgctataaatggtaataaattgcttagctcctggtttggagttagatctgtacagccaggtatggttgttcaggatggttgggcctgagcagtatgggtgtgctattcagtgtttattaaaaatgattaattactctactgttttactattcttaaatatttgctaaatgctgcttttgcaaatgagcctatattatgccatcctttggtattcttgtgcacttgcatatttgctgtgtggtttgttgagtatgtcatatgctcattcttgcaataatcaatcaacctcagttgaagaaaaaggatccagaaggagaagacgtttggtttataccccagttgagctgcctgtgggagtggagctaaagccatcgctagacgtttggtttatacaatttctaagtatgtaacgttattattatgatggatttgtatattaaattgtcagtttgtgtagctcggctgattcctggacgagggttttatgcacaaataagttcggaaattactagtgaatttctgggcgtgacatccgccgagtgtattattgatcgtatgatctgagagtagaatctcgtaccccaagaggcacccggacccctccttatataggagaaggagtccgtattacaaaatacagcccatatctctaacggaatatgtagttacagatatgacctaatcgtaaccgactaggatcccgggtacttccttaacacacaagtttggaacttaacccgggcctcattaaagatattctatctatacatggctccctatacccaatcggattatacatgccgtgtaggtatggggtatccataatctccacaggtggccagcagcagtgcggtgtccaccgccagcatgaggtggccctgcgccatgagcgagacgaacacgaagtgcgccaccgccatcgatgcagatagttcgtgttctcgctggcgatgtatttctattgcttgtgcagatagctgctgatccatccatatgtgtgtgtgcgtgctttaaagagagagacgtgacggccggtgatgtgttcgatcgtttgtttccagatgccggcgcgcgcccccgccgttgctgccgatggagctagcagcgacgacgtcctcgatctcgtgtagccgctgctcggcctcggccggtggtgtcccacgtctcgtcgagcaccaccctcgccttgccgcgccgccccttcatcgccagccactgccacgacggcgtggatggttcgcagggcgtcgtggaagcgggaggtgcggtcgaggccgttgcggacgagctggaaggaggggatagagagagaagagagataggagagctgacacgtgggtccaagggcatttttgacatttcacgtgatttctctccccctcttcaaccgaaaattattattttaatcggcgtagtgtccactgtcaaattaccacatttatggagtttttcccccaaaagtgagtttgggcaatgtactagggctaaaaccgcatataagcagtgtcctgtagcaaaatttgcctaaattgggcaaattttggcaatgcataggctcaaattggtagtaaattggtagtgtcatccgccggaagtgcccagaagcaggccacacaactaacattgtgcttatttacgctacgtaattgtcgtgatgagcaaaatgaacctaattatgtatatttcttatcatcttatttgtgcttattctgcaacaaatagtaccaaagctattacaacaaaaaaaaaatggtaacccttggttggtacatatccaaatagaaattgacccacaaaaaattggcacttcattgacggtttgacactaatcctaacattcacatttactatgctaccctatcaaaatcttggtagtacccaaagttacctagattttggcactactaaaattttggtaaggtaccaaaacaaataagcccatagttctcactaaagtgctgaattgggcttaggaacagttatgggctttcgacccactacataatttttttatttcctattccattttctcactcagatgcctgctaaatttgccataaatgttactacccttttacctaatatttgtagatattattactgccataacattatttataagaattcttgtactatttataaagtactcctatttaggagtaattactaataccgctctaatttgatggtctattctatactcctttttatctcccggaaagagacagaatgggaaccatacttaaataaataaattatcttcagcgtcaaaaaggaacaaaaaaaagtgttcttccaaccttagaacgtgacaaagacaacgaaaagaaaaatcaatatgttcttttcagctttgaggttatcaccaaagctttccaaggatgacaagccgggatgaactttgcgtccaaaaagcaggtccaaaaaatccaaaccttttatcctggccccgtctgcaatccacttctccccctcttttgcctctgcctcagactattcattcgatggccagcgagtaataagattcgctttctgctatcctcttctgcttctgcacacttctttgcatgtgaacccaagctcacgcacgctgacagttcatacagctactgtaaaaaaaaagtttccacctggggccaatactttatacggactcacagtagtacttgtgagtagaacaaatggtctaaattgttcattgattctgttatagattgcttaagccagcagcaagaaagagtactggtaagcaggccaaatatgtggctggtttcttgttttttccctgtaatttgtacatagattaatgtttccttgcaaaacttgtgcctgcattcttggttcttgccataatttctttgggagcggatgagaggagatgagacaaggtcgtccttgctggaccgtgtctttactgctatgatctttgctggttgaggcagatgtggtggatggcttctcttgaagaggtcttgggttcacatggccattgcttgcctcctcctttctccgtgacgtcttcttcctgtggggttcttccctttggagcttggcccctacctactcaggacaagcgtgtagatgcaggcgtgaatagcctttgcctgtgctcccatgtcaatcaagtgttctgtgctagattggtcccagagatggtgcctctctggtgctaatttctcttgagggtgtttctggtttggattactgagttaatgacgccatggctgggcagagtaggatgaggtttcttgcttcttcctctcttgagtttgttcttgggtaattaatccttttcctgggagcaacttgtgagttgtgactgtttcttggtttcctccgccttggttttaccccctttttttgcgttttttcgaggcatcgatttctgagccggataagtagttgagctgctggtggctgaattattaacagtccaattaattgctgacatcccaagatgggcagttcttgataaccccagtaatttaatcgctcggtttagtagctctggtttcaattgctcccacatggagtaacaattcattagttagagggatttagagctgaaacttcttctcaaaatcgcagttcttggttgttgatttccctctgttcatcgtggaaacgtgttaagctcaagttcttgcaatttttctttgctttttttttttgttttgtagaggaaaatttcttgattaggagatagtacaaggttggtggctatggaggaggaatcccaatcccaatcccatttcccgctccggtgggagagcaccggcgaccaatggtggtacgcgacgcccatcgactgggcggcggcgagcggccactacgacgtcgtccgggagctcctccgcctcgacgccaacctcctcatcaagctcacctcgctccgccgcatccgccgcctcgagtccgtctgggacgacgacatgcgcttcgccgacgccgccaggaaccgcgccgccgtcgcccgccgcctgctccacgactgcgagccccccaggggcgccgccgctggcggcggaagccggcccaaccggctcatccgcgcgggctacggcggctggctcctctacacggcggccgccgccggggacgcggccttcgtgcgggagctgctcgggaggcagccgctgctggtgttcggcgagggggagtacggcgtcaccgacgtgctctacgccgcggccaggagcgacagctccgaggtgttccggctgctgctcagcgcggtgctgtccccgcccgagtgctccgccgggggagaaggcgacggcggcaccgccgccattgctgggggtttcatgttccggtgcgagatgatgaaccgcgcgatgcacgccgcggcaaggggaggcaactggaggtcctcagggagctcctgcaggggtgctccgacgcgtcggcgttccgggacgctcagggatcgacgatcttgcacgccgcggccgcgagggggcagcttgaggtgatgctacttcctgcttcacaaattttttatctatgaaatattcatgacagggtaattccatagaagaattagttttactttgtagctgcaacttttgttaacattttgtcagctctaatctatgaaactttctgattcttgaggtgatttgatcatatttaattgctaatctggggacactggaatgatatatatctgctacattattgtctttgatttgactgtccctgaagttgatcttgtgcacatgctagccagatttcctttcgttttacacatgatatgatttcttagtgacacatgatatggcatgttctagttaaattaatagagatggaaactagatggcattgacagatattctcaacctactactgaaatgtggtgtgtttagctgtcacgaatgtttggtgagagtcagcaactgaggtttagttgtaaaccattgacctaataaggaattttataatacatccatatatgcttgtcattggaagtgttcaccgacacgctaatgcgtggtgaagaaatagtctgttcatctgggatgccatgacaagtgtcttcccaccatctgttcttttgttctaaatttatatttattgattaaaatcgtcgtgtgttactctgtggatgcatactgaagtattagcatgttcttacttaattctacaggttgtgaaggatcttattgcctctttcgatatagtcaactccacagacgagcaagggaatacggcattgcatctagccgcctttcgaggtcatttgcccgtggtcaaagccctcatcactgcatccccatcacttatatcagctacaaatgaagttggcgacacgttccttcatatggcgctgactggctttaggaccccaggattccgaaggcttgatcgtcagatggagcttatgaagcaattgattggtggagtgatcatggatttaagcagcattatcaatatgcaaaacgacgatggaaggacagttcttcacttggctgtgattggcaatctgcactctagccttgttgagctcttgatgactgcaccgttgattgaccttaatgtccgggacaatgatggcatgactcctctggatttacttaggaaacagccaccaacagcatcgtctgagatactcatcaagcagcttattttggctggtggaattgcaaattcaatggaccatgagaccagatcagccattgcttctcagctaaagatgcactgtatcgtaggcagcccgggaacatccttcaagatcccagatgccgagatcttcctccatgcaggtatcgatgcgtcagacatcagcgaaagaacgaactcattctctagcgttggacagagtgagccagaatttccggaatccagtcgtaagaagctgaactctatgcaaaatgcagcgaaacatctcaagatcctactcagatggcccctccgcaaggagaagaaatcatcatccggtgcccgaaatgaactggacgacgacgcatcctctgtggattcagtcaagagctggagccacggggagaccccgacaccgctgaggcagaagtactccaggatgagctccctgttcaacaacaagcggaccatggcagccaggatcggctcaccgagtccatcgatgaagaagagcttcgcagatggcctcgcacatggcgtgatgcagcccgaatcgccttcaggctcgggctcctggtcgtcgtcgtccttggtcgacaggattgaagccgtccatctggacaagaatggccaagcatctcctgataccagtgtggtgatcaggcgtacacccaagaagcacgggtctttgaacagcaggctcatgaaccaatacttctgcatcggagcgcaggggatagctgtcgaggactcaaccacggggcagcgatcaagtcggatgttcagaagttcacttctgtcagctgcctgaattcgtaatttagacatggtttgctttccttgacttcactgcttacaagttacagctgatctgttagtatgtgcgagtgcatgtgagaagactgtcatatgttgtgtttgtattactgatgcaaaatggtgagatctactaatgtaatgtagtgctgttggtagtgtgtaatgattttgttgggagagtgagtacaatggaaggcatggttttcaagttctatggtttttatatcttacaatatcatatgaggttagtgagtataatttgtagcagagtaaattacattggtggtacacgaacttgttaagtgggtgcaatttagtatataaatttgtaaaatgctcattttggtacacgaacgtatctaatccgtgcgagctaggtccaaaatggcttggcaaggttaattttacctatctgatgttgattatctgatgttgattaggatgtgacgtgtatacgcatagtgagtatgcataaaacatgctatatttacaaatttgttatctactttatcttgaatttcgtatgtttctaacccctgtattactgctcggtattttatatctttctctacaatcactatatctcattctatcttttttattgaacaggtgtatgtctaagtagtaaccttctcatatatatatgtttatatagtatcctaatcagcacctaaattaacaaaaataatcatgtaatgtccttttgaccttaagtcgcacgcgcaatataagctcgtgtaccaaaacgagcattttacaagttcatatactagattgcacccacctaataagttcgtgtaccgccgatgcaatttactctttgtagcaccttttgtatcttacgactatatataggtatacagagagaggtatacagttgcataaagaatatagcgcctcttcaaataccgtaaccaaaaaagatttagcgatctttgttcacgtcatcacgtgggtcttatctcaatattacatttgagtggacattttaaaaaaagcaaggatggacgaatgatccgacatgccaactatatatgtagtcgtgctaagaaaatatgcagcaaaggctcatcaaatacgcaaaaaatcgcaagcaaatgtaaaccttgctccacttttctaaatgactagcgactaatttcagtcttggctccgggtttttttttattattttcaaaaatacgggtaagatttgcgtaccttcgtattaagactaagtttatattatagcacaagtgaagacaagtatgaacagaagaaaagaagaaaagaaagttgcaaaataattgtgaaaggcatggcgattttagatatcaatgtcatggtggtgggtttctcctctgttagttttaatctgcttatctatcgcgtgtcaaacttcgcggttcatatgctaactcgttttttttaatattatcatttgtaattacactttgtaatgattttccatgatcaataaaacacatctttctctaaaaaattaattgtgaaaagctatatcttacggctgaattgtatgacaaaaaaaactcacactagactagcgtctggaaggagtactagagtgtggcttcctttgaggtagcacttgccacctccattctttttttttctggccgttcgaaatacgattgttctattcctttcaaattgaccatgacgttagaattacaacaatgtcatagcctgctatcacactactattggaaaaacaattgcttatttgaaggagagcattttatctaactgattttctagaatgataaataaagagtgcctctagccaactagatcgtcttttcctgttgatcacaaagaacacaatgctagagatgctgcaggccacgtatgcttgatctatctgtcgtctagcaacggcggtgggccactaaccagtagaaatacttgtaatgcagtggtgaggtttcgagatctccaatgtcttcatcaagtatcaacgaaagtctctaaatgggaagaacatatgtaaagaatacagcacaaggattttttttgagtttcaaaaccatagaacaagttgtgtatttgaccattgaagaagttgctcaaccataattttctgtgtaatttccggatagtacatatattcaaccaactgtttaattttcaaaattttaagcctttttatttacttattttatttattactccctcaatctacttttgatagacatatttccaaatctgaaaaatttatttttgataggcatatttcaatccaacaacttatcatcttaatatctttctcagatttaatgcgtaactctccattcttccacacaagattggctacatggacatcaagaaatttaaatattaatgaatagcttatttacgaggaatgattagtagcatacttaaatagatgataagtagaattatttatctttggtctatgtgttaagatggaatatgactatcaaaagtagatgtagggagtaatatttcttaattgaagcaggagtgttgtagtttggaagactaataacccaatactttatggttagggcatccccaaccctccacctcagatggtgtccatagaatttattagcctgccacataagtaaaattctgatgtggcaaggtaattaaagaagtgagagaaggaaaaaaaaagagaaacggtgtctcatgcacaaaactggatcggcgcagccaccaagatgcatgaaatgagagaaatcagcgttgggggcaactcatcgtttcttccgcctggatttttctcgagctcccgatctgctgtgccgccatgcccgtctccgtccagcgcgccaatttcttctcggcgaaatttttggtgcggcatcaatcctcttggcgccaagttcctgctcgccttttctttttcttgccgcttctatttttccccaatcacctgtgttcttcaatatctctgcttgagagcaaaaatcgccaaaactcatctctggtggcttccacattctgtcttcttccctatatcctcttccctcttccataccatcatgtcccaccaatctgaaaatgatccgccaagtgaatcccctttgcatgatgattctttggatgaggtgagcagcatagatccaatggatctgtaccctttagatgaggtgagcagtatattgggcgatattgctgatcaagtgattgttgaagtgaagtccgaagttgcagctctacaagacatgagacctaccaggcggagtggtacaagaagttatattgataggccttatgcagaatctgaacaggggctcttgaatgattactttgtagagaatccagtcttcaatggaacaaacttccgtagaagatttaggatgagaaggcccctgttcttacgcattgttgaagcccttggtgagtggaatgagtattttactttgaggatggatgctcttaaccgcccagggatatctccaataaaaaaatgcacatcggctattcgccaattgggaaatggcagccctgcagtggagtgcttgaagatattcgtgaagggtgtgattgaggtgtatggcgaagagtatttgcgacgacccaccgtacaagatgttgaatgcttagtgcatactagggagcaccgtgggttccccggcatgttagggagcattgactgcatgcattggcattgggataaatgcccagttgcttggaagggaatgtatacccgcggtgatcaaggtgttcctacagtgattctagaagcggtagcgtcgcatgatcgttggatatggcatgccttctttggtgttgttggatccaacaatgatatcaatgtgctgaatcaatcacctttgttcatccagcagttgagaggggaaggtcctcaagttcagcaccatgtcaatggaaggcaatacaacaatggctatggccttgcagatggtatatacccagaatgggctgctttcataaagtcaattcgccaaccacaatcataaatgcacaaattatttgcacaacatcaagaaggggcaaggaaggatgttgaatgtgcttttggtattttgcaatctcgctttagtattctagaacgacatgcacgtctttttgatcaaggggattttgagaatgtcatgctagcttgtatcattcttcacaacatggtaatcgaagatgagaaatatatgaatcaggatattcctcttgacttgaatgagacaccaagcacgtcatctgttaaagaagctacaatatctcaaggccataatccagagatggaacaagtgatagaaagaaatgtcattattcgtgattgtactgctcatagacaacttcagtcagatttgattgagcatatttggctaaagtttgggaaacgaagttaattaggtgatcgtgcatcattttaagtctagtttacaatctgtgtattacatatactacttcatatatagcttagcagtaacagttgaactaaataactacttatttttttccgtaatgtgattttttaccttacatatactgacatctcttcttttatttccttcctgcagataaggtcatgtctaatgtgttgctgctctacctaatggttgaagtgctcctgtctgctggatagatgaaatgctcctgtctgctggatggatgacctaatgtccattggatgaatgaatttttaatgttgaatgtcatcaggctatctaagttattatacttatgtttctttattttgatgaactgtgtcgacgtttgatatcgcgattccggtatttgtatagtatggggatcgttggtactaggatatatgcgagattgtaataaaagagatggggacgaggatttttatataggttcaggccactgaattgtcaggtaataaccctactcctgttggccgaagccggtcgttgctcttattcaccataatcacaccagtataatatttggggcagcctatctaactgttgtcgacttggcggtctgaagtgctgactcgtagtcgacaacagagtagccttcctcctcgaatccgcatccggcgagatcaaagacaacgctatgtctctcctgacagtatccgtagacaccgtaggggactagccatgcttatctctgaagtcgatatccgacatcttgtcttggcgcatgttggcttgtatgttgatcttgtgtcttgatctattgttccgtgtcccctctcctcctagggggccttgtatttatacccataggtgtccccttgtccaagtagaactagggaaaccaatatggatacaatccgagtagtccttgtcgttttcatatagaactccattcattcttccttatacggaactcctcctatatccgaagattatttccatataagacatggtatgtggtgggtcctgccgagatttagtcaactactattaggtatgtggtatccataaccctgatagtagcccccgacttcaatgcaaatgaacgagttcatattctcaatccgaagacctcggaataactgttatcgagctcacgtgaccgttctcagtaagttcagagataacgatagacttcccttatcagtctcgtgcgggcacagtatagggtttgtctgagtcaatctccgacgtcaaccaagaaagtacagagcataggactaactctctcgtcttgctgtaatcgagaatttggattgaagtcaagaaattttatctcggcgggtacaccatctcttcattccgtattccttgtcgaggtccaccaaccattctcgagtgatcgagaaggcgcagagtctgcgacggagccttgtcaacatttgtcgtactcgccttagttgatcttggtatagaaccatagagacatggagtcttcgacaatgtcgaatagaattttcctgaaatcaatacttagaaaaaaatattagatagaaatagcatgttataatatgtatggaaaactgaaaatgaattaaatttacagactaatgttttgtatatgagcgtcttctcttttaccgacttcgaccagtcagtttgttgagtcatacactctccctagcccccagccttgtcgtcggagaatcgttctcgaaggataaggctcttggacccttgacctgctttggttgaaaagcgcttaccctagcccccagcagtgaagttgaaaaacctaatttctgattacacggctggttaatatgcatgg

SEQ ID NO: 70160 - DNA, 677 bp, Oryza sativa
aataagttcgctttgggtctctcatgttgatgtgcttcaattacatccctaaatcacaaagtacaatgcatccctaagacaatatagcaggcggttttgaatgacatgacgctaacgtaccttgtgccttggcctccggtcaccaccgcacctgccctgcttgctgtacaccgccattgctaataatttcatccacctctactccccgtccgttggcgcccacttccgcgtgcccctcctcacagagaaggcgatcagtagcatcgataggaagaccaacccttacctactcaacccgctcacaggcgcatgtgtcgcgctcctaccagccatgacgcttgagtttgttacaaggttcgttttctcccccagtgacggtggctgccaaggtgtcacatgcatcatcgactttcataggtcgggcacccccgacgacaagcaggtcatggcatgaagagcgaggctgtggatgtaccgtcttgtcgcgatatcggcatgcccatccgccaccaccaccggcgactgtgtaatcctcctcctacacatgccagactaggagctcttcttcaccaagttgggcgacgagcattgcaccccgctcttcggtacttgggatagctatgggctatggcagtgtccgggaggagttgcggatctaggagtaggacttggggacc

SEQ ID NO: 70161 - DNA, 12237 bp, Oryza sativa
aaggtggcggcgggtagaggagacaccgggggtccttttaaaggggctaggaggcggcggcgaaggcccacggcgaccggcgacgagaaggaaagttcgggaaaaacgaatccgaaacaaactcgaatccacgaatttccaaacgattttagccgatgtttccaaaggagaaaaggtagaggagatcgagaagatcatttcccctctattgattcggccggaaacggaaaggaacggctggatttggaaggaaacggcggcggcggcgcgctagggtttcgggcggcggtggcgcgaggtagacgatgggtccgacaggtgggacccacctgtcagcgacagcgagggcgcgcgcacggcggctgcggactgggtcggctgggccgaggagagaggaaggagttttgggccgactttcggcccaaagccaaaagaagacttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaaattagatcttctcttcaagacttttaaaataaattctaaaaattccatttaaacaacaatttatatattttgaattttcaaggtgtgacaaacctaccccccttaaacagaatctcgtcctcgagattcggaagaactggcgaacagatgtggatgagctgacttcaattcatcttctcgttcccaagttgactcctcttccgagtgattactccattggactttgcaaaaacggataactcgattcctggttcttctctcattcgtttccaagatacggattggtttctcaacataggtcagatcctcttggacttctatctgttcaagattagcttcttcggtaggtacccttaaacacttcttcaattgcgacacatggaacacattatggactcctgccaaggattgaggtaattccaattgataagcaacctctcctcttctactgacaatcttataaggtcccacaaaacgcggtgccaattttcctttggtgtgaaaacgatgaacacctcgaagaggcgtgacacgaagatacacataatctccttcttcaaaactcaaatctctgcagcgattgtcggcataactcttatgtcgagactgagccactcgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgtagactagcttgataactgttgttgtacgaaaattctgcataaggtagattcttatcccaacttccaccgaaatctaaagcacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacaccatgcaaacacacaatccttgccatatacaattccgccaatcgacttctagaataagttgtctttaccggaatgaaatgtgccactttggtaagtctgtcgactattacccaaatagagtcatggcctgatgacgttctgggcaaaccagtgataaaatccataccgatttcttcccatttccattcaggaatcttcaaaggctgcaacaaaccggcgggtttctgatgttctgccttgactcgctgacaaacatcacatactactacgtattctgcgatttcacgcttcatacttgcccaccaaaatctttccttgagatcctggtacatcttggtactaccagggtgaatggagtataaagtatcatgagcttcttgcagaattgcatcttttaaatctttgttgtcggggacacagattctctcacccaaccatacagttccttgctcatcttccaagaaaccaatagcttttcctcttctcatattcttcttgatttcttgaatatcaggatcattaatttgggcttctctaacttgatcaattagagtgggcttcgcttctagggctgcaacgcaacctctactgacaattcccaaatttaatctttcaaattccttgcataattccaacggcaactgtcgtccttccgtagcattgcaatagccttttctgctaagagcgtctgctacaacattagccttccccgggtgataatgaattcccatgtcataatccttaattaattccaaccatctcctttgtctcatgttcagatccggctgagtaaagatatacttcaaactcttgtgatcggtatatacctctgtacgagtaccgaaaagataatgacgccaaattttcaacgcatgaactactacggctaactcaatatcatgagtagggtagttcttctcatgcggacgtaactgacgagatgcataggcaaccaccttcccattttgcatcagaacacaacctaacccaagtttggatgcatcgcaatacacttggaaacccttctttggatcaggtaaaatcaaaataggagctgatattaagcgattcttcaactcttgaaaactccgctcacattcttctgaccacttgtacttcacatcctttcgaagtaatcgtgtcatgggcttagcaatcttggaaaaattctctataaaccttcgataatatcctgcaaggcctaagaaactgcgaatctctgaaactgtctttggttgcttccagttggttacggattccacattactaggatcgatggcaactcctcctgctgagatgacgtgaccaaggaacttcacttcagacaaccaaaattcacacttgctaaacttagcatacagttgatgttctcgtagcttctctagtgcaaggcaaagatgttcttcatgctcttctttggttcgagaatagataagaatatcatcaataaagaccaccacgaacttgtctaagtattccataaacaccttattcatcaagttcacgaagaaagcaggggcattggtaagtccaaaagacataacagtacatcgaacaacccatacctagtggtaaatgctgtcttaggtatatcttcctctttgattctcaactggtgataccctgatcgaagatctatcttggagaaaacagtagcacctttaagctgatcaaacaaatcatcaattctaggtagcggatacttattcttgatagtcacatcgtttagggctcgatagtccacacacatcctctgggtatgatctttcttttccacaaaaataaccggagctccccatggagatgaacttggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcatctgggaacacatcggaatactcccggactacaggaatctcttccaaagttatttggttcagtcttgaccttaaagtctcagaagacaatgcatgaacagtcacaactcgaccatcattgctggtgagagttacttttctgttagcacagtctatcacacctttatatctggctaaccagtccatccctaagatgacatcaaggtctttggattctaacaagataagattggccagaaatggtattccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcatgaactgagttaacaaggaacgtacccaaaatcacatctggagcatcttgagcttctgcagcagcaacatgattgacacgggccttcacgcgtcggggcttcggacacttatcagcataatgtcctgggtctccacagttgaaacacaccacggacttgctgccttgctccctcttggcaggttgttgctgtgttggagctgcaacagggcgtggagcttgattacggatattgttgccagcattgttgttgaagaactgacgctgcggacgaacaacagacgaagaacctccctgtggcatagactggggtcctaaagtaagacgcggcctctgattattcccctgttgtgtcttgaattgagcaatccggcgtttcttctgctccatgcgattgtatttgtcctcctgacgaatagccttatccaccaacttctggaaatcagcataatctccagtcatgagtgggtaagaaagctcatcattaagtccttccaagaacttctcctggcgctcttcatcattgcgcacatcttctggagcataacgagccagacgattgaactcgtgcaaatactccgtaacagagcgagatccctgggtgagcgacctgaattccttcttcttgagagacaccactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtgcattgaagcaaatccaacttcttatctatggcatgcaaccaatcaccagcttcaacaggattagtggtgctagagaaaataggcggcctcacacgaagaaattctgctaacttattctgaggagatgcatggttatttccttgattctgaagttgctgcatcatcatattcataagctgagtctgttgagcaagaacttgagcaagagtgggattctctccattgttattgttactggggccattcccgttgctgcgagtgttcaccatcaggcatgggcagggcacaagaagagaaaccggggaaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaacttaaagcaagcaaactaacacaacgatctaagacaacgacttaacaagtcactctagttcttccgagcatcggaggtcgattgaaggctcgttcgactcgtcttcatcatcttgggttgctacccactcaatcttggaattgttgcgcttggattcttcttcttcatcatcacttatgatgataaccggaggatctgctaaagttggggcaacttctttctccaccacacgaatctttggcgccaattgatagcgagggacaaataaagctctcttccttgcggtaagacgaatcctggccttctgcggcggtgcttctcccttcaactcagctaattccttctccaaacgatccaccttgtcttctaacttgcaaatcttaccacgattccggtcttcacgatcttgagccgctaacacagtctccgcacgactttcatccatagcccacagcatctcaaccaaatgccttgtggtagcatcattctcaattccttcagtctcaaggtagctgccacggtcacttccctggggttggcgaggatggtagcgatactcagtgtcggccaactgatcactgtagcgatcacggagctctcctatggcgatccttgccacctcctgacatgcatggatgtagtttcttcctccagcttcgaacatcactgagggaatatcttcactattactgttcaaggtgactttgactcggcacttctcttcatgacgatcatgacgaatctgagcataaaaaggggcagtctcaaatccaatgacaaaggacatcgtacgcaactcctggacaaaaccatcgacaccaaacaagtactcaggcttgtagcgcggcatctaaagacaagtgaaaggagggagttaagacatttatccaattaatagcacaagtttttagattaatttgaatagagttagaaaatcaaagtaaaaaggtaagtaaataaagtaaaccaagctttgcatgataagttgaaacagttggaaacgaattttgtacttttgaacatcaggtttcaaaagaaagttataaaatcaacatgctaaatttattttattgcagcaagattaaataaaacaacattgtaaaacttttgctgataaatgagccattagtacagtaatagatttacagtactaataacactggaataaattttgaatgagaaccattaaaagagattatgaagtgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtatgtgaaccctcgtccagaaatcagccgaggcacacaataacaaattgataatagagtacaattattactctaattaataagcgaataaaatgtcattacagaggtagatagttcctctcaatcaataaaatctaagcagcggaaaataaattaaacggcgcagacgactccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaaggataccaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatataccattccaaaccaggagctaatcaaattattaccagttaaagcaccttttattatgatgagaagggtgagactaatcacgaaagacattgttagacccgcccataaccgcgggcacggctattcgaatagttttactctgatcagaggtgtaccactgtacccacaagacacaaccccacatcttgtcaccatgtgcctcaataccaccacggtacctcggaaaggagttgtgacaataccccttgcataacacaatccaccgcagcgcacctttcctggatcataatcacccccttataaacaaggcatggactccccagcgacccccgtgggcttatctccgccacttctcagtctggtgccccgcaatgaaccatgctatacaaaaggtaaagccgttgcccatgctggcttgtggttggcacggttaatgtttcacaaccaaaactcgtgaactggtccttaattgtcatgagcacgaccatcaaaaccatgtgctcacaacccaccattatcaggttttagttggcaaataattaattaacaaatcacgattgaccatcgtgaactatcattaagccatcattaaataatagtgagtcataagttatcccaataatgtgctaatgtttctaagcagggctaagcaattatatctaatatctagctgaactaatataaataaagctcaactagtcaaattataataacccaaggtatcaaggaataagataatcaagaacaaaagggctataacaaacaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaatcatgaacagtacatgtggatatttttaatatgtagatctcaattttagaaaaatttagagacttgaaccaactaaatcggagctaagatgaactagttatgaatttttgaagattaaatcggattaaaacacttaaattgattttaattgaattatgacgcaataatgaattatttttgaaaaaggaaaaagggatttattgcgtcagcgggctagggtttcgcggtggaccgggcgcacggcggcggttcacgcgaacggacggccgagatcgacttgatccaaaacggacggccgagatcgatcggtccacgaccggctcacgggagagggcgacgatgacgtcagcgatgacatcaccaccggcggcggcggctcagcggctcggacggcgcacgctcgccggcgaacggcggcgtttcggcacgaacggaggacaccaacgggtagcggacggcacggcgaactcaccggcgaccaaagcgacggtggacgaccaacggacggcgacggtgacgaggttgaaacggcggcggtcttcggctcgacgacggcgacgatgctccggcggtctccgatggtggcgaagcggcggacgaggacggcgacgacttggcgaccacgacgacggtcttcccgagcgacggcgacgtctggaacggcggcggcgcacggctggagtgacggcggcgacggcggcgctagggcacacggcgctagagtgctacgggcgacgagaggcgaaggcgaaggtggcggcgggtagaggagacaccgggggtccttttaaaggggctaggaggcggcggcgaaggcccacggcgaccggcgacgagaaggaaagttcgggaaaaacgaatccgaaacaaactcgaatccacgaatttccaaacgattttagccgatgtttccaaaggagaaaaggtagaggagatcgagaagatcatttcccctctattgattcggccggaaacggaaaggaacggctggatttggaaggaaacggcggcggcggcgcgctagggtttcgggcggcggtggcgcgaggtagacgatgggtccgacaggtgggacccacctgtcagcgacagcgagggcgcgcgcgcggcggctgcggactgggccggctgggccgaggagagaggaaggagttttgggccgactttcggcccaaagccaaaagaagacttttaaaacctttttcaatttaaattatttcttaaatgaaattccatttattaaaaatacttccttagctcaaataaatcctagaaaaatctaggaattatagaattaagcaaagtatttattgaaattttatctggcccctttttatattggaatttattaattaaaattagatcttctcttcaagacttttaaaataaattctaaaaattccatttaaacaacaatttatatattttgaattttcagggtgtgacactgatcatgagaaagaactccaaacccctttgctatgcgagtaatcaaggaagtgcattctattggagcagtgaacttcacattttctaaccattgcctaatcatacattgcacaggaacaaccttgatctttctaactatggcacaaagaataatcaactcatcctccctaataggtctaagatctcctcaagggaacaaagtcatggcaatccatttatgcatgagcctaagtgtgggactataaatgtcattagttctgagtttcctgcaaattggtgcaccaaaaatatcttcccaaaatctgtttttctcaaaactggaaattatcttctgaaaatcagatctacagacatcatgaaaaccgagaagtgtacttaagcctctccttgtaagctcaaattctttacaaaaaaagacgaaaagaaattccatcttccacttcccgcaaggtataaagaaattgcaaagtaagcaaacgagagcctggctcatctaccacagcaaatttctaccaaccaacaactttccacacagttctaaaatcaacatccatacggatcataggcttggctatgagcaaatgtccggtccttgagcatccggtaggcttgtatttcccgatcaccaacgagctctaggtcggagtcactcaacaaacttggtgcggtgtctacatcctccattgcgatgtcggcggacgagtgagcattcaactcgtcttggtgacggctcaaatgagaaccagatccattcttgaacagacgggaaagtcgtatcttcatctctgcagaaatgagcaaagcacaaaaacagactcgagcgcgggttaaagctagcaagacttctacccgccaaatcttctcacctagataacttgtgtatgcaagagggaaatcaaaatgctagaactaaaatttaagacaatcttgaattagctcaaaatgaatttgggagcaaaagagagtttcagagagagtgaaagtgaattgaattgtgatgaactccctctcccggccaagccacttatataatgcacccataatggctacaactgtgaagtgggacccactagccattacctcccaaaagggggcagccgaccgttgcctggctggttcggccgaacccctggtgggccaagctggacccacattcagccgttggactccaacggtcacatgtgtggggggccacgctgatgatggccgaatactttattattttttcttagaaatttcattttgcaaatttatctcaaaattttaaatcctaatgtaaaactcccttgaaatttaaaacatgctttaatgcaaaaaatcaaaatgatgaaaaataaatatgggatacataccaatttacctattggcaagggcgacgtctttttgagtccgacgagcaagaccgtacctccaaaaaattcagatcattgattttccaccctactccggagctggtgtagtggatgtcgtctttttgacttgccacacctttttggtcttaggtgtgggtggcggctttctgggcgccggctttacaggctgcttgacctgcacaccagttttaactggtgtcttatttggacagggcctactcattgacgcttccttcactaggaagttcttcatgaacgcaatgaggttgtccgtctttggcggtttcacttcgaccactctgatgttttgtggattcggctcatacttgatcttgaccattgagcattgctccatcctcggcctgaacttgaatttcttctccttctcattgatgcaaaaccgaatgtttccggctcctacatcaacgctggcttcagcatttccttgtctgattccatgtcaagcaccacaaaatccactgggatgaagaaatcctagatctttgctggcacatcctcagcgattcccgctgggtagcagaccgacgagtcagccagctggagccgcatcggtgttggtaacaacaccgtgtagttcagcttgtcaaagacgtccttgggcatgacgcttacgcttgctcccaagtcgcagagggactggtcaaagtgttgtgtcccaatcgagcatgtgattgtgggacacctcggatatttcttcttctccgggagccggtctccatatcgtccgcggccggaccgcagccgcctccatgtcgtttgccgccgctgcacctcctcactactacaaatcacattttcccgtatggtcaaaatgcatctttctatgcggaggttttgtccgtctgtaaccaagggtctgcaaaaatgaatattttcgcatgcgggcaaaccaactgtacagaaaaatccatcttcatatgcagttagattaggtggaccgcacggaataatcaaatttttgcgtgcggtccggttatgtcacccgcacagaaaaatcaaataccaaaaaaaatcaaaaatcaaaaaacgaaaccctatccggccggctggcgcgcatgcacgcggagccggcggcgccgcctcatcttcgtcgctcgaggccgccaccggagcttcgcgggggagggcgattgagtcgccgccttcaccgtcgaccgcgccacgaccgcccggccgtcgatgagccattgccgttggccgggccccccgttggccggccgttgttgtgtgcggga

SEQ ID NO: 70162 - DNA, 1432 bp, Oryza sativa
attcctgcagcccaatgcatgttctatcggaacacaataaatgcatacaaggcacaattaaagatactactactatatcgatcatatttagagcaagtttaatagtatagccactattggctctaaattatttatagtcaatttaatagctagtttatacaatattacctataaacatacactacacaattaatatctggctccacctgtcatacacacatacatcttggaggctgttttgcagctgactataaaaccgtagtccgttgctcttatatatatctcttattttatcttctcgaaatgtgtttgtagagtatgctattgtacctgctcctcttattgatcatatctcacgacctgtttagctatcaacggtttgacggttaatttaggtgtacgtccaaccatcattaatatattcgggtagtaactataaaaaatgagccatgcacggatggcagccagatacacataacatggggcggatagtagacggatggttaatttgccccaaaagtacgtaagagtagttatattgctggtcgatattctctagcttgtcacatggatgctactgcaatagtacagccaagctactagatttcagtatttgtacatacaccctattagaatcaatatctttgctagctgggccagttatgagtgggcaggaaaccgaatcgaaccgtacttttcttgttcttgcttcttggtgttcggtttctgtttcattttgttgtcggtctattttacgatttttaattgcccgaaatagatgggcccactccaattctattgttacatgaaagactaagtcccgctactgtctctactactttatcccccctccttcccttcgggagaatttactatttgtcactctaccaaaataccagtgttcagatgccactctcctaaattttattcccaaataccactcgggcccacatgtcaatctcatctaacaccgggtcctgcaccacttttgtttgaatgccacttttgttttctagctagctatcaattatatatcctataacatgataaagaactgatgtttcatcattttgtacccgtgggcacggttttaagccacaatccatgtccgatgaaaaataaatacatgtgtgaaatcaaaagagaggccaatgtaatgcaggccggtgcccgagtgatgaaatgtgaagatagaaggtgactatataatgcaatggttgcactgtcaatactgttgggccgacggcgaggctctagtatagggtggtgctgggggcaacaaagccaccgaggccgagtttagttccaaattatttattcaaacttctaacttgtctattacatcaaaactttcctacacacataaactttcaacttttccgtcgtatcatttcaatttcaatcaaacttctaattttagggctgcaggaat

SEQ ID NO: 70163 - DNA, 26352 bp, Oryza sativa
tctgaaagctcagctgcaagccaggcagccagcaatatataccgcttggccgaaggatccaaatatctaatcagcaaggatgaaaagtagtactagtacaatagtgcaaaagtatagctttgtatcatggaccaaggctggcatacaccctgtgccgtttttcacatagcatttgtctaatctgaatccatcacactcatacgtttttgcttttctcgcacgcttaagatgagaaaaacagactggattaaagctggattaactattttatctttttgggggcaacctgagacactatgattagagtttcttggtgtataatggaattgtaatgatggacactgcatcaccttttcacttgtgacacagaaacttggaatgcaattgagaaacatatcagaaattcgaattcacaacatggcaaactgttggtacctcaactgggagctctctaaccaggaagttgaactcctccccccacaacgggtttcttgagctaggcaccatggaactgcaaacgcattaggccatgcttgctttttagaatgattttttagctcagacatgattatattagaacaaaatactgtgtgaagatgaggcatagcgcagagaagttgtaatggcaggtgacctgaagcgtctttgctcgccgcaggagatgacggcgtaaggatcggagctcccgttcaagttggcgccgatgaggtacttggcacagagcagctccagctgattgcaaaaacagaaaaaggcacacggaaacaattcagacatggagtcaattaaccttgcagataatataagcaagtaccttgatcacatagctggttctgccccgagagtgagggctaccatctggaagagcaacctgcaatgcaaacaaattgttctgataattaagaaggaagtgcaaatgtgcaatgcaaacaaatataatgtggctcaccttgctggtgcctccaagttcagcggccgctggcttccccttcgcccgccggcgccggcagccgcagccaccacaaccaccgtctcggcggcagctcgcggctgccgtagtggtaggagagggcggcggcgacgaggaggaagccggggacttggtgctggactggaccgcctggtcgaggaagaggaggagcagtgccgcgacgagcagcgcggccgcggagacggcgacctccgcctcccacagcgacggcaggagaaaaccccgcatccacgagctgagccccgcagcctccatggcaaactcctcgaggcaaaaaccaaagctcggttcgtgcggggcgctgcacgcatttaaagcgagccaaagcccaagcgtagcgtggtgcaaccgcgcggttggtgatcacgctaccactgactagctagtgagattgccaaaggcgagagagcgagcggaaggacacgctcggcccggggagccgaaaggcacaaggctacaatgattagagggcaaaatttttgatatagagaatatggctgtatttagttcacgctaaaattggaagtttggttgaaattggaacgatgtgatggaaaagttaaaagtttatgtgtagaaaagttttgatgtgatagaaaagttggaagtttgaagaaaaaatttggaactaaactcggcctatgtaatagtacgtgctggcatatgcatgctcggacgcacccttccatagttgataactgattgttgttacacggacactatttgtcctgttcactttcagctttgtaggtgccagtattttgatttttaatgttgtgttatgttgaggggttagaaacccacactgcttaagtattagctaaaaaactgaaaatggattgatataatttttatatactttttaattaacaaaatatactatttagtggtttgggaaacatttttttctgaaataaaaagtagaagttggaaaaggggtaaaagaacacatgctagctacacctcgcgattcggggcgcagtgttgtgtggaactgtggactgggcgttgttgtcgtattttgctacagtgctggctttttgccgctcagtacgttactctgttaagtgcgtaggttgttctggaatgggcactctgcatgcttttcccatgtaatagttgcattgttgcaagcctgccactacgatacttctacaccattattctctgttcctcagcaaagcaaatattcggtgtcaatgtttgcatttatggactaaactttaatctttgtcacatcaaatatttagatactaatttagagtattaaacataaactacttataaaactagttacgtaaatgagagctaattcgtgagacaattttttaaagcctaattaatccataattagtacatgtttactctagcatcacatagcctaaccatggattaattaggcttaatagattcgtctcgcgaattagtctagagttatggaatgagttttatcattaatctatatttaatacgtctaattagtgtcaaacatccgatgtgacagggactaaaaattttagccctatccaaacagacctacatgtactgtagtgattggacaggaatggccaatgcccaatattatggacaagacattaacacagtcgcaaatagcactgatctagaatgtttgaatcatggaaatttcacgcaaacaattgaacaattgggacggctagatcgacgaagcagaaagaatgaagagcttgtaagttcatgatcgagagcggcaaattgaagtgcaactcaaagccacttcatcatgcggaattaattataagcgcgccggccgtagcatccaaagtttgatactttgccagttgcatttcttggtgctttatcattctattaaaccacgcaaatagctgcgatcatagcagcatcacagcatgcatagcaatttttttttcagctaaagctagcaaattaagaaacgcaattaatattgcaatgattggaacgactagacttgtagttgtggccttgtgggacactcgctattcgttaatcaatacgtacttgtcaccttcgagtttcgacttaatttatgtagcggtgaggctcgatcaggaggaggagagataaccgggatctgcccgagctgtaaagcgtgagcaaagatggtggcaggtgaagaagaacggaaaagaaaagaaaaggcacgtacgttttcggagagtccaattgttttgggggggtatatggtgctttcatcaatcattactaatctctccgttttatattataaaatattttaacttttgtaaaatcacctttttttcattcatttaaatctataaaaatacatagtaatatttttaacccaaaacaaatatactattaaaatatactcaatattatatttaataaaactaattaaatattaaatatattactaaattttcttaaacttctgtaccttccctttttttttctccagggaaaaccttggatgttgtatggtggtaaaaactttgtttctcctcctgcttaattaaactaaaaaaaaagtcatttcctccatgccggccctgcgcgatcgcagctactgtgctgtgtccgttccaacgccaccgtcgcgcgtcgcgagcacctcgccgacaccgacgagcgacagcatatctgccggcagtcgaaacggccccgacttcacgggcgcaccgcgcgcggtggacggatcgcgtcgcacttgcattacaatgtcatccggcgcacgcacgcacgccgtcgcaatccttcgcggtggacgccgccacgctggacgagcaggcgaggcgagccgcaccacgtaccgatccacacgcgcgaaccagtgttgtacagacgcgtgcgggccgtgacggtccaggcgcagccgcgcggcagccgaattagcgtcggcgcggcccgcagccccgcaggtgaagccgatatgggccatcctgccgaccttgccctccgggtccaactccaaaccccctgcgtatgtgtgcaattctggtggccgcacgtctcgcggtcgcgggcacgcgaatacgcgatactgtggaattgtggaagcgatgtggtgctcactaggcaggggtagaaatggtcacgaaaaagcgccgttccgtataatgagtaacgttttttaccgttactgtttatggctgtatttaatttttgttttttctattttctttatgcactgtattaatatcgacattgagtagtttaagtgatacatatggtcaattgctagccgatcgaacgtcgtttccgaagagatgctatcgattccgaccgttttcacccttttttggaaacggtcgaggaaaggtcgaaaaacagctcaaccatcctcgtaacctttttttttctgaaaaccaaaaaggaaaatggtataaaaaatgttgaggactctgaagcggaattgtacaaacagaaacatgtcagaatcgatcggatcatcggaaaccgatataaatgtgctttctcaagtaccctacaaattttcaaattgtaaactatactacctccgtttaaaaataattatctttctaggattcaaaatttattctaaaatacttgtacttatcccatacatcacctcctattaaattttgtccctattctactcttagtcaactcccaaccatacatcatttaatgaggaacattgtaatatttatttttaaaccttaatctatactaaactatctacatttaacgagtagaatgataaatatttgaggattgaggaagtatctttttagccttgctcttaagttagggatttgattgaggagctaacaggcctcattagatcaaatagagaaaaaccgtacatattgagggtatctagagatatcgtaagtaccatattataaaaacggtaattttcgcaagaatacggtaagataaagataaagaaacagtcgatataacagcgaaatcatttctatttttgtttgcatatttttttaatttcatcggttaccattttcacatgactcggttggtagaaataaaaaaatgagctttggttggttggtaattttcgtgaccgttttcacacctcattgctttgcgggttttgccttcctgcccctcgatcggtttcacgcgattttgccgacgagattacgaggcactactgaagtagtgcagtttacctgatgtgtgatgaccagcaggcaagcaggcaggctcagccgcagaaaatacgtgcaaccgcgggcggcaatgcacgagtcaatgcgctcagctggtgaaccgaaggcaccaccggccggttcagtgacaaggctccgacatcgagtcctttacaaatcacaatggatagaagtctacttctcaacccatacccatgccatattgccatacaggggttgtcacgaaatgtttatctgtaacaatctataaaatttattggaacgcattgtcagcaaggtggtcgtgccggagtggttatcgggcatgactagaaatcatgtgggctttgcccgcgcaggttcgaatcctgccgaccacgtttttttttctcatttctgccttctgttttcacaatttccattcttttcgtttctgccatctgctttcaaatttccctttttctttttcgtttctgccttctatatattttcacatgtttgaaaaagataagtcccagttttccccctctagtttaaaaaagatatgttccatttggtccaaagtacgcaagtatagcacctctgtaaacgtaacgggcatactactgcacacgccaccatccgtccatacccgaaatgccgaggtgagcacatctctctctctctctctctctcagtctgaccctatatatccccagtgatgatgaacaaaatctccataaatgaactctcgtaatatcccactgtatcaaccggatttcgcgaggctcgcatgcacacgccgcattagccaaggagtgaattcgcgattgaaaaccaatctggcattaatgtgtccgatgttttgttgccaactgctaaatgaagtgccagcagagttgccccccttccaaatcattccttcgcgagtagtagaaactggtgttctcatttgttcgaaacacacaccaccaggcagaggcagattttttctcatttcctctttgctttttttcatttcccaactcgagttcgcttcgatgatgcagcagcttcatggctccgactccgtgcaagcgcagcgccgccgcccaaggtgttcgtcatatgcatatgtgttcgcacacaaaaaaaattcctttctctttttttcccctcaagaacacggagaaaaatatctcgttttccccttttgagaattatgatccttagatctgtcgttgtggacgtgtttgatggtgatctcttcgtgcgtgtgtgcttgttttgatgcaggaatggtgacgccgccgccaaaaagcagccgtggtacatgcgggcgttgggtgggctgatcccgtcggcgcgacgtgccgccatagctgcgccgccgccgccggcggctgccgtggcgggggcggtggagaggaggccaagctggtggtgggggtcgtctctgaagacgacgtccgccgcgttcgcgagggaggtgtgcatatgcgctccgctgtgctcctacgacgggatcatgggcatccaagtcgacgccgtggcgccgacgatgatggcgaggagcagcgccgctatctctccctcgccaccgcggcgggcgtctccggccaggtcccctactgctggcgccgccggtggtggcggtcgccgctctcccgcatcgccgcggacggcgtcgtccccgaggtcgagcagggccagggcgcaccctgcgccggtgtccgtggcggcgccggcgccggctgcggcggccgtggaggggccgaggaagagggtctccttcagcggcggcgagtcgctgtggaacgacgagctggtgcggcggttcgtgcgggcgcaggaggggatgccgcgccgcggcgagatagacatggccaaccgccaccgccggaggaggtggcgggcaccggggaagagccggctccgccggatgtcactggcccatgtcgccgacgacgacgaagatggagagaccaacgctctggcctagctagctagtggcgtggctgctatgtggtgaggttggctagctatatatatagctcaggttgctcttgctcacaagtcccctttggttatacttttatgctcttgaggaacatgctctatgttgttagggttgtgatgtccgttcgatgctacttgttgcggaagaaaaccgcgaggaataataatagactatccgttactatggttgggatgtcggttcgttgtcgtttaccggaaaaggaaattgcgagtactaacggaatatctattagtaggattggtatgtcggtttcactttaattattgcagaataatgtttgcgtttaacgcactggtggttattatggttgggatatcggttttatgcgatttttattgcagaagtggtagaatgaaattttgaataatgaatgtactatccaatgttgggggttgggatgttggtttgataccaattactgcagaatggagttgtgagtaatgatacacgctatggttttttaggttgggatgttggtacctcgctgatattacaaaattgaaattgtgagtaaaaggctataatatcggttagtagagtttgggatgtcggtttagtgacaagcattgttgaacaaagttgtgaatatcacattaaggtttactgttgttggaatttcgaaagggaactgttgttgggattttggtcatggtctattattgcgcaacgaaaatatgattaattgacaattggttatttagagttgggacataggatgaattaatgtcaattactcctactttagaagaagtagccagtactatactatccattttgcattgttaaatagcagtgggatgtttggtatttttgttgctcctaagtttctatttcctagcacaagaattttgacaaagagtatatgtgccggtacaataagtagacttgtggatgaaacagtatgttgacagaagaaaaaagggctggactaactatagattttacagtatcaaatgataaatactgtatgatttagcatacttcataagctaattagatttttataagataaacatcatgaatgaatgtagaagattaaaatcaatatatatgcatcttagaaatatgaaattagatcgtgaaacctcactttctttcagccattgtaaagaaaatcatcgtggaccaccctgtcgggagtagaagttggatagagcagtaatagtacaatacagcttcccttattttgtaatgtcaaaattatgattatatttttcgtgtgaccaaatatttacgtgcacactgtagccagtttgaaaagtttttactatagattattccattataatatctagctttaacatggttttaatcttttcaatgcatgtctcgttaattcttttttttacggagaaatgtctcgttaattcagatgttgtgagtgataagttagagaaactcttgcagaaacatttcctttttcttttgcaaaattttggcatttcaaacatgccgcacggtggctctggcctgtatgctgtagcacatgcattggatatgtgcaggggaaaccgtgctagaccaccagtataaaatagaggatgccagcgatcgattcaggtgcaaaaccaatctacgcctatcattctgctatgctcttcgatgctgattaatttgcattttttttctgttaacatgcatatatagtaacataacattaagtcatttttttcatcttgattggttcaagtgtatatacccagttgtagtttttcatttctgaatatcacctaaaaggagacatagctgatattgtttcatttctcttgattaaatagtgtaaaagttgttatagcaaaattagcccccccccccccccaaaaaaaaaaaacagagagagagaagttaaaactatacaaggattagcacaacattatggcatgatagtcgactagtggagactggagagatatctatccttgctcccgccatgaccgatgtttgaatttcattctctagctaggaagacgatcgatgatggaatttgatgaatgaaacgcaacgactaaattaggggactggtgatgaaattgaaacattgcacggttacaaagaaactgtaacatttgttgtacatccatatgaacccaggttgataaatctagaagcaatctttctgagacaatgattgtgaacgacacaatgtaacattttttttgccaatgtgttcacaaattacaaaaaatacatttcttgccagattcttgtaactattatccatccatcactggctgatcactgcgtgttgagcacggtgaggatgcagctggagatgtcctgagagctgtaccccgtcagctcctgcagctccgagctccacggcagcgcacccggcgggttcagcgtccacctcgcgatggagatcgccgccgccgccaccatggacggtaggtagcccaggcagccgtagctctccagcgaccggtcggcgacgtgacacgccagccgctgcacgcgcagctcttccttccccttgctgtaccgggtgaagtgctccacgaacgtctccgcgttcgggccgcccagccgatagcccagtgccgccatcatctccctctccatcgcgagcacctcctgcgccgacgcgaactcgccgtagctggcgatctccctggcgtccagcttgaagaccgtcccctggtcctcgtacttggccgccgtgtacacggccgtggcggcgacgaggctgagctggtgcgcggtgtagctcggcagggctctcacggacaggaaccggtcgaagtaggacacggcgcggtggagcgtgccggcggcgagttcgtagcggtgggtgagcctccccatccaggcgacgagggaggcgcgcgccgccgcgctgatctgaccgccttgcaccgtgtcgaggtagtccggcgacgggcgctgggcggcgtccttctccatgtcacggaggttggcgtcgatgtcgtcgtcgtagggcgcgcacagctgcgggcgcgacgccgtggagttgtcgggggccggagcgtcgttgtcgccgttgtactgctcgctccactccagctgctgcatgaacgccctgatggcgtcgccttcgtcgacgggagcggcgtacacgggctcggctttcgctggaacggggaggggagggaaccccggcggcggaggaagacggcgagcgggcgcagcgtacacgggctcgtcggccagccctggaacgggaagcggagggaagcccggcggcggaggaagatggcgagcgggcgcagcgtacacgggctcgtcggccagccctggaacgggaagcggagggaagcccggcggcggcggaagaagggcacagggcaccttgacatccaccttcgtgtcccagtcgtagagtacgccgttggtgtcatcattcgatgccatggactccacctcggcggcggcggccaggtcggcgccgggcgccgctggatgcgccgggagcgcgccgatggcgcggaggtacgcgtcaagaaccccgacatccatttgcgccgcgccgccgtcgccgggcaagagctcgaccatcgaggccgttatgtcgtcagcgagaaggtcggcgacgtagggctccatgatcgaatccatggccgctctcgctcgctcgccggagcagtgtgggagactgggagagcggaggctagtggtggaagaagaaacttgcacacgctggtggcgactggcggcgaggcgatggtgatggtgtcgcgctgcgctcctcgcctcttatcctggctgccaccatgggtgttcgatccgattcaggccaggcttcgcgcgcaattccgaatcgggatcgtattgatctgatatatttgatttgaaccaagcgaatcggtgtgaactcgtactaggctgtaaaaaaaaaaacctggaattaggttgtgttcctttcctattttggtctccgactctgtcccgaattcctgatgggattaacggatagctgtaatttcttaatgatgattagttgattgtttatagtcctgaattagtatatcgacttacgaaagcgtttctttctttcttttttctttgggttaatttggcgtccgtgtgaatttggttacaagaaaattgggtatcaggttaatgtttccaaatcgttctggagtcatcaaaactcaaacacgagcgcaagaaaaatccatcaagatttctagcgctgtaaattaattcaccgatcaatactattttgggtaggatattactaactccattccatatacaccggaacacaccaaaaaaaaagtcaactgtgcttaaattcttaaaatacatatatttctctaaggaacacggtagagacattatatatgatgaacaaaattacttaagaatgattaattgatcagttagtcctgaatggtgccaaactgccaacaacatgattaagttttcgtctgattagagcaatttgaacgtgagtgcactcctgcagatttttactggatttgatcagagcatatagagaatgtgaattcgatcattatcaagctaaatattggtgtaaatctcatccaaaaatcaagttagagaaaatacatgggcagtttgttttgtctatctaataacgccgtagattatatgtattctattctttgagtccttttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaatgtattggcttcagggttgggctcagttgcaaaggcatgatgaagatatcaagctaataaatgatgaatgtcgtaaacttgagacgacaattatgtatctatttgccaacttcgggtggaggttctctattagaattcagtagttagaggatctttttcttttgttggtgtctattagtttgcttagctttgtttctgctttcgtgaactttctgtgtgagttctgtaataattggctgtaactctttgagtaaacgccggaatgttacattccattatctaaaaagaaatatgtattattgggagtaagcaatatcagaaagcttggctccgaaactttgttcaatccgtataaaacacttggctccgaaagctcgactttgtacaaatatccaaaaatcgcagatgacactcatcaggtgtgagaatatagatctcgatgatgtattggagaacatactggtgatgcgtcactaccagtgaaatacctgggattacctttcaccgttggtagattgctcaaggcagacctccaaccactcttcgataaatggcaggaacgatggctgtttggtgggaaagaaacatggggctagctagacgcaccactcaagtcaagtaagtgctttccttgcagccaatctatgtcctaataacgcttaaatttaccaaggtatccctataaagtgcttgacaaccaatgaaagagcttcctatgggtgggttaggaaaacataacgagcgggaaatgcaaagtataatgtgctcgccaactgcctacggcagcctgggcgtgctaaatctagaaagctttgcactagcactacatgtcagatggctatggtatgaatggaaatccctggacaaagcatgggtcggcttggataccctgtgcgacgaaaccgataaaatactcttgtcaactacaatgataaccattggggacggagcaacatcacatttttgggacttagcctggatgcacggtcgccacccgaaggatgtcatgccacaagtgtacacaatctccaaagggaagaatagaaccttgagggataccatcacagacaatacctggtcgcaagacctaaatctctcaatcatcggagacatgtcaactaagcttctagagcaactagtgaccttgtggacaacagttcaaagcgtgcaactctccccaggtgttgtagatgaaatcatttggaggctcacaaatcatgaagaatactcggttccacctaaaaagagtagttccttgaatccactagcacaaactatgacataatcatttggaaaccatgggcacgaaacaaatgtaagttgttcgctcggcttgtgatccgtaatagggactggatattagacaaactagtgattcaaggatgtccaaacaacacttactgcctgctctgcagacacgaattggagactgctttccacctcctcgtggactgagatacatgagaagaatctggaacatgctcgcaaactagatgttgcaagggcacataaagtcagccagctggattcccgctatagtccatacctggtgtacaatcatccggaaagcgtaggcaccaaacaaatgtaagttgttcacctagcttgtgatccacaatagggactggacattagaaaattagtgattaaggatgggaaactgtttaacagctcgagtgggcgtccacccatttattgcatgtcatctaaatggttatgaaaaaaatgaaaaaatatgaacaagatagatcaatatgtaatatatcaatccacaaatatgcaagttgaaattcaacttctacaaattgtaacaaacataacaaacaaaactcaaattactatatgtatatttacaattaaatttgttatttttgttacaacttttagaagttgaatttgaacttgcatgtttatggagtgatatattacatattgatctatcttgtcaattttttgaaaatttttcgtaaccatctaaacgggtggacgtccactcaagctattaattagaatccatctccgattaaggatgtccaaacaacacttattgactgctctgcagacacgaattggagactgctttccacctcctcgtggtctgcagatacatgagaagaatctggaacatgctcgcaaactagatgtcataagagcacataaagtcagccagctggattcctgctatagtccatacctagggtatggcgttgcaacctaacctaggacatccaggaaagatgtttgcactctgctactactaacggcatgagagatatggatagagctcttgacaatatccctcgttacgaaaataaaggaggacactaaaacttgggccctagtagaagcaaaatgccttgcacatatcaatccttagtttttttagaaaatactttcccatttccttttccttttcttttgtaaatctcttcttcctatacagtttttccatcccagtatactcaacgaaattggcgcacctaaataccgatttgttaaaaaaaaaaaagctcgactaggtggttcagccgttgtgtactgcatcctagtgcaacagataccaccatctatcacgtggcaggtggcacgagaagttgtgagttcgcgaatgcatgtacatgcagtagaccagtaggaagaagagaaacggtacagatcgatcgataaagatgtacagaaaccagagtacgaaaagttagtaattttgaatttgatgaatcatacatatttcaaccaaaactcacaaatttggacttatagatcgatgtacatacgaacgctagcaacaaaattgaagccatcatgcattgcatcattgcatggttgtgcctttacagactttttttttgacataagcttttacagactctcttgttcttcctatacattggctatggatcctggaagaagtactcttgaaagggagcaaagcgaggacatgcgatttgactgtacatgtcgcagacgcagcccatcaagtcgatggcctcgtacccggtgagctcggcgagatccctgctccacggctcatgccccagcacgtgcagcctcgccaggaagatcgccgacgccgccaccacggacggcaggtagcggtggaacccgtacgtcagcagcgacccgtcggtgaaccgatgcgccgcctccttcaacagctcctcttcttttccgtcgccgtagtacctcgtgaagtgctgcacgaacgtggacgccgtcgggccgcttaggttgtagtcgagcgcggcgaggatctcggtctccatgcacgacaccatcttgtgcctggtctcgctagtgtagccgcaccgggcggcgaccatgctggcgtcgatcttcctcagggtgtactggtcctcgtacttggcggcgaggaacacggccgtggccccgacgaggcggagctgcagcacgtcgtccgactcgggtgtcaccgacaggtagcggtccaggaagtaggcggcgcgctggagcgtgccatcggcgagctcgtagaaccggctgaactcgtccatgaaggcgatcatcgaggcgcgcaccagtgcggtcatccgcccaccttgtgtcgtctccaagaagtacggggagggcctctccgcggggttcgtctccatggcacggagggtggcctcgatgtcgtcgtcgtagggcgcgcacagctgcggtcgtgtcgtcgctgagttgttggtgaccaccggctgatcagcgtgctctggcagcagtggtgcgacatcgatcgtcttcttgggtggcaccgggtgatcgccgccttctggcagcggcaaggtctcctggacgacggtgacggagagcggtggaagatcaccgtagattgggaggaagctgccgtaggtgtgaggggtacggggggagtccggtggcggcgccggtgcgagcggagctgccggtggcggtgcaagcggaggcagtgcgccgatggcgcggaggaaggtgtcggtatccaccatctgcggagtgccgccgccggagaaaggatggaacattgggagcgatgtttgatcagcaagaagttcggcgaggcagggatgatccatgatcgcgtcctccatgtagggatccaagatcaaatcccccatggtcgccggagcccggaagcgagatcgagggagagcgagaggagtcaagaggcggtggcgggaagaaacttggacggtcgcgtggtggtggccgaggaaggatggtgccgcactctcgccttttatcctcgtgccacgatccgactctgatcaggctgcgcacgcgtgaaggaatccatcaaattcaaagttcgcgcggttttccgaatcaggatcgaactaatgatgtttgattagagaggactaagcgcgtgcgtttctttcctttgtttgcatctccgactcgatctctgtcatgatgaaattcaccgatcatacgatactattatacatacactgacacacacacgcgaaaaaaaaagagcacatcatcacgcaaaaagaagtccaagcactcaaattcttaaaatccactagaatggtagattaagcatgggagatgacataccatactattatggattcatgcacattgctagagaagttacctaacagtgagcatatgctaacactctatcaaaatcttcaggatttctaagcagctgagcagaacaaaaacatggtggacgtccaatcgagtgactaaaagagaaactacctgttaatctttcggtagatttatagcatcgatttttgtagaattttcaaccaatcaatgtagctcgttttaagtgaaataacataaaaaaaagacaagcatgtaaaaaatcgtaaatataaagaaaaaaaatgttgcaaaatctaattttggtgtactgtaattgagtgtaagagctatgtaattaagtgtaactgcaagttggatatagaagagcacaaattttgatgcaaaatcctacggatgaaaaagtgaaagataggagcccaaaattatgtcgcagttgaaacaacaaatccgttaaaggagtttcctggacaatggtaaaagtgcgttaagcgagttcaggtaaatctcaggcaaaacgtaagcgtagtactacctctattctattatgtatgacgctacaagttaaactaaaacgattcaaaatgtatgacgttgcagggcaaatcatttatgtatgacacattgtgtaccgactttgcccctatcctccgatggcgccgttgaattctcctcctccgctaccattgcgcaccgcagccggttccgcctcccaggcgatgtcgtcgtcctgacctccaccatggctagatctagtggtagtcagtgtttaatctttcggtttgatcatttttagcggggtggccgtaatatcgcaattttgaaaatttcagcccgaaattatatgaatttttaaataaaatttgatacaaatttaaacaaaatgttactaaattcatgaaaagatgaaataaataaaaaatttcagccaaaataatatcatactgggagatccaatagaactgaaatttcgatccgaaattttgaaccgtggcagtacaatggctaaagtggtttctccgcagcggcgttgtacgagctctgcaagctagcggagaacatgcatcgcatcgtgtgtgcaagcgggcgggcgcccgcgctcaccgactctgcccgcgtcgcggatgtgctcatcttcttcgccaagtccagtgagagccgccacgagctgtccactgtccggtatccctagcatcgtagtcctgctcgccgcagccaacattgtcagcagtggcaacacccgtgcaatcgagcgtgcgctcgtcgtcttcgattggatttgtgccaagatcaacgaattggcattggcatgggaggcaataaatcttggtctaagagaaattcttttgaatcccaaatcatccaatctgaaatgctctatgatatttttctctgaaatggctcctgttaaattccaatgttctcaatgctgtcctgtttcgttcttgatgcttattcagatgcttgttcagagtgacaaggagcagcggtcttgatggatccaaaataaaggaggacatgtcattcccagaaacatttcatcatcttacagctcatgtataaactgaagtagaattcagaaatgaactgaacaccaaaaagctgaatcttaatcaaggaaatcgaggaaaattttgtatcttaatcaagttagtacggggccaaattcagctacaggatcacatgtcactatcagctgtgaaggaagaatatttttgttctgctttaattcaaaaaaacctgaaatggaagtaaagaaaacaccaattacaactgatgcaatatatattatgtacaaatacccagaaagaaataagattaagagtataccaatagtctggacacatatgtaattagtccttgaacacgcggcacgccccatcctcgcatgactcttccttctgggcccatgacaggattttttttttcgccaatactcgtcctcctgtcctgctcttgcaattctcacattcacttccaatgattggtttgtgatcaatggacaaatcaattgccttaagatgcaacataaatagggaaaataataagcatcaaattaatgcattagctagcactacaaaaatccgtaattttcttggcggccaaaaaccgccaagtatagtatgaaaatcgccaagattaattattccattggctgaccgccaagtctagaaagctagagatattcagattccgtggttgctaaccgtaagggaatatcttcttggcggtcgaactaccaagcaaattaagaaagttgtgaactttcaaatgcgccaagaaatgtaaccttgtccctttagaccaacaaaaatatatctttccttggctgctgagaaactgccaaaaaaattcttactcttgaccgttagaaccgctaaggacattttttatccttgacggttagtaccaccaagaaagattatccttgtcagtcagggccaccaagaataacttattgatgtccaaaactgtgtctttccctggcggccctacctaccatggcaatcaagaatatatttggggtgtaatatgagtaatttccatggcggctagaaatgctagggccgccaagaaattatctttggggtacattatgcagatacagtccaaatattggtgacacacacactatatacacacatgcagtccaatgcaacacaacatagcgaaagtaatgtgaaagtcaatatagctggccattatgtgaaagtacgccgcgagaatcgccaacatttccaacaatggtaattttatcttacctaaaggtataatattttttagtgtaaaatttagtatctttacgtactatctatctaaagataaaaaaaaattagtgtaaaatttagctatctcaaggtgttttctcaagaattgtaaaatttatcttccaacgatgatctgatttcctctgatgattaccatgtgtgacgtgtttcttttgtataacgacgctctgtaagcctgctgatcagggagcaaaaatcccaattgaagtgtaaaaacaaacaattcaacagttccatgaaagaaaaatgctacaaaaatgtgtgaaatgacaccggagaaaaataaaggcatacataaaatagaggagtagaataagagtcggattctatactaaagggatatacctattgtagcaggatggcgacatggcgacttagcatagcgagagggagcggctgccagcgacgttcggccaagggttgctgtaactctgatatatacgctgtaatatgttggatcggggatgtgtacccgttatcagtgcctcggggatataagctacgactctcaatgacgtcattgtgtttggatctcctatgacatttttcgcatttggtttctaatgatgatcttgggccagttttataaggcttttacgtgtttgtgaataaaaaaaagatgaagatgaagacaacctccgggccatgtttgcaaagactctctatcagggggccaaaaaacctcaatcaagttgcgttgcatggcaaccatgaacaatcaacagaaacatgtttacaagggatctctactcctaccgatgtcctcatcgatcaaccgatcgatcactgcgttctacatggcgaagatgcagctgacgaggtcctcgaagctgtaccccgtcagctcctgcaactccgtgctccagaccagcgcgtcgtgccggttcagcgaacacctcgcgacggagatcgacgcccgccggccgccgcctccatggacggcaggtatagtagccccgggcagccgtacgtagttcattagcgactggtcggcaacgtcgcgctccagccgctgcatgcacccgtagcttttcctctccccggctgttgtacacttgtaccgggtgaagtgctccacgaacgtgtccgcggttgggccatatgtagagacatcagagtaccaaaagctaataaatttgaatttgatgaattaatcacatatatttcaaccaaataacacgcgcaattttgagtttacagatcaatgtacaggcaacagtgcaaaatttaagccatcatattcatgctttgcatgcttgtgcttttacagactcttttgttcttcctatacatgggctatggatcctcgaagaagtactcttggaaaagagcaaagcgaggacatgcaatttgactgtacatatcgcagacgcagcccatcaagtcgatggcttgtaccccgtgagctccgcgagatcctttctccatggctcatgcccccgcacgtgcagcctcgccaggaagatcgctgacgccgccaccatggacggcaggtagcggtggaacccgtacgtcagcaacgacccgtcggcgaaccaatgcgccgcctccctcatcagcttctcttctttccccttgccgtagtaccttgtgaagtgctccacgaacgtgtacgccgtcgggccgccgaggttgtagtcgagcgcggcgaggatctcggtctccatgcacgacaccatcttgtgcctggtctcgctggtgtagccgcagcgagcggcgaccatgctggcgtcgatcttcctcagggtgtactggtcctcgtacttggccgccaagaacacggtcgttgctgagacgaggcgaggctgtagcggtccagaaagtaggcggcgcgctgaagcgtgccgtcggcaagctcgtgcaaccggttgaactcgtccatgaaggcgatcatcgaggcgcgcaccagtgcggtcatccgcccaccttgtgtcgtctccaagaagtacggggagggccgctccacggggttcgtctccatggcacggagggtggctcgatgtcgtcgtcgtagggcgcgcacagctgcggacgtgtcgtcgtcgctgagttgctggtgaccaccggctgatcggcgcgctcttgcagcagcgatgcgacctcgatcgtcttcttgggtgacaccgggtgatcgctgccttctggcagcgggcaaaggggcttcccttgggaaggggaaaccggcgccagagagcggtggaagatcaccgtagacagggaggaggctgccgtaggtgtgaggggtacggggcgagtccggtggcgccggtgcgagcggagctgccggtggcggtgcaagcggaggcagtgcgccgatggcgcggaggaaggtgtcggtatccaccatctgcggagtggcgccgccggagtaaggatggaacaatgggagagctgtttgatcagcaagaagttcggcgaggcaggaatgatccaagatcgcgtcctccatgtagggatccaagatcaaatcccccatggtctcgccggaagtgagatcgatggagagcgagaggaggcaagaggcggtggcggaagaaagttggacgctcgcgtggtggtgccggaagaaaggatggtgttgcgctctcgccttttatcctcctgccacgatccgactctgatcaggctgcgcactcgtgaaggaatccatccaattcaaaatccgcgcggttttccgaatcaggatcgaactaatgatgtttgattagaactaagcgggtgtgtttgaagttgtactagcttgcgccgtacgctcgtaaaaccgtaattaggcttctcccatctgtgtttctttccttaatttgtttgcatctccgactcgatctctgtcacgatgaaattattgtctagcttaattcaccgatcgatcatacgatattacatagactgacacacacggtcacgcgaaaaaaaaaaagagatttgctcccatccagcaggtaccatcggtactgtccggtacgaaatttgagccatccaatcagctcaatcggatgatggaaaatctgtggtacctccaggtacaaatttgcccatgaggtggtaccggaatatttggagtggtggaagggtaattttgtcttttcgcgtagaagtgtccaggggagggaaatagggttttctaccaaatctttgccattcgatccgtgagaggagtaagcggcgagcaaatctccccttcccatccgatccgatccgtgagaggagtaggcggcgtcggcgacttgcttcatcggcctggagttgatccgcgggaggcggcgggatctgtgggaggcggcggcgacttgcttcgtgggagatggcggcggcggcggcgagttgcttctgtcggcgcctacttgctttgtgggaggaggcggcgtcggctgatccgtagccggcggcggcggctgatccgttcgaggcggcggcgaggtgctccgtgggaggcaaggcggcggcgggggaggcgaggcgacggcggcggctgatctgtaggaggcggccggcggcgaagtgctccgtgggaggcggaggcggcggtggcatctaatccatttgaggcgcaggtgtcggcggcaccgggttgttcgtgccggcgaggttgtggcgggcgcagtgatgcctagcgcggcgaaggcctggtgctgcggtgctgctggtgacgggcgcgacggtggcctggtgacggccgcgttcacgaggtgacgacggcggctggtgcgtgacagccttggctgcgaggtggtggcgtgcgtgatggtgccgcccgcggtgacgaggtggtcgtcggaaccggcgttgtggcggcagcgggtttgggctttgcgcggctgcagtggcgaggtggtcgtgtagtcttcttagccggcgacgtggcagtgtatgcatcgatttttttcatctaatctaaatcattagcttctgttggttgcagcggtagatactttcattttctgggctgcatatgctcttcttcttcattgcttataggatttgtattgtacgatttattggatgttttaatgagctcagttgttgcttgttctatgtgaattttcaaatgttcaataccctcccctatcatttactgattacattgcaattcgagtgacttcaaaataaatcatggatagtaacaatgagtgactgcaaaatgataataggatagaagaaagaaattgttgatagcataacgagtggtacactgatgagttgcttgttttaatcatggatagttacaatgatgtctatatgaatcttagcctagagctagttgcctacatttgcctcggtcactaggcgtttaatatcttgctgcacttcaatcacttcgttcatagtagaattaatgaggttggctacaaccttatgtttgaaagtggtggttgtatcctgaaaagcaagttatgaaaaaatatcaattaatgtcattttatttacaaagagtactgaatgcaatttaaaattaccatttcattgaactcaggggagagttcttttccattccaatgctgtatgaatttcaatgtgtgcaagccacatgaccagctgttgcaagcatgttctttgtaagtggtaattcgttatagataatttgcgacaaaaattaactgtttgtttgacttgtcactttgctgagggactttcattgggcagaatggccaattggtaatcctggtgttcttccatttgttttcaacgccatcttctagccttgcatactggataaacttttcaattccttttatctgagttatcaaatagagtattacatatctaatgtaaaaagttagtaaggaatagtgatgaatctaaaggcacaatgtagcatactgtattattgaggtctttatctttgtcgtagtagctcttttccatgcgcatcgagtctagtatttgaattttttctttagcaccattgagaacagccacgtaccaatgagttgagtttctattgagtggtaggaaaatctacataggaaatgaaatgtaagtcatgcagttattattatgaaggatatttgagggaacattgatataacccatatcatgttgcaaatattttgctgtaacttttgctctcttgtctcgatattgcttgttgcgggttccaatttgttcaccatttgttttccaggcctggcaatgtgctgtactttctagaaatgcagtaccatgctctcttggactttcacttgcatgtctttaatcaacataatgtatgcatctatgacctgtgaaagaataaagaacaaaatttagatactgataatattacgttgtatggaagaagttaagtatttcttacactgcctttcaaccacttgcttatgatttgtgagtctttgggattgacaagtggcctaagaaattcatatgtaagttgtatgccatcaatacttgatagcaatttttcatcatcatcacattgcttcatgtaattgatggtaatctcatcctgcaagctcagttctgtagtttttggttccttacttctctttagagcacttgcaaatgttttttttgtagtataagaatggactgtctgatctgtgagttggcttgctaacccttccatgtggacgtctcagccttgcaccgattgtgtcaacctgataggatcaattatataattattactgcattgctaaataatttaatatgttgtcatggttgtaattttaattgaaataccatgtttttttcaaacaaactatcatcatcgctttcaatgatgtgtggagcttcagctatccctatatcaggaatgcatgtgattttgaatgcttgatgagaattctgaaatgttaattttggaagggattagagttgtaatagtgatatcatattacaagataagaaaatagcagcaccttatgatccatattctttccatcgttttgattatcagtttttggaatttcttttgtttgggatgagtgctgcaaaatattagtaatgcttaggtactctcatagtagtaatagaaatgtattgagatatgttaccaccttctggtccttttgatcactccacagaatggcatgtatttcacaggagttcgagtaaaaacagcacaatggtgctagtagacaaacaataaacaatgtatgctctgttcacagctgacagtaattaagacaaaagctccattcaacgatatacatgctttgttctccagcaaaagcttgtgcttttcacacaaattcattacaagaaccatgacagattgaattgttcattacaaaataactagaccacacaatataatcctctgaccaacaatacaacttcccaaacaaggcatattcaacttccaccagtgcaaagaaacacttcaaactccagattcaacttccaccagtgcaaagaaacacttcatacttctcatacatcttcttctactttgctgaaaataaaatcacagatcaaattagtaatatatagagagagtttacataaattgacatattcaaaataatcatattatatttcaccttaggaaaattggacatgttcgaacagtgtgcccatggccacgacaataaccacaacgcctaacacgcttctccatgaatcctcgtagtctttttgttggagctcctttaggcacaatttccataggatcatggaccttatcatgactctcaatgtctgtacgtaaactttgcgctagcacatgaccacataaagacaaatctgagttctttgtctcacattcatcagtttctaagtccaatttttctagcatctccatcaccattaaagtagtttccttagacaccgagcacttgaaaaacacttcggtgcccatgctacgcaacctgtgatatctctccatctggtttgaccatgtatatacttcgccatacctatcagaaggaaacatgtgtttcgctttaattgtccacctacgcactatgcatgcttcaggaatggcatcgagcttcaaatgatgcataattgcaaccatatgctcacatgggaggcattcacgatccatttttctgcatgtgcaatttatgctcttcattgttgattccacatatgtacaattcaagatttgtagcatctcagaatcacctttcatggaaataacatacttaacc

SEQ ID NO: 70164 - DNA, 18584 bp, Oryza sativa
gtcatgtcacttgccatgctggaaaaaaaagaactagagaagtaagtacattaaaaggaaaagagagggatcttgtcaaatgtcttgatattttcatgtgtaaccaatcaaaacaaaaaaaaaactctcaatgtcctgataggctgctaagccacatgttaaattgtaccaaaaaaaaagaaccagtgccaaattgaaacaaaatgtataattgtgaacctgtttgataccccttgcacgaaatcttaaaaaaatcaaacaagatgcaagttgtatcttgttgctaactcattttaatcagcactgaagaatttttagcaaaaaccagcttgcatgaaagttaacatcgacaaaaaaaataataataaaatgttttttgaagctctataactgcaaattaatgtgttgaaccaaaatttgattacagttacatatacttgataaaaatgtcaactacaacatcttggtattgcaaaaattgtgttaactattcgcatgattatagttgcacaaaattataattaaagttgtacaaatttaaaaccaaagttgcacaacatttaaaaatggcaactatagaaacatacggatgcaattgctataggacgatgaaaaaacttgttttagttagtaaataatagtactatgtataccatatttcaaagtgatacgactctattatatatttgtacaaactcagcttatctgcatataagtaaatgtcaaaaacaaacatctttgtgttgcgaaaaaaaatgtattaactattagcatgattatagttgcacaaaaatcataattaaagttgcacgaatcactaaccaaaaagttgtacaacattaaaaaatgacgactgtaggaacaggaaggtgcaatttttgcatataaaaaaagtaacaaaactggatggatatgacattattcaaccacccacatgtccaagctcagcagcaaatcaaaatcttagcagaaggaaatgtactttttttaccctgcagcaagctccacccccccccccccggggtagaatccaacgctccctgaaaacaaaaatcgtagtgagctactacatctgagcatacaatcagtctgaagttgtgcttgtttataaccaaaattaggaaaaaaatcgtatagtagtcagctaaaaaagaattagttgcacaatttaataattgaaattgcatatatttataacataacttgcacgaaatgtatagtattagttgattttgctatttggacaatgctactggtatgtagatggttcaagcgggaaaaacacagtacatgaaaaaaagagaggcacgcttgctgtcgtgtgttgatgagaaaaaaaaaagattcaacataaaaagtagtatgggttgcaaaaagcaaaaacaaatgaaaagttcgacataattactaagaaaacaagttgtctaccaaaaaaagtccccagttgtatgcatgttttcctaaaacacaaacgctatttatcaaagtaaacggaaaaattggctcaaaaaacattaaatgcacaaacttattacacgacttgcacgaaaaatcaaaatggctactacaatagtcagggagtgcaactagcatagataatctcaaaaaaacataatttcaaaaagattactctcctctctcaatgctctgctggtaatctcaaaaagattaaacataattgataggagcagagcctagagttcattttcagggaggcttatctcagattgatcactgatggaatggaagcaaaagtggcttagtatgtcacagttgagcagaactactgttaaaaaaaatacacagcacacaaaaacaaaagatagctttttctgtatacaagcacaaaaaaatctccctgtatagagtgaccactaaaatggactgattaactcaaaccctctatgcacaaaatggatctgacaatgctgagggacaaaaggtaagagcatttgtagggatttaatgaaaatattggttagttgttgagctcaaattgctaccaaatccctaaacccctctctaaaatgccacggcacagaggtcatcactggcctacaggataaaaacgactaaatctagagcaaaaccatgtgtgtgcctaacaaatgaagttagggagaaaaataattagggagaaaaaactaggcagaggcacagcccacctcccaccgactatatcataaacgatgtgcggtaaaaaccctaaaaaaaatttccccaactacaccaaacaaaacatcaaagcacacacatcatgtgggtttcagatctagggatgctttgctcgacattggtccccccatcccgccccctgctactcgtgccctgcaccaactacgccgcacacgggttgatctgttgggtcggatcgtgggttttgttggcgacaaaaaaaggcccacggtctccatgtcttttttaatttgaacaagtatatatattggttatatggaatattttgatttcacatgatgacttaattgttcaaaaatctgagtagtaaaaatatgtgtaaaattatcaagatgctgcaattgcatacaaatctatcgatttcttcatttgcaattatcaaaaagatattggaaaattgttgacctaacttgttctgaattgtgctcccaggtaatcatgaaacatgcagctgttgtctaacaaaaaaaatcataataacttcaaatttcaggagacgtgcaggagtctaaagttgccagatggctggagaatggcatggtaaataatccttaacatatgtttgacctccttaacatatgtttcatgaagaaaaaaaaattcagtaaaatgatttaagctaatatctatttgacctcctctagacatagcttggtgttaacgttactactcagatatatagtcttgtttaggttcacaactagtttcaggaaactgggtgttcaggtattaaatgacaaaaaatataatctgttgtgctgaattaatttttcctctagtctcaggagaggcactggcgtgtgggtttggcaaaaaagaaagctgaaaggagttgatattactcgaggtatttgagaaaaaaaactaaacaaaattatacttacatttgactgatatgaggcatttaatcttgcccctgcatattatctagattaacataaataatatgaattggcacacaaatatattgacctctgaatcttgtacctctgctatgtcaggttttaacaaagtacacatatctgaatatgagaactgtaccttgcagctacaaaacaaactgctacaaaattgcagctagagttcagacaaaattaactattgacaactatctctgtctccaatgacagaactgcttataactatttctaaaaaaaatgacaaaacctatttctctatacattatgtttcaagttgggagcaaaaaactgaagtaagcatgttattcctctaattccagctcggatggtctgtctgatgagtactccataatgagaatgacccaatggtaagcatgtttattcgcaaatttatgggctatatatatccagttattcttcataaatggggaaatgatttacatcaaaagaaaataattagtgagaaaatgaagttagggagaaaataattagtggcaaggtttagaaccaggcagaggtgcagcccacctcctgccgactatatcatacgcgatgtgcagtaaaaaccctaaaaaaattttccctaactacaccgaacaaaacttcaaagcacacacatcatgtggtttcagatccaggatgctttactcgacattgggcaaaatcaactcaaaaacatatacccagtaaactccaaagcatcaaggaatgaaaaaaaactccgcgggattccccccccccctcccttgaaatggtagccaatccagccctaaacaactcacaaaatccacatgatagaaaatctgaagctgaggggatcaggccgtcgcggtgtgagatttgaacaaaaaagagagaagaaaaaacctgaagtgcctcaactcaagcgcgctcgccttcgaaggcacactcgcggtgccttccccggcgccgtccgcggccgctcgcggtgcacagcccacctccctgtgccccccctccccccccgcctccccttccacctcctgccttggaagaatctccggcaccttccgctcgcaggactccgcctccccctgctcgagaaaaacacaaatgctatctactcgagaagcagaagcgctttctagatgagtcacgggtgcgggcggatttttccagagctatttgtgggctgtgggctgtaggctgtgggctgtgggctgcggactttgggcttattagcaagggaaagatgatggcgcgcacaaaatcaagacacataatcgacggtcgatgcgatcgactgatggattaaaatttgaatttggatctctaaactgggtctctaatcgggctctccaacttgaagtacgtccatcagcaaactaatcagacgaacatgccacgcgagaaggcattcaacctgatcaagccccgcgtgcatgtacttacggaacgtgaacgcttggacattatcgcgcgcggctgatcgttgttatttcctcgtaaaaaactttgaaagtgagacaaccttgaatgcgataatttcatgttcaactaatgccaatatttgtaggcaatacgattaatttctttgcttgtcaataatacatgtacatacatacacacacaagcgtacaacaaacaaaaggtgttacaatgcagctctgaaccctcatcgttcatgtccgtgcaacgaagtattgcactcatgctagccctagctttgtctctcctaccaactaccggcgatgtcgcaggctggcactgtcggcctccttgaaccaccggtgccggagtgcttgcgccaccgtcatcctcttctccgggttgcacgtcagaagtccactcaacacctcgaacccagcctccgacaatggcggccggcggagcatcctggcgtcggccggagatgggaagaagccacgaagaaagctgtccggcccgcatcctcccagcagccgctgccccttgtagcctcgccaccgcttgatgtcgttcacgccgaggacgtcgacgatctcgccgagctgctccctgtccgagctcccgcggaacagcggcttccgggcgaggagctccgccatgatgcagccgagcgaccacgcgtcgacgcgctcgtcgtagtccgtcgacccgaggaggatctccggcgcgcagtaccaccgcgtgccgatcgggttggagtagggcggcggtgaggcggtgctctgcgacaggccgaggtcgcagatcttgaggttgccgcgcgcgtcgacgaggacgttgtccggcttgaggtcccggtgcatgaggccggcgtcgtgcatcctcttggcgccggagagcagctgccgcatggcgacgcggacctcgagctccgaccgccgcgtcctcccgccccgctcgcgcctcaagacttgacgcagcgtcggccccacgaactccatgacgaggacggcctcgccatcgtcgcatcggccgtgcgcgcgaggctgcacgatgtaggggtggcccctgcacacctccatggcggcgacctcgcggtcgaagtcggagcggtcgacgagctccccgcagtcgtctcggtacgagcggatgcacttcatggcgacgatctcgccggagcggcagtcgcgcgcgcggtagacgacgccgcatcctcccgaggcgagctcgtcgagcttgacgaagcggcttgtggagattatggatatcccatatctacacggcgatggtatttgggctgaatacaggataccaaatatagatagaatatcttatttgtgtctcgggtttgtttctcaacttgtacatcaaggaaataccttgagacttagtcggctacgactgtattttatctgtatctgcctattccgttagggatatagattatcttttgtaacacggactccttcccatatataggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggtttcgtctccggcatcgacgacctcgtcttcccatccgggcagacgtttcggttcggcagcctcgacttcgtcaccaacaacttcggcaagatctctctccttgactcggagtcaaaccagccgggagagaaccggatttcagtcccgtttggactcccaaacacggctgaaagttacttcaagaccatctcaaccgagtcggcttcaaaccactcgggcgagatcgcatcttctccaacgtcaccagatcaagatgatggggcttacccaccgatcctgatgaggctccccgacgatttggcggccatctccatcacgacagcgtctctatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgccccaccgacaccgtggagtatgacgagtttagctctcgctacaacgacccggatctcgacgacttcgacggaagcctagatgacaactacacccctctctacttcggcgtcttcatggccgaaaacgagacggaggagcaacgccaagcccgggagaccgaagcacgtcgcgaaactgagcgtcgccgactggaggaggagcatcaagcacaaggacaagaacgactacggcgtgagcagcaggagcgtgagcggacagtgaaggaggctgaggatcgacggcagcgagctttggaagcagggcgccgagcgcgtgatctcatcggccaacaagatgttgaagggacaccggttttccgcacccctcagcagaacacggttgccgcgatcactctcctcgacaccgtcctcaaggaaaacgagctcaatcaatctaatcacgtcgtcaacatcttgaaccagacgaagaccatgattgcggcttcagtcccagttaactctgaaagcatccacacgccgactggcagccgggtcccacacttccgatctcatgattaccgtcatccaagcctcagcatcaccggcgcaggatccaatcgcaggagcaggggtcacgacgagcggtccgttcactcacctcccgaccatcatagggagcgccgagtggaacggcctcactcaccacctcatcgccgccccgtcgatcttcgcgacacaatcatacagcgccgagcagctcgaggccatcatcattcgccagaccgccacgacgacgaccttgacggagtaccagccttcactgacgacctgcgtcgagtggattggccagccggcttcaagccgactggaatagagaagtatgacggtaccactaacccagaatcgtggcttaccgtctacggtctcgcaatccgcgcagcaggaggagacagcaaagccatggcgaactatttaccagtggctttagcggattccgcccgatcttggctccatggattgacccgtggtacaattggatcttgggctgaattacgcgaccacttcatcgccaactttcaaggcaccttcgagcgtcccggcacacaatacgacctctacaacgttattcagaaatccggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaagacagtcaagcttatgttcgaaaaagccaacgagtatgccaaggccgaagacgccgtcaccgcatcaaagcagtcaggtcccagttggaagccaaacaagggtacgccggctaagggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactccgacgaagaacaaagtacgtcgaggaagaaggacgacggcgacaccccggcaggatttcaagaccaccgtaaggagctcaaccatatctttggcggccccctggcttatgagtctaaaaggaagcaaaagttgactgaacgggagatcaacgctgttcagcccgacacgccccattatcttcgatggtcagaaattgcaatcaagtttgaccgctcggatcatcctgaccgagtggtccacccggggcggtaccccctggtactagacccagtggtccgtaacgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagtttatggtacatcggaggaagacaagagtactcgggaagagcaggctcaggattctgaacataaaaccagttcgcatgccaccctttgtttgaagtcttgaaaggcattgagaagtacttctggctcagagtccccctcagctggaatccggccccgccgactacacatggcttactcttgtttggttgggggttgagaaagaagattcggcgaaacagagcaaagtggggtttaattcccaagaaggcttcacaaacatggatgaaattggcgatgtggactatggaatttggatttaggtgatgcaagctgattccatagaagcttaatatcccgcggaaaaattttgaggtcggaagagcgaagccgccatagaagaaatgggaaaagactacaacctcgtgtgtatcgggggacggaaaagcctcaccgcacgctggccgccacccgatgatctccttggcaggaagaacgccgtgcgccaccatctccttcaggttctcctccgtcacgtcggatggtgcccattggccttcaaagctttctttctcttccgccatcgattttacccgaatgcactgatttgattcgagggatggctagggagaggtgagggattgaggcggtggatcacgggaaggattttgatgaactttttgaaggtggattcgagtggaatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagcccaatacttttgacagcgtggcccattgtgttccttagggacttaggcattttttttgctttggcaatttatgcgcacaatagtgttgcccaatgctgataaaatcctttttatgcggtcatataattctttggaattattgcaatgcaaattaaaaggtgcccgacagaaaggtgttatactgttttttgtcagctttattaggctacaaaagctgtttgggttaacttggaatgacttgtttttaccatagtcatttccttggtatgttatatgcctgctttctttatggtgaatagtcatagcctaggctattagacttattcattaccataatttttataatatttggtgggtaatctttagagtttttattcggatgcctgtcaagtgtgttcattcgtgaaccttttagagtgttaaccactcggattccttttattatggctaaaaagcagtcggctaaaatgcctctttaggcgccgcgtatgcttttgtcatatgacgcacgattgtgctattattttgttctcgactatatgtttagtttgttaactaatcacatagttgggggctacacctaattaggtgcatctattcgatgcaccatattctttgtcttttcgccctttacagtctttgtcttcgccactcggcaggccttggcatgagaagtttgaagcactcggatcattatctttgagaaggctatgatggttgactgcaaaggtcgtgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcctattccgttagggatatagattatcttttgtaacacggactccttcccatatataaggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacacggctgatcacgacggaggaggccgtcgccatcgccatggccgccgagataggtagcctagctagggttttcttttccgtcctctttctttcgtggcactcgagtcgatatgacgcaaatgcaaacgggttcaggaggagagaggtagcaatctatttatggctggctgggctacgcacgtgcgtagcaacatgagtccgatgcggtctcgacgaagtagtcttggcgcgaagccgcgaacgcagtgatgctcgcatgcacacgtattcggactccgagttgaaatcaggggattgatatatttggtgacagagatatatatgttccatttcatgtgtaacgcagctaaacaaggtttttacacgtgtatgcatgcatccgtattccgtgcgtcggtgcgtgcaatttcgccgtggcctgtagataactagcgtgcgcgcgcgtgccaattcatttcacttcgggtttccgaatatgcggggacgcggccgctcgaccagctgtgcaaagggatgaaaacggtcggaatcggtagcatatctttgaaaacgatacttgatcggccggtaattgaccatatttatcatttaaactattgatcagtgtcgacattaatacgatgcagaaaaaaatagaaaaaaacaaaatttaaaaatagcaaaaaagggtacgtataggcggaaacggtaccccttacacggaaacaacgctcggtcgattgggaatttccatgactgtgtgagtcagcctgtgcatatgtagagagcggcgatcgcgccggcgccacttcctggcctccgcatttcgctctcaaccacggcaccaccacccgctcacgttccgccccgcctctcctaggccgggcccacttacatctggtagcttttataggtcatagactgccctcacagaccaacacaagtctttctgcaaactttgtcctcactcgtgcgcacccgggaagattttcccggtcggtcacccatccctaaattgctctaggcttgtcctcactcgtgcgcactcgggaagaatttcctggtcggtcacccatccctaaattgctccaggccaagtacgcttaacctcagagttctttagagatcggcttccagaaaagaagttgcaacttgttgatatgagtattctattaatcctattaagccctgggttaggatgtcacacctccgcttctatctggtagctatgtctcgtgctgccatggcgccatcatccccttgctccccagcccgtcccctccacgtctatctagcacctgcgccgcgcgacgccagggcgccactacgcccactcgcgctccacccgttcacgcccgccacctctgacctctgtgtcacacctccactgtgcgcgtcaccaccgtgccactaccgcctttgtgcagtcgagcgctatatacctgcacctgcgcgacctccatcccattcctgtgccgcaccacgccctgtcttgtccttcggtggctagcctctgctactctatcctccccttctccccatcgtctccatatctgaattgtaaagctttgccaaaagttcatgttaatttgttgagtaaactatatataccactggtccttcaagatgaggccaagtgtcacttaagtccacaattttataattcggcatttagatccatgatcttgtctaagtgaataatcgtgggtccaaagcccatttgacaagattgatttgcctacgtggctccattgtgaccgtatctttgcatttaacctcctctgcacccgatcgaccaacttctcaccaaatatcccctcttctttgttgtttaaatttagggtttcagcggcggcaataggggcggtagtggtgatgtgactaggacagcaacgacgagggaggcaggtagggcggcgccgacaagggtggtggttaggcggattcctgaagcatgccaataggggaagccaatcagccatggctactttaagcaacgggtcttttcaagtgcatagaggaaaaggatcaatctcccgttgattatgtgcccttgttgccttgcaaaacacatctccaaacactgcggaagcgcggacagcccacaatcatcatcgcagcccttggaatcattgcaatcatgcgggggtggatggttgagtgttcgacagagcgtgggagcagtggccacaggtagaggggatatttggaggagaagtgggtgactaggcatgaaagggactaagtaaaatttgtggtcacactagacagccacgtaagccggtgaacccgatcagacgggctttggacttatgatggttcactaaaacatgatcatggacatagaggttgaatttacaagattattaacctaagtaacatcatgccctaactttatgaatcggcggtgtattttactctaattttttagagggggatactaccaagccttgtctcgtagtgtaactttataactacaaataaaacagagttttacatagcaaatacaaaagaaaactaataagcaattacaaatgttgtaatcaatcagcaacttcctacacatacataggagaacatcattccgaaaagcaaaccaccagctatcaaaaatggagtaatattttcaaaactcttcccattttttcttccaaatgtgccaataggctatgaagaaaacataaaagaacccttttcgcttgaaccgaagtattgctaaatccactattttaaaaaaaaattgaaacggatattccaagggatacccaacttctttcagcaccttttactgaaaggacggcttgtttggctgcaaggtacaacactgccatacaactgaaccacaacctattgatcatttgtttgctgcatggtgtaatacccggctggctgtatggcaacactgcactaggcagccgaacaaagccaaaggaaatacagatgcaagagagtttccctttattgtgtagagcaaagaacacaggttaagttagcgtgaagagaggtacaattctttctatcgaacatgtcccttatgttaagacggtctcgaaacaggagctagatgaaggttttgattttcatcccacactcagttttctataaccacaagtttctcttaattcactatcttatatcttacatttgtttgcaaatttctgcaagtcacattaattcacgtttgtgtggaagtttctgttgatatttctcgcccttctgtttgtctctttttttttttttttgctgccatcgcatctgaaactagaccgggtcaacccaccataagagcaccatatatgagttagactatgagtagggttagactaatgtgtgggtcgggttgactgatagcttgcagttttctgcccgattcaactgcacccctaaatataatgacagagccagaaagatttttaaaaccgagtaaaacttaactgtatctagtatttcttacagagattctatggttatttcagttgctaaaaattcgttggaacgtatgatggtcaacctgggcaagtagctgcctgtggtagccggacagtggtcagtggctctgcctcaggtttggctaagctcatattttgtcggcccactactcaatgcatacgaaccatggcatctgggcctaaggcctggagggacatccttaccattttccgatttacgtacattttgctgtgcaaaagacttactccgtaactaccaccattgcagccatgagccgtggcagctaaaccaaagcatgcagtgacgctgaactaggttggaacatggagaccgagtcttatccataattaatatcctgtagcatcttgttcatcctacacaagctaattttcttgagggtaattaagtctgattagccctctaaacttttgcagacgtttgaattacctcatctattcctataccagatattaacatccaaactattgaaacaagacgaaatatatctctctaacacaatcaacgtacagtagtttttgagcctagaaaagtcaacaaatcagtaaaaaaaaatttaaaaaatcttaatctctctctctttcttactctatcgggcagcaggcccatcgatatctagaaagacgaaatgagatttttttttacggtgtttgatctaatggtccacaataaaaggtatcacttaaaaagatatttaagtattgatataggtacttaggtagtaagggtaaaatgataatttttctaagaaatagagaagggcataattatcttcgtattagttctaagtacataagtgccgcatcggtaccttatctccagtatgcctgatgattctccatacattatttacatgttgtcttttcagatttacattcttttcctaagaacatgatcaccggtaatcctccattccgatatttacgtgtttttttaatttaccttttctccctaagaacatgatcatgatatttttaaggttgatgtcatgttcctaataataccatcagataaaatatgactgaatgtttgcgtgattattttaagatttatattttatcacaagaaacatacaacctcggtaaatcaccggttgtaggttcaaatgtaattcatcgtcaatatgctatatttacatggtttgttcaactttgcatattctctccgaatgaacatgaacatagatactataaattcaaagtacaatcttaaaacaaaaaaaaatcaaagtacaacatatgatagtaagtgaagaaggaaatggatcagatatgttttttttttatcatgcagccatgttgtttggggcgaaaaaatgtgtctttttttattattgtgttgatcagagtgcaatcgctacaattgaggaaattcttttaaaaagtatttttctctttaattgtacggtaatcaacaacgttaattactgagatcctgatcctgttctcgcatgctagaaattaggggctaatttggttattattgtttccaacttaatcatcatgcatgcatgtatgcatgctaaaatttaggagctaatttgactgctatgtacgctactttatatagaaacacgcatgtccacttaattttaaatttgtgatgcatgaaaccacacaaaaatacatattcaaatattataaaataataaaatttatttcgaagacaaaatgtatgggaagatttatattttctccactgaacgatacaaaatgtattggagacaaaatgcctcggaagattgacatatttttctactaaacaataccgatcaattcaatttcagccaggtatttgagtaacccaaaatgccaatattttactagataattacttcactgccatcggttacgataacttttattccgtaacttacccttctcttgatcaacggttcatattgatctacctctcaatacctctagatacctcgcaaacactgtaaaagctctcaaagagtaataacagggacagcatacggcagccatgagaaggaggaggacccatcggccacccgcctgctacaacttccttcgctctacggcagtacgccgtacgcatatcggcgcgtcggctctcctccgccttcgcggcggtgttcgtgagagtggaggtgtgcaggcgacgatgcctccgatgcgacggccgaaaattcacggtggcgtacgtcgagttgtgacagcggacggcaatgagggcaggcgcgtggtcctagcagggaaatgtcaccggcggcccgacaccatgaggaaaagagagtgatgtggcctccgtgctccgtgcttcatgccaaattggatctgaccggatgggagctaagctccatgcactcccgtggtggccggggtgcaggcgcggcagtgtttgggcagccaggatgagttatgactctgcatcggtctctcagccatcgtctccgctgatgatgattgttcaattcctcttcgattcccctctcccagcgaaggcgccagcgctttctcccccgaccctctcccaagcacaccactgccagactcgagacacccaccattgagacgtaagtaggtcaaaccacaaattagtgagtaacacacaaattgatcgatctgtggttatctactaatttgatctataagtgtgttcacggattgacccacttacacttctagatacagcaagccaagccacgatatatgaacccgttggttttacccacttatatattttacttataagtgccttcacgggtcagtccacttacacaaccagggttgtgggatccaatagcaaaaataatctggcctacactaaaatggatgtattttggatagatatttcggacgaattttaatcaaatatgaacaaaatttgaatcaaatggagatgaatttaggggataatattgtctcggacctcaccgagatgggcaaatttcaccaaaattcggatctttcggtccgaatcccagaaccctgatccctatttccccattgggctctagcctcaagcccttaccgtcgtcaacactgaagagagcagggaagtggggtgaagaatgacgagagagaaagacatatgcagctagctattttttttaaaaaaaaattgatggctcattctagcacatgggaccaaaaccaccttataaacagcccggcgtagattaagggtgaaagatcgatctgtgaggtcgtcacacctatcttacgccgccgttgatcgcttgccaatggagaagaatagccgatttggtgctgcgggcggacatggcaactctgctgctcgtgggttccatcctgctgcgggcggtcatggcaactctgctcgtgggttccatcctagttttggcggcgggagtcagcaaggtggtagggaccgaggttgaggaaggggagggttcggcggtcgaggtcgccatgatcatcctcaaggtcctcaaggtggaagatggtttggcagtgggcatggttggaacaatgggttcgggatgaatgcaggtccgaacgtcggcaatttcagtggtggtggtcagattggtttcaatcctaacttagggtttcagccacagtttggtgcttccggtagccatggtggtaatccagttggcccttttctgccatcaggtgagcctgtgaccaggggttcatctgtagttggtggcgcattccctgtgggtggcggtgctgctttggctggtgtgtctgtccctgtgccggctggtgctggttgtggtgtacatgcgcaagctggtgctgcatatcctgtgggtggcggcggaggttctggtgctgttcttggtggagatgcggtgcctggtggagctgctttttcagttgctgttgcttccttgccgaaggtcgggggagttcagcctagtggctcagctaatgccgcatcaggtggtgcaatcgctcaggtaactggtggttctggtggtatgtaggggcaaggtgttgccggatcagctaaaggcaagattggtatggatgcttcggtaggtgggtgtattgctcaagtttcagatagtactgtcaagggtgtagctactttgggtgatggtaagggctctactgctgttgcttttggtgcagaaggtagtgtactctcccagatgccaggtgatttgtataacagaggaaaagctaaggttgataacaaagggttaggtaaaccatattgtttcaggtgttacactaaagggcatacaatgcaagaatgttcttccaagttatactgtgaaatttgtgaatga

SEQ ID NO: 70165 - DNA, 18264 bp, Oryza sativa
gtcgccgcaccacgaggtttggtcgctgcacctcgttgccggatcagcttccgtgccgtcgtcgccgttaccactgcaggcaccctttcaccgcctctgagaagactagagaggagaggagagggagacggccgtgtatgggaggagaggagagggaggcgactgggagaggagaccgccactcttggccgccgcccgcacccctccccaccacgggtccaccgaccacgccgctccccgccgccagatccacctctccaccacgaccgcccctctccttcaccacccaccgcggcttgcgactccccgggccgccagatccaccgcccgtggcctgagtcgccgcagctcgcgttgtcggcgcaccacgagcttcgtcgctgctccccatcgttggatccgcctccgcaccacgagcttcgcctatgctcctccccatcgccggatccacctccacgcgccgtcgttgttaccactgcaggctcccttcacctctgagaataccggagaggagagggagacggccgtgtatgggagaagaggagagggaggcgactgggagaggagagggatgcggtgggtggtgggttgtgggctgtgggggtttttaataacgcggttgatttttttttgcaagcgctgctctctatgagtatgtactttttgctgtcggaggtccttagtaaccgccagcgaaaatcacttaagaggtccgcttataaaaagtcccctatttttacaagcggtactcttaacccagccgccagcgaagatccattttcgctgacggtccttaacgcctcatccctcgttaaaatttcgctaacggtttccacttatggccgctagagaaaacaaaaagtcaacgccatgaaaaatcgattttgtagtagtgtatgcaaatttcatgtttgtatccgtgatttgtatccattcgtaggggaccgaacctgagagcgagaatctcgtctaggcttgtatccactaacgagaccaaatcagagggtatggtaggataacatgaaaaaaaacgtgcatagaagccactcctagacccatactcatctggccgaaccatagaaaaaagtgtgaaattatgttaaaagccatcaaataaaacgaactttcttgtctcatatgcattggttgagacgaaggacataacaaaagacgaaaaattcctttggcttgtactcatggtggtcaagcctaagaatatggcaagaagatgacttcctggttcgtactcattagccgaaccgaacaacatagcaaaagaatacatcaacgtgagcagaagaacgagaaccgagagattctttgactcgcacacaatgaacgagcctaataacgaaggaggagcatgattcccaccttaaacacctctgatcttccagcacagtggagcgaggaagcagaggctgacgagatggcataggagcaaagcggaacggcagcagtattgcctagcaacaagcagcgcttctgcaaagcctacgaacagcacctagcctctacgctaatctcccctggaacttcctttgccgctagggggttaaccagcttttcgtggtttagaacagagtcccgcgcgcatccgtgggcagatcgtgggaaatggactcaacagcatacacctttctttggcttacatgtgggtcccttcattttgactggatgaatgtggcaacgtgcgtgcaggtagtggggtgaacatgagcagaccggtcatgcccctggtcgttacatgctttcccatttattgttatcattctaatctttattactccagttagccttttaattgcctggttattgagtgagagagagcgcgtgtatcctctcactgacatctggccctctcttatttggcgcgtgcgtgtttatatatccgcatcattatagcggtctgcacgtgacatgcatttttatttcacgtcgcaaaaattaggagtataattttctcatttgttgtatgaacatatattttggttttctttttaatttattggatgaccgtagtctaaaactattttatatggtgcgtacacctttcctgaaaatatttaggacatgactattttgggtgagtgggaaaaatcctattccacggccatatgttttaggccaggtgtgtacttagcgaataatcgtagtctcaatatatttatacgatctcttttattatagcacgaatttcatatgtgcacacgaccagaaagctaagtatcagcgttcgtcggtccgatgaaaagcacgtaaaaaatatttgttcacgttttttaattttttgaacgtgtttccaagatgctaatttatttttatatggcacgcgcatacgcatttctatttgcgccggaaatcatttcactctgaccgagcggattttatttttatattgcggccatatatttttggtcgccattttattttatttattcatttgactgttttgactgtttattcctatttttgtttatttatttttttacattatgtttgagattatatattagtttataatttaatacatcttatttaagatacgagccaaaatcagtgtcaacaaatgcccccttgccaaaattttggttttgcatccggagctcgaaacataattttggattcgtagggacatgatgcatgtgaagtttatcctcacaactatcgatgtgcccgttgtttgaaagattgttgagaaaattaaggagcatctctccgattatttggccacgttccctatggctaggggcagtgaggcacttgttcgttgaactcatctactactccagtcttctccctctttctcctcttctgtgcaaggatttgaggagagacttcatcaatgacagcatcaaaggtaagaccttgatttgatcttgcatactgaactggcgatctttttttttgtttcctttttactattattgttggctttcattcctccattaattaattccatttgggtttcttccctatgcacacatgcccgaaacctaccaagtcttaatttcagcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacatcaccattcaccaagtatgctgagatctctgctggaaaaatgggatccacacaccaacagcttcctttttcctcatggcgagaggaccatcacattactcgatatatacaaactctcaggactgccccttgacggtgatctttttgaagagtacgttccacctcacagtgagttagagccatctctcttgatgtacccaaagagcttaatgctacatatggacattaggaagagtcttgaagttggtggagaagtttcgcttcaggattggtgtgatcattttcacaaccgcatggaggggttgccagattcctcgggcattgagtcctcacgcatttacatagccgcctttatagctttgtggctttgttgcttcgttgttgttgggttgggtccagtccttcgtcatgggggtattggtcatggcttcctggatggccctagggtggagaaattcgttggctccgcccgccctatgttctttgtactattctttgatattggctagtacaaatcttatcatcccctcccatgctgcaagtagaccatggcctatacactttttggttggatgggcatttatttgaagaagttgtatggcaacaaaaaacaacacccatatttcccttcctacagacacccttctgctgagaagccactcatggagcataccatgtttaggatcccctaattttatacactgttgacggacgttatagaccaatctcgaccgtcaatataactataataaaggagaactagctatgcttacaatgcatatttgttttagaataacatatctccacttgtacttatagtattatttgttacaggaatttagcaaataaaataaagagaaagtgaagaaacctcactcctaagcaagcttatggataaggagggtccacaaatcaggtgtaaccatcctggaaaccgcattaactgccacaaccaccaataggacccacctgtcacccaccctgccgaagctggagacctgctgggctagcccaggttcagccaaaccctggctacgtcggctcaggtcagccctccacgtggacgctccaaattgattcccaatgacggttccgggggaaaatggacaattcgcatagctacaaccatcataactgccctataacaggaggagttcattcactatctcaacacactcaagcaagctcaagatttctcttcatactttagtttagtatttttagtgctaagtggagtagaatagaatagttctcggagtcctcggagtcttcggaagagttccggtatggctctagcagcttttctactttcatctataagactttcgaaattaatgaaatattcttctttatatactttcagtactttgcttagtctgagtattgctcttgctttatgtttgcgtcggtataattgtgtgggtagcctaccagagaggtgcaatggcatgggtttagtgtccgatttatcggttgctctatatcatgtccagaggtgtagagtagtatttattaatgtaagcatggtgcttagattactaattatcactatctgggcatatatgctgcaggacagtagaggtggaccactgatgatgacagctcaatacaggtattcctccacgttagtatatattcctaagactaattcctagggagggtactctcatgtatttagccccggttggacggccatgacaggttgtcgtaaggaactcggtaacccaggatggtctctcgaaacaccaggagggcactgttagggggtattagccacatgattgtatacttctgggtgaaatgctacaatggtatatccgtgcgcttgcggattacttctttgaccatacatatataccaggattattcatgcgccattgctgggaatgaatatttgtagtaatgtcgttaagaaataccaactagcatttctagcgctgtttctagggaagattagtaaagagattactataagctaataatcttttatatataattacctctgcataaatcattgtccgttgcaggctaacctttgtgtcatgaaaacagggtatgaaaacaggatagtgcatgactggtaaacctgccagaaaacttcaacgaaaatccagaagctttcttccagagcgtcagaccgagtgtcgtccctccgcagaagaaactttcagctaagaaaccagtcatcccagcgtcaccatgtttcaggaatatggctgagaagacacttcgtgagttcgctgctccgtccgctgacaatgtgcccgtcgggccacaggttaacctcggagacactgacttcgatctcaagagcagcctgattactatggcgcatgcaagcctattttgtggcaggccaaatgaggacgcaagtgctcacttgcagcagttcctagagatctgcagcacctacaccatgaagggtgtcagcccggacaccattaggctgcgtctgttcactttctcactcctgggaaaagtgaagcagtggttttacacgaatcgggttgcagttaacacatgggacaagtgctccactgcgttcctctcaaaattcttcctgatgggcaagacaaatgccctccgcaggagaatatcaagcttccaggagttttacaacgtctgcaggaatatgtagctgcctgtcctcaccatgggatggacaactggctcattctacagagttttacaacggacttactgtttcgtcccggaatcacttggacgttactgctgggggtgccttcttatcaaagacggtcaaaggggccgttgatctcatcgagaagatagtgtcgaacatgagctgcagtgaagaacatctccagacccatcagcatggcatgcatactgtcaaggagacaaaaatgctggccgcaaagctggacctcctgatgaagaagctagatgatcaggagaagaacaacccgtaggccgctgtcaaggcactagactcgcacatcacttgtgaggtctgcaggaacactggacactcggggaacgactgccccgacattcgtgaagaagccatgttcatggggaacaatggctatcatcccaaagaagaccaggggtggaaccagccctgcccgttctaccaaggaggcaacaacaacaacaataacggtaacttcaacaaccagccctccttaaaggtctatgtgggctccaccagaagactcatcgaggtagataagtcaaagtgtcacgtcaacgaaaccactctccaaacacagttgagagagtcaagttacaccggttttaataatttgggtttcaaagatatccggtattatggttcaaacgacatcaattgaggattggagctatatttgagggacacgaattggacttatttcctttttgttttccgtaagtggaccgagccttagaggctctgtagtaggccaggccgcgctaggagttctggcccaggcagaggagagagggtccagcgctagggttggcccccgctctcttcgccctttgcgccgcttctcctcttctcttctcttctcttctcttgggaacctccacttgtgctcgcctcctagtcctcctcctcctcctccccctcccggtaaggcggacgaccgagctgaggctgagctagggctagggcacccacctcctccccttccggtatggcctctcccctctcctcatgatttcttttgcgagttcgtccctgcgatcgatttgttaggcgagcgctagggatgcgcagatctgttacctgggtgggttggatggatggatggaacctgtcgattcgattcttctgtttgtttgtttggaacgtgtagatctgcccccaaatgggtgctttggagaatcacgcggatctaccatccgccatgggatgggatgggatgggatgccattttgactagtttgtttgatgcctgtgaaccgcctagatctgcccgctctgtttggtttccttggtacttgttgttagaacaatggaacccctagtggatgagggacggactagtgctgtggatttgggcatatggtccagtacgtgaacacgcatcgtgtaccacatggatcatacccatttttttccctttttcttgtcacgtaccaagtaatctttttcgctagatagattaggcacggctgagatatcactacatcatcatgaaaaattgagatgatttattcctgtggctacttatgttcaatgtgccttacagttggcacctaacaattgagatgatttcgcatggtatgtgcttatttatcgacaatagtgcaatgctccatttatactaatctaaactttttgcgatgcaagtttcatcttgtttctttgatatcatgttttaggtcactggcgtatctggtacacttctttttgtatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccagaaaaaaccaacttctggggacaaatctagacaaatgcatgtccagatttatctccataagttgattctttttgggacggagggtgtaaatttgcggtgaatcctcctggttattactcaaattcactccacttggatggttagatactgtaaatgaaatatgcacagttgcttctactaattatgatgccataacctcttttattgtacatctcagttttcaatatttgatgcagtatcctggatggctgctggtcggggcattaaccagctcctacggagaacactccataatcagtcctcagtaagaattttaatgaactatttattttgtattacttctgtcaaaaaccgatcgcttaccaatctttttaatatttattttctgtctgatgcctgtatgaaatgttatggtataccaatcttgaattgattattgaaatggcatgtagaaaggtattaccggacatcactataacgtgaaatgtatcagatggggttttggaaagaaatcacagttcacattcttactagttactactgcacagtttttaggggtttctgtttggcaggattgatctttattctactttttacagttaaacctgcattatgcatacaatgcttatttttgctgttctggttgagtaattagaccatgatatcaactacttatcctaattttgacaaagtttataatctgacagtaaccatttgttcaccataagtttcagtacccatgatcatctcctttttagtgtggtgacctgcttttttttaaaacattataatcatgttttcagggctcatctctgctatcctcgttccggataaagcatgaagaatcctccgctggactgagagcattggctcttcttggagttggtgcttctggtcttttaagctttgctacaatagcttctgcagatgaagctgagcatggtttggcagcagctgaatatccctggccacatgctggcattcttagctcttatgaccatgcatcgtgagtcatcctttttcaacttccttacaaaatagagtttagctcattgcaatatttcagagtctttgcatacggtatttggttattattaattgatccatgctcttggttaccccaatccttcaaacctacttcaccaatttagtttcccagtaggatagcgaaaagaatcacaatattcttttgctcccaagaaaatccttttaaccactactaccctattcttgctgtttactcattgtcttatatttgaacacttctatgatcagtattcggcgtggacatcaagtttatacacaagtgtgtgcctcttgccattccatgtcattaatttcgtaccgagatttggttggtgtggcctacactgaagaagaaacaaaggctatggctgctgagattgaggtggttgatggtcctaatgatgagggtgaaatgttcacacgtcctggtaagttaagtgaccggttcccacaaccatatccaaatgagcaagcagcccgttttgcaaatggtggggcatacccaccagatctcagtcttatcacgaaggtaatgatattttatgccattggcgttgcattgtttaatcttccaccttcaagttgtaatttactgtttgactccgtatgttcaggcaaggcacaatggccagaactatgtgtttgctcttcttactggttaccgtgatccacctgccggtgttcaggtaaatctcattctctgtcagttataccttaggcatttgcagttgctacttgctatgtgtatcgcccttaattcctttacaaacaataaagatgctcttgcatgtggattgaatcacttgtgtcacagggatacatattttacagacacatgatattgacatcaaatttgacactgttgtaactctgtaattgcaatactggttgaacttggaggtgctcagcttcaagttgtgttgtcccattgttgtttgagtgttttctctgttaatttacaattattcagcctctcatttgttgtcagttattgtttggaattcactacataatcactatttttgttcataattatgatgttgaactctattttgaaaaaaacctaacctgtcccacgaagtgttatttttctagctgtaatttttcaagctggttgtgttctgttatttgctttctgcagtgtgcaacattagtaaactctctggttgatttgtattctagatccgtgagggtttgcattacaatccctacttccctggtggtgccatagctatgcccaagatgcttatagatggagctgttgaatatgaagatggtactcctgccactgaagcccaggtaagtttctaatgcgttgttgggctcttacagttgtgacatgttgggttagcattaagggcctaagcatgattgttgtcatcctctaccacagatgggcaaggatgtcgtttcgttcttgtcatgggcagctgaacctgagatggaagagaggaaactggtaatcagctcaacttttgtccatttatatattactttcaattcgcaatatttcctaataccaacctactctaatttgatgtagatgggagtgaaatggatcttcctactgtcacttgcacttctccaagccgcatactaccgtcgcatgaggtggtccgtcctgaagtcacgcaagctggtccttgatgttgtcaactgagggaccactgtttcttactttcattaaaatgttttgagcatttaagcggaagcatttcaaataatgagtatgatgtacattctgccactggggtttcccatgcctagaattttctgttttcttcctctgctgcaaaagcattttcttcatgggagcacttgcaatttttgtcaatgttacctgaatggtaccagcaagcttctaacagaactgctaaagttcataaatctttatgttttgaactgtgcacaattcatttgtttcgagcacgctgatgatttgggtttgcgtttttatgtgacggatgcctgttgaactgtcctgttttgtgtttttgtcaagttctgtgtcgaatctatgcgttcattcgcgctcaagctacatcggtattgtcatgcgcatatcatatgtcaagcggtaccaatttggtattttttttccggtagcttcatgtactatgctgtcagaattttgcgaacggtctaatgtaacagaagatacatctaaacgaaatttaacatttgtcacaactcacttttgcaatggctaggagtagagtttacatcgacctgaactcgtaggctctgtttggcaaatgggatgaggagtgtgggaaatggatgttatttccatttttcatatttctactgtttgggtgtggatgggagtgggatatagaatcctgcttgatttgagggtggattgactactaggaaaaattattgaattaccctcaccatttgaacttatagctaatagctgtgctgtttgtttactcatttagcatagtttgaaggggtattttagtcattcttctagaaacttccttttccaatccatccaaccaaatatgggataaaattttccttcgtataaactaccaccacatcctaccaggatattatatccatttcccaatgggtataacccattagccaaacggagccgtactcctaatgagtcactaggcatttagctcgtaagcttatatgccagctcgtgaattgtccgtttagctcaaacagttgtccgtttagctcaaacgagtcgaaccttaacgagccgatgacttgtagtttgtgcttgctttactttggaccatccaaaaacaacaatttgttttgcataaaagaaagcttaataatatcaatttatttttccaaaaaaagttaacatgaatcaatgatgtctcatctaaagttttttttttgtttgagttggagttcgtttaatttgttcttcgtgttggatttatttactagagcttgtagaaatttttttcatggatttatcttgagtttatggagatgttttttttgtcgaatttcttttaattccagtagttcactacatccacaaaatccataaacctaattcaaatacaagggtgtatcaggagtacaggttgctaactcattcatctcgcttagaagacgaggttgtttattagtgcataatccattaagtttttagctaaaatgacttgaaaaatagatcttatatatatatatatatatatatatatattaaaaaacatactatttaaaagttcagaaaacgtacacgtgaaaataagggagaagttgagaaatacgagtgccaaacacaaccctcataaatattaggcatacacatgcatttcaattaggaatccagtgagcttagcgattaactccctccagttatgagtatctgtgttcaactttaatcgtccgtcgtatttaaattttttttaaaaaattaaaaatttaagtcacgcataaaatactattcatgttttatcatctaataacaataaaaatactaatcataaaattttttaaataagacagataattaaagctgaacacagaaatttataaattgggccagaggaagtaccattttactgtaggtctttgtcgaatataatggtgcgtgtgtagtggagtggtgtttccatgtaatccggggaaaaaattccctaaaccctgtcaggccaaatctttccaacccattctattcatctggctgaacccactcttctctgtcttcctccactcatcttatgtatacttcgaggatgagcagagcacctaaaataaataaagaaatatttgccgctactaaactaaactagtatcgccaaaaatactgaaatacaaagtcacaatattaaagaaatatatggtgaggaaaaaaacactttatgcgtgaaacaaatcaaggccatatcttgccatatctggccttatccaatatgtggtttgagtatcagctcttgataaatagtctcaaatgaacatgcaaaggagctcaccgttcagcaagtaaatgtagctaggcaactcaaactaaatcaaagccattctaggtacatcaagatcttaaacacaaagggaagatgaatggcatgcgtcgtttacaggatgcacatctgattttgaatacaaggatctaacacacaggcaaagcatgcttcacacaatttagacaaaccacatgcttctgctatgttgagcttttcctagcttagcaaacaacagggaaaaaggaacggtaacttcattgcttcatgtttgcggtgggggtgtgctgtcacagcctgctggcttctttcctacagctttggcttggctgccttttgcacctctatcatcctcatcagcctcatcgtcaatcagcgatccggagcgcatcagctccttcaccttgaggaattcatcatagtgagcacgacgatgttccttgaaactcagtcttgacttttcagcttctggatctacatgaacaccaacatataactaactctccgatgataccaggaaacatcccacaggaactatcatactccataagatttcaggttccctatggtgaataacagattattgccaattcgtaatgatggtatgtatcccttgcttatgtcgtcaaaagaaagtactccgtatacaacatgattttaagatgaattgacgaaatttaccaacgaggaagcaagaactaaacatttgtctaattatataaaacagatatattaagaagagctgtgtcatctgtcatcagatgcatctaggtcaaaattgaatttgctttggaagttaatagataaattggagctagcttaacatgtggaaataaatgaatattgataatcacttctgttcttttctgaccatcaaactcaaaaaatgtgttttaatcatcatcattttgagctggtacaaagtataaccttcaagatttattttgaactggttctcagaatctctattaaatgcctcctctccagatatgtacgttgctttagtagagcaatgctaagggtttggtcggtgtatgtgctttactattacaaaatgttaacatactataacttccagtaagatttgcgctacttatccaatgacaagacttttcagacatattcatgtaatttcctgataatcaattaattaatttttccatcaaaaacaagatgtcttcaaatgcatttaactgaaacagggaaaatataagagcaaattactacatgcagggtagatatatgaaaatgggaacagggtaagaggcacaaccatcatcttgttccatggcatctgcatcatcatctgaggatgcccaaccatcatcctttggatcagttttgcttgaagaagccacaccatttaaagcagttaaaatagcttcagcattaacagtctcatccagacacttgtcaaaaggacgcgttggtgacaatgaccctataaagaaagcaatggcaagacatattcaacaacgacacagtaactaatatggtcaagtaaaggtataatgagatcagaacaggaaaacatgtaccatcatcatctaccatagggtgatatggtgtcttaggctcagttatcttctgcctaacaggtttatttgattcaatctcatacaggttgtcttcattccacttcacacgacgagagctaaagaaaaacagtaaaatcaaattaagtaaactctaaactcacgcttgtgcagtagttttttttcaactagctcttaacagtccagcatttccacaccaaaaaagaaaaaaagatggtgtatgaatctaaaactccataaagttctttaatctaaaaatcaaacagtttttcgaaacaaaattcatgtacaaatcagcagctatggtgtatctgtctaagcacttagggccttattgtaagttattccaccatggtaccatcatcaaaaggagccgtgtcacctttttcttaacacaaaactttgacaagctctgtttgccctttcatcccttcagttttaacgtatcaggttctgaaatccaagcagcataaatcaacaaactactatttctgggcctaaaagattgagacatcatacttcaacaatcatacagctctaaattctcaactttttagtatttatagtaatatttgattttactaaacaatcatacaatcatacagctctaaattctcaacattgagtcccatctaaacaatatttgaccctgaagtaatccggaatggaaccactgatttcatcatcattgaaactgctgaatctttacaccacctcatattaataactgcctggctggaaccttaacttttgtaaggtaaaaaggaaaaaaaaaggaaaaacaactgtaaacaaagaggtgctgcttaaattgattctttgtcaagggcccagggttcgtggcctttcttgactagctttgtctgtggtttcttcttagcttgaaaagatgagggggcggtctttcccccgccggccgagttttgtttttttaatttacatatcatagcaactggaaaataacaaataatcctcagaatttaccaaacatacttcttggtaacgtgttatgggcgtgggcctaaggtatgcaaaccagcagaaatatgtccaaaggtaggaagcaagaattgacctcatgattaagcttcaacacctcccagtgatggaaaataaatgaagtttgagaaatcctcactcacgaaagctgccaaagtcatataatgttaaatggcttcatcatgttttcatgcaggaaaattgatgatgcatgatgccagaaagaaaaataataacatatagttggagatatgcaaatacggtaaaaacattagaacattaaggcccaaatgtaatgtgagattttttctggtttgtgtaggaattgaactgatatctgtgaaattcctgtgttttaaattaaaacagagcccaactgtcagtggcataagtgtaagataggaaagcacgtgcaaattcccagttccaacatatcgacacgacttaatatcatctcaagttgatgatcccgaatgactcataatactaacaaagttaatcaaacaattttctgcacatgacaaatgagataatgaactggtagaatgtaacttttttagagagtgcatcatgtgcatggaggtgaatggtcttgcagtgactgaagatcaataaagatatttgagcaggacaatctataaatgcataactaacccagcttggagagagcaccacaatattttgaacatagtatgctgtcgagacaagctattggcttaaagaaaaaataaacatagtgatacatttagcagcagcgatggattaactggtgaaaatggttactgctcctaccagctcagagtgatggttccatagtagtcagaaggggtaggatacccctgccctccacacgcacaacacacacacacatcaaaattagcatgtgttaagacagacacacacaaattgtgacatgctgatgttgccacaacgttacatacactatagaaataaatattggcatcatccaacacaaattactcttctggatgtgtgtagatttcataatactgagaagaaaaaccaacaccatatatatatatatatatatatatatatatatatatatatatatatatatatatatatatatatagaccattttctggttttcatttgtctgttatgataagagaaaggttttgcagcccacaaacaatttggcctgcatcaatggatgtgggggcacactgggtaccatccccaattcttgttacaagggaaccattagtaataactatcttaggttaactgacttttcatggggtcttaatcaacaacacagctccactgctgaatcgtgtcagccatgacctagtgatcactgattttccttggtagcgatggccactagacacacttgcatcaatacgcatatattatacccaccagctacaaggatggtgcgcaatagtttgtgcgtgctcaggaatggagaatgagcaacggcgcaatgacgagcaacgaattcatttattatatagaaccacaagtagtgcgggatggcagtgtaatcaaattttctagtcaggattacgatcgcccatcgactatctctacagagagaattattgtcaactgtgttcagctttatcgcaaggcgaaaaaccacaagcggatcataaatcctttggtactcgatcataaatcccccaccctagaacgatgaatccaggtgcaggcagacctaaacctaacacgcgggggcatatggggtttaatcctccgttttccgtttctaacaaaagaaaaagctacaggctagggagagaaacgagatcaaaccaatcgaatccaatccacgccgggatgggggatctccagtccacaccgcccccgctgatgaagtggcgcggaaggaggagggatgggggagaggggggctacgagctgcgagagagaggaataggtaccttccggttcgactcgagcgggctcgccggccgcgcgcacgacggaggcctccggcgac

SEQ ID NO: 70166 - DNA, 2145 bp, Oryza sativa
accaccaaggctccatcgcgctaatcccgcggtggctcccctaatcacgataacgccgccgccgcgcctttgaacgttgttgcgccatccgtcatcatccgcacttccgccgccgtcgtcaccgcaatcagtatcctggtggtccagggtttccaccagtgccgctgccccgtctcgccctggttgtgcatcctcccaccagcgtcgcagctccgccatcgccctgcaatcggtgcctcagtggtccagggctccgctggcgacgccaccccgtcgagccacggtggtcaagccttccgccgacactgagcctccatctttgtcgctgctctgtgagtcctccagtgttgccaccgttggaagaggatagactcagcagctaggcctcccagccgtgcgcctccctctcttatgttggtgatacctgattcaactcaaatcgactcttttcaatccccttttttcctctttgtgaattttccccattagttctctagctgaattttcttattcaagcttaatggtatgcatctccttttagttatgttattcggttcttctttacctttgtggataattgcaggctatatattacgtgattggtgctgcagtttcatacatactaacattatagttgtcatgttgaatatcttgcagattatcttacatagagcaaattcaaccatgcctggtctcttatcttttttattcaggcgaaaaataacagttcctttcttactgaaatggaaaatacatgaaaccctacactgcaattttctgcaatgacagggtaaatagccatatcaagcccgtttgttgctgttgggctgcctgcctcttatttttcttctttatttctgtgatcatcaacaattactagattgtcgtcccttatggtctttcatttgattcactgcacggttgatgagttcactcatttgctgccaattgttgttgactaatttctttttcacattttcttttatctaaatatatttattctgtacttctattgggccatatatagtctgatttagtgtttgtcatttcaggtgaccttgcttcttagccaattggagcacaaaagaaaaatccaataaacaggaaaacatgatttagtcttggacatcatttctgaaggcttttgcacttaagaaacgcgaatagacaagaataaggtatgcagtaaacatgatacttctgtgtggctcactacttcactggtcctactactttagagctatatatttttgtgtgactgtagatgggttccattaatggatggctgtgagaactaacatttcaattttgtatatatggtagagcttcctcaggtggttggtagcagaacaagatagtataagttttcaggtggataaagctaaagcaaggctaagaattaaacatgtgtaatggaagtatcagggatggctgtgagaactaacatttcaattttgtatatatggtagtataagttttcaggtggataaagctaaagcaaggctaagaattaaacatgtgtaatggaagtatcaggaattcagaatggtagttggcgcatatggagcagatttgataaccgaaaattgtgtaccctgtgaagaatccattgctggttttaagttttaacttcataccgttatcatttcaaggaaagaaggtcttgcaatcgatcttcagaagagctgagaaaggtacagcttaaaaccattatttgttctatagtgaagttgatgtgtgtatactaaataacatcgtcagaatgagcaaacgctataaacaaaaatcaaccttcaaatataatatgtataagctttaaatgttaatggtcacttatgcaaaatgcactaggtaatgttgttcttcattttcaggagcgatttgtaaattaggttaatggaacaaaatattccacgttttgcccaatttctataaatttgagtacctgaattcactcacaccaaatggattgccacatcttttaaaggacaaagttattgtcttgtcatattgctgcgcaatctcgacctgcacaacgggttgtgcaatggaactaggcttatgattagagcatttcagaattattccattagtgctgagattgtcggtggtgcacatgctgggaagagggtcttcataccacgg

SEQ ID NO: 70167 - DNA, 5846 bp, Oryza sativa
cggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctaaataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcatgagcataagttgttctagcaccatatgaatgaaaagaactatgtagacgagacaaacacaagtagtactgcagtagtaatagcaaaagtagtactactttacaagtttgtaagccaaaagaaacggtcacataaggactgaagaggtagaacactactgacgaggcctcttacccctatccctcctaccctgcgccctaatgtgcccgtgggagtacgtgagtcggtccgggggtacggcacggccaacccgtcctgcctgtacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacaaatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcgtaaacgttgtaccgtgcggtagaccggtagttgatcctcgtttgtatttacaatgcacattatttttttcgtttgtaatcgtgaattgatctgagaataatcatgtccgaaaaaaaaaaacaaagggagttcgtagttgaaagaacctcgcgtgtggttattagcgatcaagtcaaatatcctctgttgtgcaaggttatcaaagatgtttagatgtgggtaccagagtcacaattatcagagtatttagcgacagatcacagacagatcatagtacaaccgtgtacactgcaactgcaatttggcagcgcatgatcaatcaatgtacattcttgattcttctcagagtctcatccatgtgtgcctactgtcaccacgcctcctcaccttcactctgaagattgttacaccgagcgatataaaaaaaaacgaaattaactgcctacaggctacagctattggtagaagagaagcgcatagaagagctggttccacgtgtccggcaggccggggaggcaccagtggctgcagtccgccgagccgccgccggggttggcgcgctgcgccggcgagaggtcgccgctgtacaccgacgggtgcgcgtccttgcgcagcgccgacagcgccgagatgtcgaggaggcgaacggggctcttcatcgaccgcagcgtggcctgtatcacctggtcctgccccgacgtcgcctgcgccgtcgtcgcgttcagccccgccgccgccgccgccgccggggccgtctcgccgtagcagttcttcgacaccgggttggcccactccttcgagctggtcgatcgatccagcggcccacggcacagatcagaacaaaattagatcgcgttgtcagaaaagagagtgaaatacaatacaccattgccacatagtacgagtgtactactgtacacgtgcacgcacatggtaaggtgtctagtgtactgtgtacactgtagagagagatggggtgatggaatcatgaggttgagatgagaatatgagattggctcttgtgagatttacctgtagtgtgtgggggacatggactggtagaagacacgggtcttggctggatcgacgttggcgtccacccagttggcccaggttgccatcccgcgctggaacgccaccatccggtccatgtcctcgtagtaccgcccgtccgcgcccatgtaatcccacctgcatacgtgaagtgaaacgaagctgaagaggaaatctggcgggtgcgtgtggaaaagggcgcgtatcacgacgtttacaataccgtctaactagattcaaaacgatcagaaacgatttgataccgatactgtaatttttgttggaccggagtaaatatcttacaatacatacccctggagcgtgccggtgtgcgtccaccagtggccggagttgaaggagagcacgtcggcgccgcgccacgcctcgccgttcccggagatgtcgtccagccatagcaccttcttcccctgagccacgccgatgtccaccaggtacggcgcgcggtagaacgataccaccaaaccgtactcctgctcgtatacatacgtacgtacgtacgtacttaccatgagtacatctatatgacatttgcagtaagatcatgcaagtgcaatagggaaattaaatacgtacgtaccaggaacttgtacgtgtagagagggtcgacggagacgagctgcgccggcgactgcggcgccgcggcgtgcagcaggcagatgagcgactcccactggttccggcccagcgagtcgccgacgaacatcaccgtcttccccttcatccgcgtcaagaagtccgcgccatcaaacctatagcaaaatcgcgcgtcgatcgctgcagctaattcgcgctctagtcgtataatatgcgttacctgggtagctcgcagccggccggcttccaccggtaccggaggtagtcggagtccggccggccgtacagctggcagttgaactccgcgtcgatgaccgggcagttgtacccggtgtacgccgccgcgccgccgccgccgtcgtcgcggacccagctgccgctgaagacgtcgcagctcacggcggcgtctttccggtggcggcgcgctagcccgaaggagagcgccgaggccggcagcgagaaggcgtgaaggaggaggaggaagacgatggatgtagacacggcgacggcaagaaagccggcgccgtgcttgcagaagagcggcatcgatggcgatgagaattggaggaaaggggaggcgaagccggcctttcccccggccgctttataccgccgtacgctgacgattatgaatcgatcacgagaccagcttagccaagattaatcgtcctacaattcctgctgtcgcaagcaagagaaaaggcaatatagctgccctaattattttgctgtgcgatccaagcaaggaagcgattaaccgattagcagcagctcgtggagaagaatattatcaccaaaccgatggattgattttttttttatcagcgcacggggcagttcacgtgaggggttttgcagatcatctttgtactagttcgcgtagctaagattggaacctgagcctcatatatttggattcgttgccttcgcggctttgccccatggtgcacgtagacggtagacgtacagggaaaaggtttggttttggaattcgtgttcgcatcaatatggaatctgtggaattcgccgggtacgtttatgtttgcagtttgcacgtagcgtagtgtcctagtccgtctcagaggcagcaaacctggggtgacaaaaatggcgcggcagaagtgaagtgtgcgtcaagacaaaacgattggctggagccttggatgtacatggagcttgtccatgtcgttaggcccagttcctgccttggccatcggtagtatatcatgttggatgtcggatcgggcaaaaattcagaagcagcggcggataaagagaacctgtgtgtgtgtggtatatttagcagaacagagtgtctgctagcaaggttgcaggagtaattaaccacggtgattcgtcccctgaacaacgtgacttgattctcccgttcctgtgctctttagatataggagaataaagtgtggagaatatatcttcttgggcgacgctccggtgctttctacttgtagtatatactacaagtagaaataatccaaaccgtcgatttccaagggcatattagtactatgttaggactacagttaggggtaaacttggtattaggaaaatattcgtgatttttattacgtttcaatcttgtatcgcatcgatccttcgctaactttagcactattgccgttgttgccctatttcggtagctctcagccggcgttcatcactgtcgcaacgctctgcttcgctcatgtctgcaggcaatttgtttggtaaatttctcacatggtaaatccttctagtattttggtgcgactccttgatggtattttcgtgaacgaaaatcttctagacttttttctagggaaaattttgctacatgacacttgttatgtgtgattttagcactaagacactgcccaaacttatttttgggggaaaacactccataaacgtggtaatttgccagtgaacaccgcgccgattaaaataatactttccggttggggaggagagagaaaccgcgtgaaatgtcaaaaatgcccttgggcccacatgtcagctctatctcctatctctctcttttctctcacaaatggcgaggacggtggctggcggtggcggtggacgagcgtgcggccgctggagccacccctcgccgtgcccgtgcccgcagcagaaaggggcgtcaccgccacagcgggggagggggacgcgatgtagagccggcgagtttcggggaggacgacgtgaagccaagcgagcacgaggcaggggaaggaacgacgagtgggaggtgggccggctacggagaagaagctcgttggcggccgcgcgagcaagatgca

SEQ ID NO: 70168 - DNA, 2913 bp, Oryza sativa
ccatgttctgctcaatgtgccaagtgcacaaccaatgctcagaatccggcatcacagctgctattgctctacgcatggcattgtccccatctgtgatcagtgctttaggatgcttctgatacatgcaatctagaaactgcttaagaatccattcataagttgcaaccttctcatcagctacgatagcacatccaaaaataatagtggaaccatggtggttcacaccaacgaatgggataaaaggtaagttatacctattcacccggtatgtgctatcaaaaactacaacatccccaaatgcatcataatcgatacgggattgagggtccgaccaaaataaccgtttcaaacgaccagcttcatccgtctcatactcaaaaaagaactccatgtcatgtttttgcctccattgaaaatactttataacacgctctgcatcaccacctaaaatatgtttcttccttagcctagtaaaatagttgtacaggtccctactaacaaaacctgtagcatcaaaaccaccatgatgcctctccatgacatccataacttgatgctgacgcaaacccacttctttcaattccaaaatattagccttttgagcattgctaattgtgcgatgtgaccgtaagaaagctacttcatctgatttagccaacggatgattatgctttgctacatacttcacaacaaaccaatcacctttcttcttgtcaagtttaatctcaaaaagtgcattacaaccacatctagtaagagcttttggttctctacttctgttagccgcttccatatacacttctttcctatgtccttctctagagcattggtactgcctatgggttaccgcaacagtaataggatcacgtctaatgtaattcttccttacactaaaccctttttctttggcatacctgttatagaagaggaaaccttctttctctgtcttaaatctcatggcagtcattgttctgtactcctcttgttcttctaagcttataaaattgtctcccatttcatcacccatacaagttctctaaaaagaaaacacataatactcagaaatcatctaaaatcaacaaacaaactgctacctatctcttggttctaacaaaaaaaaaattagaccacaagaaaatcacatacctgagaggaaaccctaaaccggtagggggcatatgctgcttgagttgtccagggggataggggcaaaaaatacccacggcaccgtcgctccttgcgcagatggatgggcactggatgagataagaaatcggtaacggtgggggcgtgaatgaaaccgctggtgaaggagtgttggttccccccccgcggacggcagatgcggggccagcaagcgagcgcacaggcgggggcgtggatgcggggcgggcagatttggggcgagcctgcgcgcagctcaggccggcttcgcacgggcggagctgtgctcgccgaggggaggaaaaaaaagagattagatgagaaagcggcgccgcacggagggaggaaacgagaaagagcgaaaaggagaagagggggcgcgactactttctctgttttccaatcgtacccttctaacatggacggatggatttatctctgtacctcccagtaccagtacctaccggtacaagttgctggatgggagcaacgctcaaaaaaaaaattgcacgccgtcacgcaaaaatttgtccactagaatagtagattaagcatgggagatgatatatcgtactactatgtactcatgcacattgctagagaggttgcaaatacagtgagcatattcaggattacagagcagatacaaaacatggtgaagcatcgaattttgcagaattttcaacaaatggatgtagccagttttaagtgaaataacaaaaaaaattattacatgtaaaaaatcgtaaatataaaaaaatttctataacatctaaatttagtgtattgtaagtgagtgtaaatttttttagaatcacacagtacaacgcagacactcacaacgcatgtacgcacactcacccatgaacgcacgcacgcaaatcctccccctatgagcttgtgtatgtgagtgtaattaactgcattgttactacaagttagatatatagaagaacacaaattttgatgtaagatcctacaaattaaaaagtgaaagataggaactcaaaatcattcatgtatgaggacgcagtgtgtatcgtctttgcccctatcctccgatggcgctgctgcattttcctcctcctccgctaccgtcgcgcaccgcagtcgtttccgcctcccatgcaacatcaccgtcgccacctctgccatgcatgggcagatctagatgcggcacgatggctgaaatggtttctccgtagtggcgtcgtccggtggcgtggccacggcgttgtacgagctctgcaagctctagctaccggagaacatgcgtcagagatcgtgagtgccagccagggtggcgcccgcgctgatcacctacttcgccgatgccgactctgcccgcgccgcggaggtgctcgtcgtcttcgccaagtccagcgagagccgccacgagctctccagtatccctagcatcgtggtcgtgctcgccgcagacaacatcgccagcagtggcaatgcccgtgcaatcaagcgtgcgctcgtcgtcttcaattggatttgtgccaagagcaacgaattggcatgggaggcaataaaccatgagaaaattcgatccatagcacaagaaaaaacccgatatcaaaaaatagcacaacaaatttttcacttcgaccataagcacagggcaccaattttcttgcgatccatagcactcccgttacatttgtcatccaaacatgtgagttgacatgaaaaaaagacttatttgcccttcttctccaagcaagagggcaatggagctta

SEQ ID NO: 70169 - DNA, 5960 bp, Oryza sativa
  unsure (1)..(5960): unsure at all n locations
ctgaagagcaacttaaacattctaagcatgtatactgaacttcagttagtttctttagtcttgcaaaaatattctcagtaaaaaaagacttgtaaaaattgccataagttttttggatgcaaaacttttaaatatattaatagtagtataattataggtaactatattgtaactatactatattacattataagttttatataatttatatggaaaacatacgtaacttttatataacttgtattgtactataactataattcatatataagttataatatagctacaatacatttacactatagttataatatacatatatcgtatagttacattaaaatcatactataatcatactatagttaattatattatttgaaagttttttactttaaaaacttgctacggctctttagcaattccaaaaataactctatatatctaaggctaacatgaaaaaacaaataattgatcgacacgtacttgatcgaggccatggccaattgagagttccttatgaaaagaagttaaaaatccaaaggctagctagcttgcttgtgatctagcggaaatgagaactaactgtgatggcgatgggctgccaacaaataaaaatatatttttttagaaagagagtgcatggatccaagaataatactggtgcagtaggataggcatgtgtatcacgtacatatgctgtatgcccaagcctaggaccagggctagggaagtagacgaatttaagcccggccggccggttgttatcgccgcgtacgggagtttacttgcatgattgagtgctcaagtcaagacaatctagtcctaattaagcttgcattggcctatgagatgaatggcttctggtctctgaaaacctcatcaaacgtctatcattctggccgtggctatgattgcagctagctaccgttctctcgatagataatacggacgatcgacgcatctagcaatgactctgaaatccaggtacttaccatctgcaaaggatctgttatgcgctgcttgtgctaagtcacccaatcgttccccacaacattctcaatggcaactgctcaggtagtgatgagtttcacgcgctctaagcccggcccgcgcacagttaggaggattggccgctatctgagcggtttaaagccaaggagcaagaaaacggatgcgccccgagtaatcgacccgtttcccaagcagagtttcgcgaaacctcccctcgatgtgatagcatcgtcctttgtaacgatcaagactggtaagtccattagtccaaacagttgtccatgtaccagtagaagattcggcagctactgcagcccctgcttcaccttcatatttttcgtggtctatatcatgcgagttatagcagtcctaggaaatggttggttttagaatacacgaaagtgacgaagttgctttgactactgaaccatgcctggatcgtcggagcgaattggatgatcgggccgagggctgccccctcttccccttgctctcctttccttaatattcaccgtcgagtcatcaaagccgtcaactaattcagaggggctcggcgccctttgagtctatagccgccaaatctaaatattccttaagttgtcgtacggcgacgtcagatcgatgcgtctgttaattaaacgttaataacattgatagaagaaggaggttaatttcgtggttaaataacttggacggtattgtacgtcgttgtcgatcggtatcgatttcactctcaatctttacgtcttctctctttttctcgtctttgggtacgatgattaagcatgacgaggacaggtgctgagctgcatttaggttaattnttgcatatatcccccaaaggcccaaggcccccactgcatacaactcgtttaggaacattaattagtggggctggatgtatgagccactcatcagctaataaaatgtatagagattatttaaaatatgcaatcaatacatcttattagttttatgttgtcttaatttttctctatacttgttccatgctatggcatgcagggacggatattgaactataagagtatgatagctagggctgcagccctatttccgaacctaaatatcaattgaaattgcattataaaattttaaaagataaagacaaaattatgtaaattatatcgattgagtcctaggcttaaaaagattccggttccgtcactgattgcatgcataattaactttcacttcaacttggtaacttctacaggtattagcaagggttacaattcgacctttttttctacataaaaagcacaatagattatcaaactggtgacaaaagagagtgagatcgtacttgttgggtatatattaatgaaaatggaggaacaatcaacatctcgctcatttgttgtttagtgggaccaagaaggtctgactggatatattacaaggacacacgtttttttaaaagaaaaatcaaagagttacatgtttctcttttgctctatggataaccaagtaaactcgaaccacttgcatccctcttgccgttttgtatgcttgttacatcaatcctagtgggcatgcattacagtatgttttggatctagcatgggttttctttaaggttaatttgatccatgtcattgcaactatgtcgtattgaaaaaataccactactattcacaaaatcgggtagatgtcactacaatcttctaaaatttgaaccgtgccattccatcacgatttcttttatctccgtcacactttgtgtcaccgcatcttcattctaagtcaatactagtcgtctttgtctccaagtagtaagcccgcaccggaggctggccggcgagctctgggaaggctaggcggtggtcgtgggtggtgatgactccatgcaatggtcgtggacggcacttgctgctccgcgcctatcccttcctccatggcgaggctgcggccagaagacggctgccttcgactatgacgaggcggaggtggaagtgctcctccacgcggcgcagcagatccccttgatgctgaactcatcggctgcttcgacacgctcatgtcccaaccatcggatccgaagccgaagcggcctgatgctctccccaccgccaaggcgggatggacgaaatggaggcgtgttttgcagcgttgaagggggcggcatggctggagaaggaggagacaagatcatggttggcaagctcgggaaggaactctgcatgcgggacaccgagctccgcgctatgcacacactagaggagcacgtccagccgaggagcactctcgccgcgctcaacggcctccacctagatctctagcactggcgttgacgggctagctccgttggatatggccggagcgtcgtgcctcgtcatgtgcgtgctcggcctgcaactggagaatatggtcttgtgcggcaagctcgacttcgccgtgccatctttcggttcgagaacaagttctccggcaggagacagcaagggattgaggagagagagctgtgagggatgtgcacggaggagatcgtcagtgagggacaagcctagagccagcggtggagggatggggctggggacgcgagacgaccatgtgatggggatgatgaaaatcatgatggagtggcacggttctaattttagaagattgtagtggcatctacctggtttcatgaatagtagtgatgttttttcaatacagcacatttgcactggtatggatcaaattaaccattttctttatcaagttaaaatgttgtgtgaacatagattgtttcctttgcaccaactaagaatgcacacaactatatataatttatgagcaccaagattaatttggggattttgttatggtagaccgatactttgtgaaccatccatcttattattctttattgatccgatggttaatgttcatcttacatcataggaggtaagacgtcatctacaaccatgtaaagttaattaatctcaatcttttactacaggaaggaaaggagcgatgtttacttgtgtcactataaaaaaccattactaatacaataagaattaactagtaatttcatttttttattattactagcaatagtacccgtgcgttgcaacgggaaaaacaccatttgatattgtgacaccttgaaaacctcaaataggtaaaaaaaacaagtctaatttgatatattaacaaatagatagaaccgagtctaatttgatgaattagcataggatttaggatttagttttagatttatttttcgagccttcttaggcgtttatccgacggactttaatttaaaacatctgagccacattgtttgataaaatttgcattcggcctaggtcttctcatccggtccaaacttgggctggcccatcttcgtcgagctgagtcaattcgacagcccgcaagctgagcagctgagcgcggcccacatatgcggggacagtccgatgcacttccgcggcccattgggcacagtgtaatcggcggtgccggtctgacgttgggcaaatctgagccgtccgatctaatggatgctccgatcgtccccgtgctagatgaagcgccgaccgggagagaggggcaaaaccctagctcccaaatccctctctcccgatcctatttctctccggcgacgagcgagcagaacaacagcgaaggcagcgacggcagtccggtgagctagtgagcgctcctgcttcgctggctgggtggcgcacccgagggtggtgcaaagttgtgccacggtgttggaggttcggctaggcaagcgcgcaaacggcgctgagcgctgagcggcctggacctttaagattagataagattttcacggacgacgaaagtaaattgaatcaaactttctttttttttgttttatgttttctttcgcccttttttcgttattacagaggacagaaacgattagtagagatagagatagagaagataaagaaatatagtaccatgtcacatataataggattcgattttttttaccgcgtcacatataattctttgtttaatcggacataattcatttttataattgttttccaccctttttttaccgcgtccacggaatcagatttgtttttttgcccggtttttttcacaagattttttttctcccgattcttttttttcgaataggacagattggttttttttttttgcctttcattacacggaatcgtcattgttttttttgcccctttttcgcccggctttttgcccgatttattattttttaatcggacagattgggttttttttcgccgtttctttacacggaataggattcgtttttttcgcccttttttcattcggttttttttcgcccgatttttttttgacgacgatggaaacatttcatattttttaagtagtagagataaagaatcggacagattttttttaattttttttcgtcctttttttaccgcgttgacggagttggattcgtttttgtttatcggacaagttccatttttttccttttttcgccccttttttggatcggacaggtttggttttttttttctttttttcgcccggttttttctggataggacagatttggttttttcgcccggttttccttttttcacctttttttatcggacaggtttggtttttttccttttttccgccatgttttttttcggacaaatttggtttttttcacccgattttttttacggacgatggaagcacctcttattttcttaagttgtagagatagagattaatatttaccagaaccagattacaatattgatttgtctttacttacaatttgtagtagaagttttcaaatattttcggaattttaaggtaatttatttattttcttcactcacagcaatttgaagagatgtttaactatggtctcttctgataatagaatctatgtagaccgttatcttttctaatccaataaaccgaatctttttatactactacaataatat

SEQ ID NO: 70170 - DNA, 35543 bp, Oryza sativa
tatatatatatatatatatacatatatatatatatatacatacatatatatacatatatacatacatatatacatatatatatatatatacatatatacacatatatatacatatatatatatatatatacatacacacacacacacatatcatgatagtaagttacttggctagagaatttgttttgaatacatcattcgcattgaggtacgactaattgattgtattagtactttcaaaaactaaaattctatcttttcagttttatatgtaataacaagttgtgcattctacagttttatcatgagttcgtatgcaaaattgattaatcacttcgatttatcatcacacatggtatttagaaaatctcacttgacgatggccatccgatctaaagatacttcgactatagatttaatgtaatacctcatcaaaagtgctatttgctgcagagtttacgataacatccactatcaagatccgaccgccatcttcaaaaggaactccgaataatactaagtggatctgaataatatgaaatgcatcgatcgattaaaaccttgcttttttaaagtaatcaacatatacaaaattactagcacacgtaatcctgaaactaatacctagcacacgtttttagtacctttccacgggtaccttcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgatgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacataactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaagaaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaagccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtctacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccacgacctggcaaggatatgacataaatggatacacctttcacacggtaaagcaagacagcaaatgcacagtgcagaacagtgggttacgcatcgaggctgctagtgacggtggtcgtcgtgatcaatactatggtaaagttgagcaaatattggagctagattacttgaagttaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccacgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataaaataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgttgggcccgtcacaggtggtcttacctgtgacggctccacggttggcgcccgtcacaggtgacctcacctgtgacggccacatagttggcgcccgtcacaggtgagtttgactagggttgacctagggttggacatcttctagatcgatccagatctggcacccactctcactcactcactctctcgaccgccgcctcgcctctctctctctcgatccagaccctcctcgccgccgcctcgacctctccaccgccctcctcgccgccgccctctctgccgccatctccgccctctctgccgccatctccgcccttctccaccgccgcctcctcactcactctctcgaccgccgccgtcctctccaccgccatctccaccgtcgccgcctcaacctctcctccgccctctccgccgccatctccgctgccctctctgccgccatctccgccgccctctccaccgtcgtctccaccgtcgccgcctcaacctctcctcctccctctccgccgccatctccgctgccctctctgccgccatctccgccctctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacaccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctaaattattgtgggctgttttattatctacacttgccccttgctgtctatgtttgcccatgctgttgcctatggttgcaactgttagttaaaacttgaatgtgtagctagtttgcaacttggatgtggatttaagtgccatttggacatatacctctacacttgttctttatggataagaacagagtatctacacttgttctttttttatgcataagaacagattttctgcacttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggacatataatcattcatggagtgtgtactgctatatatgttgctagacctattgaattttgtggacttgcatttatactcctcctgctgctgttttatgtcaatcatgcaaattctgtacccttgctgctgctgttttttaaatttgcatgattgattcagtggttatatacctctacacttgttttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgttgtttatgtgaatttccaccctgctgttgctgtttatgtgaatctccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttatttgggttgcttttttctcctagtagctgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattatgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatataagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccgtcacaggtgacccacctgtgacgggcttttactttcgggcccgtcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgcttgtgttggaaaccgttagattacagccaatcaacagcagtttgtcatcagctttggtgttggaaaccataactcatgaaactggcagcttgtcatcctcattggtaaacctagataccatagtggctaccgcacacactcatagggacatgtaagcatttgcactattatgtttttctacctgatttcctcactcactcaaaccaaaaccatcttgttatcctgtatgataattaatcttcatcccatattttttctcaacacaatcagaggaacttgtagctcgaatcatattatcatttaacacaaataatggactttattatctcaaccttatcatgaactgatatcaattatcgaaaagtcattgttgataatgtgtgttgagtgcttgcaggtgcccgataaagcaatacattggaacagaaactaattagtttttatacaactctttgttagatatcatatgacaagacatatataggtgcattatttttcaatagaggatttgcagatagcttttgaagtatcactgtcatttctcttacaaacatcatgcaagaggcgaaatattacataatcagaagaaataatctcaattataccatactattggatcaaagaaaaatgttctaagaaaattctcacagtaatagatcctagatatatcttggtttgtaagtcgagatttgacatagaaagttttcataaagtaattttgatttattccccatgattggtgcaagcatatatatatgcttcaccattacaagtctaaaacataggctagtaataggaatcacacttcaaatcgtccatcgaagcagctgcaagagtcaccacaaccctggacactggacatcatgtgctagatcccggaaaatcagcatttgcgggtgtgacagcctgctcttcaaatagaaattgtgattgacatgctatttcaatatgtggctgtggcaatggcattctagtaccctttgcatcttgcagtacctggtagaactttgcaatggaagtgtaaggtagagctgagagtttgttgtgcagctcctccaattcatcctgccccaggagattaacttcagaagtcagtgattgcataagatgtcctgccctctccttctccattgcctcctgaaccctcttcttcttttccgacttttccaatgacttttggagctccacatattcaattttctgctgttgcgctatgtttgtcacctcaccgctatcatggtacccaccacccaaggaatggttattgggaatgcccatggccatggaggccaagcggtcagcaacatcatcaacagagggatgggcaaaggagaaacccctaccagcaggagaaatcacaacagcagctatatttgcattacatagcaatgaaagctcaccagctttattaaatagggtttggcgacgcttcgagaagcaaacgtcacgtgcatcctttttttcgatgcgcttgatctcaacctttttcctgccagcccttccctttcccttcaccatcacttattggataaggtgtggttctcctttggctatatttttcctaatgatggatataacatgctgtcgtggaacgtctgtttatatagagatttttgtaaggatataactagaagcacggatttacattgatgaaaagatatctagatttttgtatgtttggagggtatattaggtagcattcagtgcattaaaaaacagccaaaagaaatttatacactacttagagaattagtaactgtgcacatatggagagacttatctattgtgatgtatccaaatataaactcaatggaattaaaattggaatacgaaaaatgcataccatatattcgccaccatcaagataagaagtgataacaaaagggaaattgtaagggaaggaagaagacccatataagtgtgtcatctcgagtaaaatcttcaccatattgtttgtgtcactagatcaatataaaccattatttgtgttactaatgtaaatgacttatagattagttttatacattgtaataagattgaacactatagttcaatttactgaatatctattaaaagagaggttggtagaatagttggttggagataatgcacccatccttctagtgttcgactccagatgtgatgtcccatttttcttaattaattaacgattaggtcatctttggttctccaacatcttcaattgactaaataactactatatttagcaaagatacaaatggaaaatttatggacctcaataaaggaccctagcaagattgagacactttaattttgcaaagatacacgccacaagcatttttagtgttgtgttatatctatttatgttcattcttttatttcctttccaagcacttcgctgccaatacaaacctttgactgtgctagtgaactctctagttctcatatataaataaaaaatgaattcattcagtgatgatgtatgcaggggcagagaaagctcccggaccagtcgggaggctgcccgggctccgtcattgccgcctccactatcgaatgccgtcaacgtttgcagaagttgctagattgctatgaaacactattattcacccaggctcgacgatgcacctcctccgccactatctgtaaggataagtggaaggagaaagaatagataaattcatggaaagaaacaacttgtccattccagagccttctgccccataatagaaccactgttcaatttcttgacaatcacctataattttgttgtgtgacttgtccaatggttgtgtaccaatgtagaaatattatttctgttttgtttaagtgagatttctctaggatttttcattatgccgtgcagaacatcagccattaatgcatggttggtcatatgccatacacaacatcatcgattcttgttacttgctctctagtattgatccaacataaacctgatcaactgaaccatcctagtatttgcatatgaactcctagcctctagccacctagtcctatatgagtcatattcaataaatgttatgtaccatggaaggttacatatcataacaagttgaaccatcttcctttctgctactaaaactagcttaagtctattcttgcgtaaataaccatatatatcatgcctttgttgtttttactgaatatcatgcttttttgatgttggagttcattgttaaatcattaacttaggttatgcatgatcactgtcacaccctgaagttcttctcccaagcctaaattgaatttataaatggtctcaagaaaatatcggtgtaaaagcaaaagagaaaccctaaaggaattaatgtaaataataatcggaattggcatgtggaatttttcttgagttctacatgtcgaaatatgctaacatgatttttagtggaattttcagagctctagaaataatttttaaccaattaaaaatgagcacaagcaatatttaatccctagaaattcattttctcctttttctttttctttttccctccttttttcgaatgggccgccggcccattctcttcccctccccctccccgctgggccggccgaaggccacggcccagctgagccggccgcctccctcctccctttgggtcgccgacaggtggggcccacctatcgggcccgtctccctcctccagccgccgccgcgccccgcaaccgccgcccgcgcccgcgttccccgcgcccacttcccctctctcccgcccgcgcccgcgctcgagatggccgggattcgaattacgaatcccgcctctctctcctctcccactcccccacgtcggccggcgattcccgcctctcccggccacgtccggacccctcctcccctatttaagcaccaccgccatcccctctctctttttccccatttcgccgagctctcccgtggcctctatcgccctagcgccgtcgccctcctctccgccgtcgctgccgccgctccggtagccgctagccatcgctagccgccgcgccgagccgcgccgtcgccgccgtcgggttcgcaagcccgagggccacgccgtccacccttcctccgtcggaatccgccgccggaaccccgtccgcaccgcgcgtcggtgagcttcgccatggccgacgccttagccatccatggtttccctttccctctctaactcatcccttttgatcccttaggtggtcccagagctcgtctcgccgtcgccatcgccctccgtcgctcgccgtagtcgatcgtcatcggtgaggcccctcctcccctttctccctctccccccgtgccgcttagccgccgcgccgccgcctagcctcttagccgccgctatcgccgtccgcgtcgccgcgacgccgccgccctccgccgccggccagtcgccgccttgtgccgccgctgcgtcgagccgcgccgccgtgcgccatggccgccgggccggctagagccgcccatgcgcgccggccacgcgcttccgcggccgtccgatctaccggggccgtccgttcggccgcccgcgtggctgccgcgtggccgccgcgtcggcgccacgtcagctccacatggtgcgccgccccttttccggtccgtggacccggtccaccgcagaccgccccccccgagtcactgccatgtgaggctcgtatgtcggcgccgcccactctctctcccagggtttatttattgcgcaacaaatcaattaaggatttttctgtttatagtaaaaacacagtgaactttctaaaattcatagaaaattcatccgagctccgtttaagcccattcaagtctcagtaaatcaagaaaaatgcatagaatccattaaaaatggttttgttctctgtttcagtagtcttatagcctgtttgtattgtttactttgtatatcgcttagattccggctctcccaacgctccggtgtactttgaattagtcgccgaggttcctccagcagcagagcaaggcaagtcattcttgtcacttgaatatgttgatcctatattgcaaatgttctattgttttccttcaaatattgcattgtttcacaataataccatgggatgtttacctactgttatagccatgctatttttgtaccatgctcctttgttagcttgggatataacatgactagatattggtctagggattgcttagccatgcttagttcaactagcacacaatgggggaaatcatattaatgtatagacctcaggttctagtgttgatgttggattagagccaccgtcctggtgttgcttaattaaaataaatcatatagtgggctgtgggtgcatggttttgctagtcacgcccatggcacttaaggaccggttcgcgggaaaccctgaaagaatttctcgtacttaccacaagccagcgtgggcaacggctgggcttgtagtgtagctttcctctagctgacgcatccaggcaagggtgggtgtgatggagcggggcgggccttgcgacggcctctgtcgcttccggattcacctaggcacgagaggggactacccgttgcccgctggggataggggtgaaacctgaggtgtggtgtgcttggctagagggggttatgtgaacggtcctgtcacagcctctttccggtatgtcgtggtggcatgtcggcgcacggaaacgtgtcatggggctgtgtcttgtgggtacagttgtacacctctgatcagagtaaaactattcgaatagccatgcccgcggttatgggcggtcaaccagattcaccgtgattagattcaccctagactagtctaatggaattgaatagtctaggtggatggttgggcctgttgcaatgtggtgtagcgttggacagtggatggttaatattgattaattattacaactgtttctttgctttcaactactgtttataaatgctcgctttatgcaaatgaaccactctagctctcctttgatatttccctgcatcatacccctattccggtatgacttgctgagtatagtgggtagtactcaatcttgctctattttccccaaaccccagagtttgagtatacgttagatggtggtttttccgaggagtaggcttcgtccgtgccgtcgaggatgcctgtggagtggtgttcccgctgcagtccaagtcaaggcttagctccagttatctttgttttttttccgctgcatttatgtaagacttttataatgtttgtaagtcgtggatctgtatgtcaactttgtcgtttgtgtaccccggccggtcctggacgggggttttaatgcacattctgcttggaattctactcgggaatttctgggcgtgacaatcacctaatattttatgcagaattcagtgaaacatgaagcagcctttagtccccgttggtattgtagttgacgagcgggtgccggtgatgggatcaccctgcggcggtggtgataggaatgccgtgctgcggcgatggtgatgaaattcaatctttggtcccttcaacgcgcattaggatcagcaggcttatggttttgggaaaatcttaccgtacatgagttctcacccgtgtacaagaccgaaattcccttttatagtgtgttgaggggattgagggtgattccttttgaggaaactgctattgggggtgattattttcgacaaaacagcgagtcgtcgacattggtcatccaattccggtcatacaactcagatcgatcgagcccagaacaaaatctgcgccaggtggaaacccttgctccattaccctttctttccctaatatttctagcgtgagctgagtggtggcagtgatggtgatgccgagcaaagcggaggagacgacaatgccgagcaaagcgtaggtgatggtgacaaccggcacattggtagcgagctaattccatgagtctctcctcctcagttctcctccaaggtgtggccggagccacaccatggcaagcctcagtctcgcgctactgcctgatgcggcaatgggaccagttcgagatggtggaggcgaatgcacggtggcggtgatgccgcgcatcacacgcaagaaggcgacggaggagtagggtgcacgagcacggcatgagctgatgtgacacacgacgggctcttccgagttgaaacatgaggtcgatgaagacacgcgcatggcttgggtcatgccatatgtagccaactcttgcgagtggaggtggtgaggcgggcaagacgggcccccaatgagctgatgtaggtgcacatctcgctaataatgagttctcttgagccggtgagtgcttagtcccaaatttattagggtttgctttaattgggatttgttgggttcaagattttcttaatttggggatttgaggttcttaatttgcgatgcttcaagattagggttttgaattaaggaaatttcgaaattaggggttcggttaggacagaattggtggttttgggatttgttaacttcaactcaaaattcgtaattccctcctaatttctacccaatccaggaaatttgacttaaacaagcaacttaaacatcaattaaaccctaatagcacttgaacagaacatgatccataaaatttgacttggatgcaacatgaaccctaaaacatgaacaagatgatgctaggttacttgacatggcttaatggcttcattactggagtgatgggaacatgcaaatgcctaagaaggctctaataccacagtgttggagcacattcttaaatcattaacttagcccatgcatgatcactagatttcttatgtggaattcggtgaaagtactgaccagtgaaagatgaagctatgagcgctgcctttagtcgttgttggtattgtagttagccaagctggcatcggtgaagggatcaccatgcggaggccgataggaacgccatggtgcaacaatggtgatggaattcgccattcgatccccttcaacatgcattaggatcagtagactcatggatctagaagcgatgacgatggtgtcagcggatagcttctttataaaggtgggaggactaccaagagggtccaagagtcgtgctctaccagattggggcgcaccccacatgggccccacttgggccggggtcccagacgtagttacaagcccataggcctattattggtgatgcaataccttgcttctgtgattgcggccaaatgagatggaattccaagatgaggctggatccgttggaaagaggactttgagagctttccatcaagtactcacgggcccaaaacggagcacgtgtgtagatttggcggccgtttgaagtcagcaacgtaacacgtggccgaatcagattgcagcacatggaggacttgatcttgatgtcttcttgttgattcatgatgtgagcaacggttgtatcgatagtagccatggtcacatcagtggcttgggggttcataatttggaaatacaaaataaatgtctcttgagtaaatggttgtttaagttaataaatgaaaaagggggtgtggcaagacttattgaagagaaagtatctttataataaatctataactcgagttgataagaaacaaggtgatttccatttttggtaaggtcttataaaagttaagagtactttcttaagtattggttcgtggattgtgaatagtggggaacaaataagattttgggaagataaatggttaggtaacttggcctttaaagataagtatctttctttatatgctattgtcctgaggaaaaattcttcaattgctagtgttatacgatctgttccacttaatgtttcttttaggagagctttagttggtcagaaacttcttttttggcatgatttatgtgcttctattgtacatgtgcagttgaatctctcttctgattgttttagatggaactttaatcagaatggacggttctcagtgaggtcaatgtatctggctttaatcaataatggccatactgagagaaataaaataatttggaaacttaagatgccacttaagattaagatatttatgtggtacggtgttgttctaaccaaagacaatttggtaagacggaattggaatggtagtttaagatgttactgaagaatgagactattcattatctctttatggaatgtcattatgcaaagtttgtatggagaaccgttcaattttcttttggtttataccttcctaatagtatatcacatattttttatggttggcttttggggatagacaagaaaaagagcaagcttatacttgtaggagcttccgccttatgttggactctgtggctaagcaggaatgatatggtttttgataaatcaccttctatttcatatatgcaggtaattttcagggcaacatattggctccggttctgggctcagctacaaaggtgtgaggaagatggtgagcttttaaaagttgcatgtcatatgcttgcgacaacagttatacaactttttgcaaattatggatggagattctcaaatagacttcaatagatgtctactccttatcttagtttggttatttgttttttttttaatttcttatgttttgtttaacttaactctttttttagtgctactttgtaataattggctgtagctctttttgagcaaagtccgagatgttttattccattatctgaaaaaaatgtagaccctactctgtgacttatatctgggctccatagattcttttgaaattttttaaacatctaatgatatatgggtcccatttagatttatttttcttaaagtttttttggctgactttaattccacgtaaacatcaagtagaatgaagattagttcaatatgccacataaatgctgcgtcagcaatattcaccgttaatattgtcgagagagaattttattctccacgtaagagagagagaggactttaatatagagtcattataaccaattttacggttgaggactgaggatacgaatcatattcaaatcaaacttttttttcccaagttaaaagaactgggcggcttggggtgttgctgcgcgtaggaaaagaaggctccgcgggccagattataaattaataatggaagtcggtgttgaggcccaaggtctcttttcctcattttatagttttcttttgagcgtcagggattccatccgtcgctccgccgccgcgcatctgatcttccctgaaccccgctcatcatcgcctagccctagccctagtgccgcgagcttctccttctcctctcctatagttctaggctgggaacggtgaggatggccccgcccaggattcgggggaagctgaaacgcatcagccagttcaattctgcaaaaactgggaggaagaagaagatttccaagaagcgacctgcgcagcaaggtgtttaattccttcttctcttgaatgaagattgtttgcttcctttttgacggatttgcagacctatgcaattacccctcttgagtattttttttcttcctggggctgggatgcccaatttcagcacttattttggttttctagatatgagtattcagtacttttatctatcaaaggaacgtgcagtgagtgtgcatcatgtgcattctgccatcagcatgtctttagtttttgcaagttagcatctgcccctctaattgtttaaatctagtttgtttttaattttggctgtttagtttatgcatgcatctttgaagttcccaaacccaaatcataccacttagtttttgttccgttagttgttatttcagtgggaaactgcttgtgaaccatgcagaaagcaattccatatttgatgtagtagataggcaacaccaagtaaccaacaacgctaccagagtatgcaacagagtatgaagcaatcagagtatacaaagactgaaatttccagtgagcagaaacttgatagatgagcagaaacataaaactactcgttgcacatactagcaagacattttaattgtggacaactgcacaaggtaattaatttccttttaacatgtgtccacaagtctaacgcatatattttcttgctgacattaacagagccagaacggaggcttggcatgatccgattcagaatcatggcctgcgcaaagtccccagagcaagacatctgctacatctgcggagacgacgatcacatggagcacttctgcccttacaactacatgttcgggcgatacttcagcgacacctgcagaggagagtgccctccccaggagcacaggatcacctccagggatcatcgagagttcctgcggcgtttcgtgcgcgtgacgaacctgccgccggggttcggggtgtgggatctcgaggacctcttcagcccgttcggagctctgctcatgtggaatgttcccaagttcaggaactacctgtgtggatgcacgactggaatccacatgagcttcggcttcgtcgtcttcaagagacgcgaggatggggagagggccgtcgacgagctcaatggctatcaggccggtgaccggaggctgcgagttgattgggtttacccttcttgtgtgtagctcaaagatcaaactttctatttacccttcttgtctgtagctcaaagatcaaaactttccattacccttcttgttccatttacccttcttgtgtgtagctaaatatcaaactttccatttaccattcttgtgtagctcaaaaatcaaacttcccatttacccttcttgtgtgtagctaaacatcaaactttccacacgcactagcagagactaaagactagagagacatttgcattttctgttctcccatatgtataggggtggcaacagggcagagcggggttgggttggattgccccagcccccgaccccacaaaggaagtcgggtgaaaaacatcacctgttgcagcccccacaggggacccggtgggtgaccggggccccgcatcacccgcatacatgtatcattttgattcactctattgtttatccagactcttttaatagccaatatgtttttttatgatgtagcatatccttgtgcaagaaagcttgttgctttcactatataagatgttatgagtgtgtgagtttgtcttgcgtatctgtttgtctcgtaacgctgtcagatgggatcaacttgtgagtttgttcttttgagactgttgcttattataacttttttttattaaaagacaagttatttccttgatatcccttgtttatatagttttaaaaaataagtgaacgcataggtttgcaatttttttcaaagtgaaaacggagcttatgaaaaggaccagaatgcatacatcaataaagttggaccagaatagtgcatacaagcaagaagatatagaaaacttgtatgcctcacttcgatactgttcctcatacgacaacactgggtcgtttcaactaggaatgtatctggcgtacctggtaccgcacaaatttacaaatgattttatcgtggctatatcgcagttcagcaatggaaaggacaaacaatgtgggacggatagagctcgatacaagatagatgcccgttgtgtttttggcttgattaggatgctgggcatttatattttatctaatgtatgtaactacccaaaatcatactagagtttcacgcaatgggaagacggaattattggtctaaccaaatgcaagggatttctttgccaagattttcattcctatggtgactttcatatggtgcctctgaattgaaacaattcagccaaaactcctaagctgtaccaagtcaaggcaaaactcatactcgtagttatcaagtgagaatgagcctgcactcaactcactgcacccattcgtaattccacactgaaccatttaccaaaacccatcactaattgaactttcaacatagaaaaaaaaatccagatcattctactactactatttcttagacctttttgaaggaaacatcatttttgttttttcgattttgactgaatcggtcggaacatagacgagcgagcagagccatcagtttagacaagggtaagcccaatcgactcgcagcttgcggccaccgaattcccagcagttgagcgcctccacggcctcctccgcgtgccgatgtcgctggaacacgacgcagccgaatcccttgcatgtccccccggagcctcgcgtcgggacgtaccacatccacagcggcccgaaccggccgaacagctcaacgagctgctccggtgggcacaactccgacaggttgttcacgcggacgaggcaccgcaggaacccgagacgcctcgcgttcgcttcgtcgtgcatcgggggctcgctttgctcttcctctctgtgccgcgagcacttgtaacggagcgtggttgtgtagttgccccagagagcgagccgcgctctgcatgggaagtacgcagccggggaaagatagttgtaggggcacatcagctccagatggtttcccttgtcgtctccacagatgttgcagaactcagtatccggatccctccaaaagcgtgtagtggagcctgcatccagagatcatctcagtgtcccatgcatattttcacagggcagtataaaacaactatctattgctctctctaatcacaaacctatcactaagggaaagaacatggacaaacatagtgatctctgaccaatataatacttttgagaattttgattgtcacacaaaaatagcatggggcagaaatagttcacaatattgttcttcatctaaattattgcgttacctgcagctatattatgtgttagtatcacaagttcacaactaatttgttgcatgaggtagcaataactcggtaattagtggcgaagccaggatctgatcacaaggggggccaacctagatatgtgagaaaaaatagagaaaaatatacacaaatttgaaggttcccataaacaatatttatatcatatcaacaattcaaaagataggcatatagctataatgcatatatttatttattttaatttggctttatgagtagacatatcataagcagtgataatggtcgagctaaaagtctaaataaaaaggaaaatacaataaagctagattatggtaaaatgagtgatcaactatctaccttttgcaattattaactactccctccattctaaaatataagacataaccactactaatataaatatcaagaaaaaaatattattaaccctttgtttgaattatcccaataaatacgatgtatgaacccaatagaattagagatcttgagagttaggaactaaaaagaaaaactattttagagatggaagatgataattaactgcatgcatgcttgcgtgccttgtattgtaaagcattcaagaaaaatatttgcgccctatattttgaaatggagggtgcattttagaaattgaaagtaaaaatgttagccatatgtaaacaatacatacgattattacatagtctaaaaggaaaaatatgactgtatgactacgataaagacctttggtgcttttgattaaggattggtgtagcatttttgctaaacatctgtacgtacgtgcccatgccaggataatacggtgtcatctgaaactaacctacctaatctaatggcagattatttggggcgttcggtggggtgggggtcagtggctgttgggggaggccaggcctcctcccgcccctgtcgttaatcctgcactcttgcttccttgaatctaaaaaagtgttttagatatgggtctactaggctatgtagctctacttgccttccgcgcaatggagtcagtcctataatcagtagttcagtatgaagaggtcgacgaacacaccttcctgcctttttacaaaaatggactgaacaacagatgtatacggtcagaatgacaaatctttgtccaattccattcaatgcgtattttcaggctcagtcagcaacttaggccactaaacaaaactttttttatagaaatatgcacgcataaaccattgtgagataattgtgcacatgttgatatactagctgcctattatttaccccaactttatggtatatatagaatcagtattccgaacgatgaccatatggcatcagcacccgaaaaagaagctaatctccagtatgtttctgtcacagtatcactggtgtgaacatcaatcaaacagcggtatctaccacgtctagagtagatggccatatggcatggcaccaagggattggcatactgaatgagagccgtataataacattgaaatgaaataacgagagagatttaagtgagagcaagtagaagatagtactttcttcttccccgcttaatatgtactcacaaactctatctcagcccatctatgcgcccaagcccaagcatgctctagggtccatgtgttagtatggtaagatcgatggcaagcggtcacatggtatatgcaccatgatcattgccacgaccgtgcaagattatgatacctcttcatcgacacctggatgcctcagcagataatgcaatgaatattgaatctgtttcatcacacttctgtggcagcagatagctaccttgattgctgttttcttccactgaggtcattgtttcaggcagttttaggaagggttttaaaaggaaacaaaaccatgactagcgaaaacaagttgtgttagcatgagcaagctgagaacagattcaaagacaaaagaacatgtgcatcacttgtctgaactgcattgttttcaattcatacgttttcaccctaacagcccaacacagagactacataaataagtatttcaaataattaaacacaacaaaatcaattgctgtgtggtcagagttgaacacaacaacattcgtttctacttcctaggctagttgcagtgcgaccagttttatggttacaatgttttatgtaacttactctatttttagacatgaaaatgaaaagcgagcacgcaattaagttacttacattcctcctcttctgagaacaattctacctcctcctgttgttgctcccatttactctttcttcgacgcagaaagagcatctcttggagagtaaagagcctcataaacttgtggaacttgaagagttgaggtacaaccaaaggctgatttacacctcctgaaatcaacacaggcacaactgatgtgtactgttaactggaaattttagtctttgcatactctatatatgcagaaagccattctatcaaatgtagagttgctttctgtagggttcacaaggagaactaaaataataacaaatggaaaaaaaaaagtggagtgatatgatttaggtttacttcaaagatgcatacataaattagacaaccaaaattaaaaacaaaataaattggagtagatttaaagaaactaaacgaacggggccatactagacatactgatgtcagaatgcacatgttgcatttgcacattcgctgcaaataggattactgaagatgggcacgcaaagaagagtgctgaatactcatatgcagaaaaccaaaattaagtgctgaattgaagctgggcatccagggaaaagaaaaaaaaattgctgcagaggggtaagtggggaagtccgcagatccgcgagaacagtagaaaggaaagcaccttgctgcgcagattgcttcttcgaaatcttcttcctccacgttttattacagctgttcttgccgatgccttcgtctccccttatccgggcaggggccatcctcgctgttccagccctccaccccctcgcggcgtagcaaagcaggagagagagaagtgggcgacgaagtcagcggccctagggctaggcgatgatcagcggggtacagggaagatcggaagcaagcaagggcgggatgcggcggcagagcgacggatgggatccctgatgctcaagagaaaaagaaaaaaaaaatccacggaggaggtgaggccgtgagggtcgagagggagagagagagaatagcttgggccgccggactgtatgacttccattatgatcggacccgctgaaattttgatcattttataccttttacagcccgaaaaacttattgctctccgagttgcatcgttttgataaagacacggaggtgagtagagatcgggcgtctgatcgggggaaaaaaaaaatctggcgtccgtgccagccatctgatcgggaagaaaaaaatcagaggccccacagctactatatgcatgcacataaatactataatctgtagtcactgcatgcacagaacatgcagccatgcatgtgtcaagttttttaaataaaatttaaactattttttctctcaaattacttatccaattcacgatccgattgcactattgaatttgttgcaattaaatctttaaaacaagaccacacattgatataatccgatgaaaaaaatttagcttattattgaattatttttaaatattgcacgttgttccaccaagtatataggaattgtttcactaagtagatagtaattatttcactaagcagatcgaaaatgtttcaatcgtttaaaaagctgaaacacaaccaaattacctcatgaaatattttgctacaacgtttgaaacaatggtttctcaaaaaattgagcgttgtttcaccttatataaaaacaatatttcagcaaatagcgaaagaatgtttagtcactgcaacatttgattcatgcacagtgaaacatcacgggtacactaggtgaaacattttggtggaacaaaaaatgaaacagattcccttaatagagggttttcgtaatatgtgggtgatttgttgcaaaagaatatttcaattcaacgcaacattagatatatacatagtgaaacattgtgagtatattatgtaaaacattttttgtggaaaaaaaatgaaacggattctcttaatagagggtttccgtagtatgtgggtaatttgttgtaacggagtatacgtagggacacgtgactagggcggtatgggataggtggcggggcggtgcgcgcgcgtacggtgggaggcgccagggcgcgggcgcccggcgcccaattttttgcagccgcgccgggcgcctaacgtggaggattttcgtaaagatacaaccttaaaaaaaagataaatttgaccaccatattttattgtaatctatatagatatatcaacagatatataatttttattaaaatacgtattaatattaatcggcaaatattttcaacgttatttatagtcaaagcttgtaatgtttaaccatgtccaaaacgataggtactattagtccggaaagagtataagaataagggtaattttaccattggtacctctagatagcaaaaattttagttcagaatttaagtagttcaaggtactttctcaagaactgaaaattcctgtaagaataaacactaaacactgctaataattttggggggtttggggattcagagtggtagcctagcttggggaggggggggggagggggttatgtacaatattaccgtcacactgtgatgcgaaggtggatgaatgcaaaattattgcttatgtgaagcgtcacgtctacggtcaggtctagtaaaacaagctttggacatactatggttcactaaatcaacatcatgtatctgaacatataattttcaacttgagagacctaagcaatagctctgctcaagtttaaggattggtcatatatttgtcgacgtttgatgtcgcgattccgatatttgcatagtatggggatcgttggtactaggatatatgcgagattgaggtaaaatagatggggacgaagatttttatacaggttcaggcccctgaattgtcaggtaataaccctactcctattggccgaagccggtagttgctcttattcaccataatcacaccagtacaatatttggggtagtctatctatctgttgtcgacttggaggccataaaaccatcccgtagtcgacaatagaatagtcttcctcctcgaatccgtgtccggcgagatctctcctgacagtatccgtagacaccgtaggggactagccatgcttatctctcaagtcgatatctgacgtcttgtcttggcgtatgttggcttgtatgttgatcttgtgtcttgatctattgttccgtatcccctctcctactagggggccttgtatttatacccacaggtgtccccttgtccaagtagaactaaggaaaccaatatggatacaatccgaatagtccttgtcgtttccatgtagaactctaaactcttcctatatccgaaggttgtttccatataagacatggtatgtggtgggtcctgccgagatttagtcaactactattaggtatgtggtatctataacactgacagtagcccccgacttcaatgcaaatgaacgagttcatattctcaatccgaagacctcggaataactgttatcgagctcacgtgaccgttctcggtgagttcagagataacgttagacttcccttatcagcctcatgcgggcaccttatagggtttgtctgagtcaatctccgacgtcaaccaagaaagtacagagcatacgactaagtctctcgtcttgctgtaatcgagaatttggattgaagtcaagaaattttatctcggcgagtacaccatctcttcattccgtattccttgttgagatccaccaactgttctcgagtgatcgagaaggcgcagagtctgcgacggagccttgtcaatatttgtcgtactcgccttagtcgatcttggtatagaaccatagagacatggagtcttcgacaatgtcgaatagaattttcctgaaatcaatacttagaaaagaatattagatagaaatagcccccgagcgaacactcaaagggtgacatgttataatatgtatggaaaactgaaaataaactaaatttacagaccaatgttttgtgtacgggcgtcttctcttttaccgacttcgatcagtcaacttgttgagtcatacactctcccttgcccctagccttgtcgtcggagaatcgttctcggaggataaggctcttggacccttgacctgccttggttgaaaaagcgcttaccctagcccccagccgtgaagttggaaaacccaatttccgattacacggcttggttaatacgcacggcgagaactcttacatgaccaggtcttacatggtcgtttgtctctacatgatccgacaaggccttatccgctctgggcatccccagccaaagttcccttaggttcctcagaggccttgtcaggacggcgtaaagagacatgaggataggtttcaaatctaggtgtcgtcgtggtaagggatctctgggtaaaacacttggcgatattgtgtacctgatatcaattttgctggagtagaggtaatgggaggatcgctacactgctgatcgaaaatcagttgtagccccaacttgaccacttgaagtaaaggtagtgggagaatcgctacaccactggtcgaggaccatgtagtagtcataactcaaccactggaagtggatgtagtgggaagaattgctacaccactggtggagaaccaggtgtagccttaactcgaccacgagaagtaaagctagcaggagtgtcgctacaccgctggtcgaaaaccaggtgtagctttaactcaaccacgagaagtaaagctagtgggagtatcgctacaccgctggtcgaaaaccaggtgtaaccttaactcaaccatgaaaagtaaagctagtggaagtatcggtacaccgctggtcgaaaatcaggtgtagccttaactcgaccacgcgaagtagaggtgcgagagatcgctacagcttactggtccgagaaccaggagtagcctcatctctcggccgattgatgtcgaggtacgagagatcgctacggcctactggtccgagaaccaggagtagccttatctctcgcctgattgaagtcgtggtgcgaagaccactacactgttggttgaagaccagccgtagtcctacctcgaccatctgaagtcgtggtgcgaggaccgctacgctattgccgtagtcgtacctcgaccatctgaagttaaggcgcgagagattgctacgatttactggttcgagaaccagcgagtagaattatctctcgaacggcaatggaagttacggtgcgagaaattgctacgatttactggttcgagaaccagcgagtagaattatctctcgaacaccaatggaagttgcggtgtgagagattgctacgatttactggttcgagaaccagcgagtagaattatccctcgaacaccaatggaagttgcggtgcgagagattgctacgatttactggttcgagaaccagcgagtagaattatctctcgaacaccaatggaagttgcggtgcgagagattgctacgatttactggttcgagaaccagcgagtagaagtatccctcgaacaccaatggaagttgcggtgcgagagattgctacgatttactggttcgagaaccagcgagtagaactatccctcgaacaccaatggaagttgcggtgcgagagattgctacgatttactggttcgagaaccagcgagtagaattatccctcaaacaccaatggaagttactaaagttggtttattacatgtgcatcttatgtggccaggatgactcacatacccaacttgtagcatatccggatgtccgttcgcaatcatgtcaggtgatcaagccgacatcgttcgcgagcaattatccgttaacaacccttttctcaaatagcccagccatagccggtgctatgagataggtcgtcggtcttcgttggtaggttgggtgcgacaactctgcatttgtcgagaatgttctcgataatggggtgtactcgaccacaacctactcgagtgctcaattgtccctgaaaaatatttttctagaaggcaaggcatatagcagagcatatcgagtatgtaatcaaaaaactgcatatatcttctagtattatcaggatataacgagcagattaaatatgagggattatgtaaaccgtaaacaagcatgatttatacagaataaaatagatcaagcccccagcgttagactgtagttggcctaacataggaagcactcgcacaatagatattgtattaaaaacatgctctaggtaaacataataaattattgatctgacaatattgtatgatctgaaaagtataggtacgataaattgcctataaaatatcacgtatctctacgaaattagtagattaattaaaaatcgatcttgctaattaccttggtctacctgtctcgtataagaattttggaggcaagcagatagttgcttttggtgctatgggcatcccgatgatcatatagtgcatgtccagagcaaggctatccagttgcatgtagctatgccggctggtcgcatgtccgagtaggtgggaaaggtccaactagtcagaacttgcaggcgcgcattgtccgagtaggactcgtagtatatgcaaagaaaggtacatattactctattactccctccattccaaattgatctattatatatttcataggtacaccaagaccaaaaaaagctaataactctctcatactatatttactctagcaacaaactcaatgcatgtaccatccccactattttctagccaatagcaaatcaaggtattgcatgtgggttataaatacatatgtgcatggatgcatgcatcaatgtccatttactccaatgcacaaataacgaatagacctaataaatgaacacaaatatgtagatcatttaggaataacctcaaaaatactatatgtagatcaatttggaatggagggagtattaccgatctacagtaaacaagaataatctattcacagaaatttgggacgacgaacctgatgtcattgtagatcagtagcgcgttttgtcgtggtcggccgatttgatccggttagaattctggtggtggaagtccgctcagaggttgtaggacaatccatctcttgaacccatctcgtcggaaccttgaagcaccaaaaatcccctatctgacgcaccactgtcgacgtttgatgtcgcgattccagtatttgcatagtatggggatcgttggtactaggatatatgcgagattgaggtaaaagagatggggacgaggatttttatacaggttcgggcccctgaattgtcatgtaataaccctactcctgttggccgaagccggtagttgctcttattcaccataatcacaccagtacaatatttggggtagcctatctatctgttgtcaacttggtggccataaaatcatcccgtagtcgacaacagagtagtctttctcctcgaatccgtgtccggcgatatcagagacaacgctatgtctctcctgacagtatccttagacaccgtaggggactagccatacttatctctgatgtcgatacccggcgtcttgtcttggcgtatgttggcttgtatgttgatcttgtgtcttatctattgttccgtgtcccctctcctactagggggccttgaatttatacctacaagtgtctccttgtccaagtagaactagggaaaccaatatggatacaatccgaatagtccttgtcgttttcatgtagaactctattcatcctttcttatgcggaactcctcctatatccgaaggttgtttccgtataagacatggtatgtggtgggtcctgccgagatttagtcaactactattaggtatgtggtatccataaccctgacagtattttactttaattatattataagatgaaattacagtattatatgtgttgtgatatgtataggactatgataattttggttaggttcgctatgtcccaatggaaaaaaggaacatctccgtatgagtagacatgattggaaaattcgtatcatcttttactataatttgtgatagttttggcacatacggtgagtgcggtgacactaataaaaaaccctcatagggatcggcttataagtgctggtttatttaaaaccggcacctatagacaatttcccacctccctatgatggaaaaatacaaaaccgatacctttaaacactataggtgtcggttctagcgaaaaaaccggtacatatactattggtgtcggttttttaaaagaatcggcacctataatatattataggtgccgattcttttaaaaacccgaccccattagtttttgtaccggttttttcgctagaac

SEQ ID NO: 70171 - DNA, 3417 bp, Oryza sativa
tacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgtgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctagattccctgcgtcctccgcaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagatacggcttcgcaagatgggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttcgggtctttcttctgtttcagcgagatctcgtcgcgtccctcccgccattccaagtccggccagtctgaggccgaggatacggcgaccgcggaggcccggaggcgagaatctgaccggcgagaagccgcggatcgcctacgggaagccgaggaggccgcccgggaggccgtccgggctcgccaggctgaagaagccgcttgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccattgagcgcagagccccttctgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggaggaggagcggggggctgccctcatcgccactaccgtgatgaacgaggcgcaggacgacctccgccttcaatacgggagctgggaggcggagctagggaagaagctcgacgccgcccagggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccattcgggaggtcacactggcggcgcacgaagccgcctgtgccgaagaagagtccgcactccgcctccgcgaggatgcgctcaccgagcgggagcgagccctcgaggaggccgaggccgcagcgcaaaggctggcggagagcgcgtccctccgcgaagctgcgcaagaggaacaagcgcgtcgcaatctggaaggtgcccgcgccgagagggccgcactgaaccaacgggccgctgaactcgaggcgcaggcaagggagctggatgcaaggcgcgtagcggtggggcggccacgggcgacagcgacttagccgcccgcctcgcagctgccgaacacaccatcgcggatctgcagggcgcgctgaattcgtccaccggggaggtcgaggcccttcgtctggcaggcgagatagggcccagcatgcttcgcgacgccgtgtcccgtttagaccgcgccgggcggcaggcgggtctctggggcgggcggactgcgaagtacgccgccaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggaccccgacttct

SEQ ID NO: 70172 - DNA, 1934 bp, Oryza sativa
atttccttccttgcagaggcacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcagagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacagcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtccaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgta

SEQ ID NO: 70173 - DNA, 32410 bp, Oryza sativa
acgggtcgaccgaatcaatcaacgacgtgacacacatgcgcttggagcagcagttgattcatacatatatatattgtggccggtgacccaaagcatcaccaccacacgtgattactggctagcgagagagctaagtagcttaattagctagatgtcgagttaccgcgtcgtcgtcaaacgctgtacgcgagctgcgattccgccagcgagctaacgtcgagctacaacagatcgtacgtcggtggtgtgtacggttaaattaaccatgctaggagttgctcggcgaaatgtgtgcagaagagcggaatgtgccttagctatccggaccgacacggttggttagctgtaaagtaaagaaaatgacaccgaacaggtgcctgctggtgaaatgttcctttttcttttcaaggcacagtaattggacggcatgttggacgatgaatgaactattgcattgttgattctttttatttatagtagaataaaagataggaatattttgttccaacagtccattttgaactcaaaacactagttggcttttgttgtttgcagatgtgtcacccatacaatccaaaaaaagaagaatatcatcctaccgagcgtgacatggtattggtgagcccattggtctccaagcctaatgtgaatggaaaaagtctaacttaactcccttagtagtggtcgaatttggttagtattccttaactaaaaaggtcaggtatactgtaaccctttaaatattaaaaccgtgcaaaacaactctcctgactgtttttcaaggacagttttcattgacgtgtcatccacgtgaaagttcaatcaccaaaaaaaaaatcaaaaatagacgtggggctctctttcattcccccaaccacgatgagcttgagcttaagctcaaacccagcaccaatggcctggcctcgccctggtctcctcgcacctctttgagctctggcaccgacgagctccttatcctcctgccaccaccactatgagggtgagtacgagcatgacgatgaaggtggccttaaaggtatggcgtcggcacaacactccagtttgatttagagcccattcaaattgatgacatttttaaccataccattatttgataaaattaataattatatggctacatttaatttgttaccaaatattagcaatgtgtatagaattttggtaacatattaagccaatcctactaaaattttggcaatattaccaatttgctaaaattttagtaaagttcattttgacataaatctaaacagacccttaacagttcgaattatatttgggctcaatgaccaaagtgtgagtattttcgattgattgatttatatttatttttaaaaatatttaaaaattcatttcaaagttttacaaaaatatactcatgggcatacaaatcgccttacgatgacgtggcaccccgtgggaggtgtgccatggtgattttgtaagcgacctcctctcagtggtaaatcgccctcgggctgccagcaaaattaccacgatatgccccactcgcggggtgacacgtcacatagattaccttaccgaaggacgatttatatgttccaccttacagtaggccaggaggagtatatttttgcaaaactttgaaactgaactttatttttaaaatattttttttaaaaaaataaatataaaattgaaaaaaaaaacaattttttactgggttttattgggccagcccatcaagcgtatgacaagtgtaatacaatccaaggcccatactccctccgtcaaaaaacgttcaaaccgattacggaatacgtacgtcaaaaacgccctttaaatctcaacctttgaaccgtctttccctcatcattcctttccacgtgagctgaagtcgcaaatttgtacttctttactttaccggcacaagaatacaagatggtgaaatttcgttgaatagacaagtagaaaaaaacacaatgtatatgtctcaaaccaaagaactataaaaagaaaaaaaagcaaggttatagaatattttttgaacctttttatatttatttttaaaaaacatacccaccaaaaacttatactttaaaaaatatatattttttagataatggaatagaatatccctgcctttgctcaaaaagagctaaaacccattattacaaagttgcactaaaaaaaagtgtagttcaataaaacattgagaacacgcacttaaaataagaaattatatatatatagaaaaactattctacacccggggtaactattctatacccctctccctctagcccacctcccctccctccagggggcaaaacctaccccacacctcagtcaaagctcccccaccttggtcaaacccgcccttcactttccccaccacctccactcttctcagctctcgtctcagaacgacgtagtaacgcgatgttcatcgtacagtaacaccatgtcttacgtgcagtaacaatattgaaatgtagtcataatatagttatgacggatctacttttgataagcacattttttctaacatcatggtgcaaacggtttttaaaagtagtacatgatgtgagagatatgacccttcaaagattggttttttaaaaatttggctctccacgagcagtaattctatatcataagtattactgctgatcctctatgcgttactgtaatcacataatatcgttactacatgatgtaataatgattataagtttcttagtagcatagtgtgttactgcgattactttataacgttactgcaagaatatgtatagtaagaaaaaaaaggtgcagtaacatggagagagagacgaattagctcggtttactcatggggcaagggtagagagaaccttcaaagactggtcttttgaaatttaactctccacaagtagtaatactatatcataagtgttattactatctattgtacgttactacaatcccatcataacgttattatgaaagtgtggtaaatattataagttttgtagtaacaaagcgtcttactgcaattcttgaatagtattactgcataaacttgtggtcacgtgtatctgccatgcagtaacactcacacttttgtgtagtaacaaaaatatggttcgcatgtagacttttaactcatatatttttgttttgattcctagtttactacaatttcaccacgatgttactatcaaaagtgcagtaacatcctatatgttttgcagtaacgtgacgtgttactatacttatacgataatgttactactaaaacatagtaacttgttatgggttttgtaataacatatatatttctcttctacttagcttcctacaactatggaactttatgtgtcctgtagagttgtaacagtttatatgtttttacagtaatcgagtgtgttactaccatttcttctcgaagatttgtcttttgaaattcatctctccataagtagtaatactaaatacttattgttactactttttattgtgtgttactaccattccattatgacgttactctatgtgtgcagtaacaactataatttttacagtaacagtgcatgttactgcaatttcttaatagcgttactgcaataacatatggtaacaaccaaacacaagtacctaccacccactttgaactagtaaaatgtaagtgcaagtgatatcttttgaattcacatctttaaacaataatatctctcacaccacatattatatttttgaaccgtttgcaccgtaatgctttaaaaaaagagctctataaaactagatccgtcatgactatattttaactatattttattagtgttactgtaagtaagctacagcgttactgcacggtggtcgtcatgttactccaccgttcgtacgagacaagaacaacaaataggtggacgtgggaggaagttagcacacgggtttgaccgacgtggcagcgatttgaccgtcctttgaccatgctttgactgggggtgggaggtgggttttaagcccaataaaaaaaagggagaggtgggttgggctcttgagggggaggggggtatagaataggtgtagaatagtcttggctgttttgtactcccgggagtacatacaccctcccctgatagtggatcatccaataggatccaatttaccggattgaacaacaaaatgattaataaataaatgatgtaattaacaatcggggatgcatgcatgcaactaataatttaaaaattagtccgcctgttgcatgctacgtattcagtgcaccttttttttttcttcataatattcggtatatatgtaccagagccaacgttgaaaacgcctttttttagtatccggtatatactatgtgtttatgtgtatgattcagtatgtacaccgtattagatttttggttgttggactatatgcatttttttaatatccagtttgtacatacttgatttttttttaggtatggcacatacttttttatgttagtaacagcatatacctttttaaattaggagagcagtatatacctttttttaatccggtatatactggactagatcatgtactggttggttgtagatactacgtaccgctttaatttctttgtaggattcagtatatactagaccaaatactgtttttttaggtacgatagctcccttttttcagggagagtagtagtctttaagtagcagcgcatactattttattttagtacatactgtttttaaacttagtagaagtatatacttgttttaacttagtatcaatatataacttcttttaattagctagtaccagtatatgctacatacttgtcaattactagtatatactttttatgagtatataatgttcttaaacttagtagccgtatatattttttttatagtaagttagcaggagtgcatactgtttttaaacttagtagcagtatataccttttttaacttagtaacagtatataccttttttttaagttagtaccagtatatagtttctcatactagtatatacattttgatgagtatattttttgaacaaacataaagatgtttgataggaaaaataagtcaaaacgacttgtaatataaaacgaagggagtagtataggtattttttttccacataatagtacgtaccatttttgtcttatagaatagaacaatacgtaaatttggtatgtgtagggttgctaattatgaatatactgtattagtcaatgattgataaagaagcgtcgtcaatcactagcaaagtatcgggttgctgcattctgaataaagctaaatgaatgaaatacgctagaagtgcactgaattccgaatagacattctacatgcaggctaacaaatcggttagcatcgacgggatcacgccaaacacgcgcccgagagcgaaacgagtattcatgtgtcagcttactggatcaacggaatcacggactcagcaccgtcgccagacgaccgtacatgctggagtgtcctgttgtcagcaccatctatgcccacgatagatgtgtctcgcatgtgcatgcaccaaacaaatgcattcatcagaggcttaatcattctatcaacgtcatacttcatgtctgcatcctcgtctgcaaacaataacagagatatacccaatagaaaaaggaaaaggaagagtatgtattatcgttctataggaaaaaattaatcaaacaaaactggaagaaggaagaaagggcttgccttgatcgttgcacgggcttgatcgatgccagccgcatgaccacagtggcttgccgaaatattgatggcgtccttgttaaggtcaccggtgctagcttcgatcggtcagccaaggtgaagccaccgccgcctccgcgtagataggaagagccgatggattgatgccgtgataccgtcgccacaagggccggcaccgcctaggaacgccgtgttgctgcagatgaatgccgccgcatcccagcaaatcaccgatggatgttgccgccggcgtggttgctcgatccccaatggatcgtgccatacctccgcttcgagtcgccggtagctagcgctcgatccgaatacaacggagagattgccgtcgcggatgggatgggaaccaagggatttatacgatctgttcagaaccgaccaattagtgcgggataattaaacattataggagaatattctttaaagaaatggaaacgggtccggtgagtgcatccggtaacagggttgatcgtgggtggctactgatcaacggtggatgggagcaggtgtgtgtgtgtgtatatatatatatataatttgtttggcgtgacacgacaacacgcagtggttgtgccattgttgtcttgccacaccaaatccatctagttggtatgtcaaaggttcagatttagaaaaatgttctagggggaatttatttaaaaattaaaaaggttaaaaaaataccattctagctagcgtggcaaaacccttactacaccagtctagcattattctaccacatcagctagaatagcatgaccaaaatgtttaaatttgaaaacaagttttcatagtctttaaaaataagatttaaaaggttcaataaaggaaaaaaaataaatctaaacagagatagatgctttgcctctgcaagcgcccaaattatgacctcttctttaattttcgccaacaaagctattgcaaaaaaatcttatgatagaacgctttctgatttctctccctccgtatctcttagacctaggatgtcaggaggatgagagagctcaacccctgtgtaagtccttgcaggtgaggagtgtttcctaccaatcatggaccatcgtgctggtcttctagagtgtactactaagactgtgtttagttccttccaaaattggaagtctgggttgaaattgatacgatgtgactgaaaaattgtgtgtgtatgacatattgatgtgatggaaaaagttggaagtttggatctaaacacagcctaagtttgagttgttagcatgagatccaggtaacaggcatgtcccagatttttctcgtgtacttgaactcaacaagaaggtggaagaacgtttaagtgtgtggctgtacagtgggtaacaagtgttgtttggccatccacaaattgctatcatgtctgacgtttacactctgttttgcacgattaattaggccaaaaaaaatgtatttctttggtgcccaggacttccagatgatcatatcatagttatcgttgatacacaatggtaattctgaccaactttatgtcttggcacgggtcctacgagtgtaccagaaaaggttaccaacactgcacaattgcgagacatagccgcatgccacgaaatcctgtcactcggccagagtaatcgtggtaaattgtgagtgagagcaggccatgctgagtgtccgacactggaactcttctttgagaaaggaaaaaaaaaggcgaataatgcatgatgccgatggaataatacagacgttttctctgacctgagtgtggatgatacgcttcaaatctggaggataaagggggaagtttcaccgacaaagacaaaaggattcccatggcccaatggccgactggaaggaagggtgaagacataatacagtatcacaattacacattttttttgacgcaaaacaattacagaattacatgaatgatatgtgctaatcacaattacatctttttcttttgtcttcttccttttgcagtatgcggcagagctgtgcaattagcctccgcgagaattcagagataaagttctgtttatgatagagacgtgaagtatttgagatccactgccttttgcaagaattcagagatacccctatacggtagtactattgctcgtactgtatagaaattgacgatcaagtcgacatcatttgtgagaaccaggagaaaaaaaaagaattgggatcccaaaaatatttgtatgcgtatcgatcgaaattgagtggccaaatcttggatctgacaaaggacatgacgcacattatcttccatgcttattgtggatcactatctctggcatgctgtctgctgcccccttgcaaatagaagtgagcagcagccacaaaagccgaagatttttcttcgggagcatgaagagccttggcccttggtgagctgaaactgaatttgggccaatcgtgaaaactgacaataatcaacttggatcccacttcgaaccaccaccattcgatgtccacgagcacaacgaaatgttcattgacagagacggagcattttcaattcgtcgaaaacgatctctcacacgcgggccattagaaaacaaagcatttatacatgagtgttttaaatattgattcattttctgtggcaattagcacctcctgcgtgccaactgccactgccaaagaagggcatctccatttttgtactatcaggatcatgtcacggtcatgacagctgagacgtcagcggcacactggcctgtgcagtgtacatactccgggagaatggcatcagtaagcaatttttctcgctctttactgtattatatatcttgtcgaaagaatcacatgtttgttacatcagaggtgatctccgtcttcaatcattcgaaagaattacacatgtatgctcctttacaatgataatgctttgaaattctaggctcaacgcccaggaggctggtcagatgttaagcccaggctcctgagaaatcgaaaaataagctagagactaatgttctgtcaatccgagctttgtgcagaagaactagttttcaagtcagtttggtagtacactacgtctccggtgtcactaacatagtggtcgctgtttaagctctttgctagcacaccaagtaagtggaatgggaggggagctgatttctctggctctttgtagtattttcccagcactggttttgctgcctcagtctgcaagttaggtccaaaccaacataacttagtaggcgattcttgcaaaataattcattaaaacagcaagagtggcggatggcttcttaccgcctcaacaagatggtaatgtgggatttgtgggaaaagatgatgaatgacatgggttccaatgtcatggtgtacgttgttgatccacccgtagtcccgatcaagtgttgtcaatcctccgcgcagatagctccactcctaatagagcaaaagaaaatgtgagctcattaaaaatatataaactccaaaatagtgaaaagtatttgataatctgcacttcattctacgtaggaaaatggttaaaaaaaggaactactgttttgatatgtccattagcatttcactctggaaggagacaaaaggggctctttcaagtacttgaccacaaggaatctgaggtttgtagcgttcgctccttgcttatggttggaagtaaaggatacatttggcatttagccataaggcgatacataactaccaagcatgtagacaacagcagtaccatattggctacaaacgctgcatgatgcactaccactatttttttgaaatttttttcaaggtaagtcaaaaatataataattgcatgctttatatcagacaggatacgcccacgcatatactccattttataggataccattaagctatgcgtatggaccttttggtttatataataatcatcactttgccgacctaatatacaatggagagagggctaaaaggagagaccacaattcctctaaaagcctagaaactaccgcattaaccggagaaagagagagagatatacaactttgaatctaagataatagtgggaacatattataatggtgtagaccaaatcatttagttgtatttccagaactagatggaagagtggtatatcaattcggcttgttacctttaaagtcttagcttagtttctacatgcagtaccaatgtcgaataatgaaactttccatcatttaacaaacaaaaatggactatctcctagtttttcaacattaagtggccatccttgaatcatttacaaatagcaaacccatacaattaataatattatttacctttccacggtaccaaggaagcttgtcctcatggccatgatggtgcaaatatgtgacaaaatcaagccacataacaaatatctgcataagggtttacaaaatgtgaacacatacatcaccagacactcccatcaatccaaattatcattttgcagaaactaataaaaatatcatgctcttaccacgtatggaacagcatagagctttaacattttgaggggccccatcacaaaggtcagaccagcaagaatcccaaccattgccagccaggatgcagttgatgttatcacatccttcttctcatttggttggaacagatcactgcttgggttgaagtgtgaaccttttttccctggactccttgcaaactgcatagacatgaaccccaaaccaggaatttagtatgatattacaaaataagaacctctaatacagttgataatgaatgtcaagaagctcttggcctaaccaagtataatgggaatgccagcatgggaaacggcatggtgaacctcaatttcttcgtcatatagtccaggctattgtacagcctctcagacagctgcaggttgtcacgattagagaaccatcgagcaaaattgcagaattcctcatgaaccaaccaaaaacaaagacctaccggttgccaggactcgtctttctcgacatgaccgtggttctggtggtgcgtcctgtggctaatcctcctgaaattggatcgaaataatgtgagatgctgccttccttagcttcaacaacaattcctgtccaaaacgaaagaaccaggaatacatgaagcgcgctcatcttaccagccgtggtatgggacaaggatggaggagtggagtatgtgtccaaccacgctgttcaacttggcgttgcttgagaagctcccatggccactgcaaagacaccgagtagggaaggaagggtcaacgatccgggctgcaaaagctaaaacccacagaaaagaaaaaaaaatccaatctctaggatggaggcaggggcgtaccagtcgtgacccagcacgaagagcgcccagaacatggtgccctgcgcggcccagtagagcggccagacgagccagctgtcgacgcgcgcggcggcggcggcgaggccgagcaccacgacgacgtcgcgcagcacgtagctcatggacctccaggggtccttcacccagcagtgcttggggatggccgcgcggatctccgcgagcccgaacggcggcggcgccccggggtcgaacccgtctccgtcccctcctacctcccccgccgccggcttcggccgccgccaacgaacccctggcctcctcctccaccacctcctcccctttattatcctcctcgacgacggaggtgaggcgggtgggggcggaaaacgcggagcgcccactcgcggtggatggctccccccgcggcggcggcggacacggggcggcgcggccccccggcgaggctggaaggcgccggcagcgcaatggcgccgcgcccgcgcaggcggagcggcgtgaggccgcagcactcggagaggacgagccgtgccatcgcctccgccgccaccgacggtagcagccgctgcccctgacggcttacacggatttcctttctgatttttctgctctgcgttcgcggatgggccttgctgtgcgggtagtggtggtgatgggattaagagaagtccacgatttttatactgccattgccagccacggaccggaccgggccgccgtgaagcgcgtgggggggttcgcgcgccggtgaaccgaaggggacgacgcggtgcggtcgactcggactcgggtcagacgagaagacggtagctgtcacgtgtgaatttggcgtgcgacgccgccccgcttttaactcgtgggttgactgactggtttaattaatttagcgctgtggcgattatattccaggaattagcggttcgatcgatctaatgcatgtgtgtgaaagccgtaggtttggtgtggatttgtggaattatcggatgttgcacgatgcgtctttctcactgctaattaagatagtttagtttagcacgtacgtacggtattgtatacgtggcaatacagtagtacgtttggtatgcatgggtggtcaaaggtggattgcagcagtgagtcaaccaagtctatggtatgtggtgtcaactttggcacaaaactttttcaaaaaaaggaaaaacaaacgctctctcgctcatgtatgcagcataagttcagtgcttggacgggttagactaatggaacacattccacgtttcgtttcaatcgaaaaggagtcagcgtacatatataattaatgtctgtgtcatgatcattgagattgtaataggaacgcttatgcatttttgcgtgttggtgtagaatgtatgtactagatcattatcctaagtgcactaaaaaattgattgttgcatatgtataccgtgatagacaacgcaataaacctgtctgctgcaactaattcatccaaaccttctcttgcacatgtggattagttacatcacagttcagattataaattgcggcataattagaaattctctggtcccgaaatataaacatgcccaaaatatgaacattcttataaaatggcctaagaatgttcaattaaatgccacctgagtaatgtcacattagaatgttacatcactgtttccaaggatgccacatgagtaacaaggcatttagttgatgattaaaatagcttatcatgttggctttgacccaatagcaatatagattgtgctacaaattttgtatttttgtggtcataaattatgagaatctatataagagcttccaccgccatcaaagcccttactatcaaaataccaaaatataaaaatattctattttttatgcaagcttttggaaaaaaaatacaaagcaagaataaatcgttgcttgatcttttatctcgcacataatgcaacacccaattgtcatcataccgatcgatcttttatctcgcactatgtttcatggattgggatgaactttgaagtaagcatgaagtctaaacatttttaattatacgtagtgttacgttgaaagttagtcttacgtttagtttactgttaaacttttgttaataaagatggttcaaagtatatctcattctataaactatcattgttattttccatttaaaaaataggattagctaccctctccatttcaaaatatagtaaacctaagactaagatggacaaatcataatgatatgaatctaaacaagccctatatccaaatttatattattataatgtgtctagttttctaaattactatattttggtacagaaagagtaggaggtaagtaaatgtatttttggagggggggaagaaatgcgttcacacggtaaaacttctttatgctgatggttaattaaatgttttaggtgtcatctgtctacgtcaataagatctttgatgacacacattagtacagtgtggtacaactgtatatacatccttcgtccaaaaaagagtatgaaagcaattaaacagtccttgatctgatctctacaccatcgacccaagagaaaatttgatttatatactatcatgggaagggagcttgtaccacgaaatagaacatttcaaaatgttatgcctccctttaacctgatgcattcatacttggagaagaaaccacgtaatccctttttggtatcctttcctcgagactctttcgtcgtatcatcggaaaaaagaagggagagatttgccttgaaaaggaatgaacaagtcagagaactcaaatggcatacgacgacgatgtgaagatagtacactaatcaaatgcgatccagtccatgctagtactttatctgtctcctattaaatttatttttgggtccttacatttatttcaaaataaattcatttctactataattattatatcgaagttggtaaaagtaaaaaaacatttgtgtttaaagcagataaaataagagatagttatattattgtttgataaaatagtaatattctaatttcttttatgtgtgtggaattgataaaaataaatttatttggacttgctactactcactccacttgaaggttcgcttttatactggtcgatcgcgccacgcttagaagcacactaggggttgttttggtttaaagtcctaccaaaattttgttaatgctaaatcttggacaagttttggcactaccaaaattttggtaggattatgttgtttaactctattgaattggtaagatttggcctcaatccaaatagctaacgagtactgttcaaaactaccaaataattggtagggcaagaattggtttcaatccaaacataccctagtactccctctgttttttaatagatgacgctgttgactttttctcacacgtttgatcattcatcttattcgaaaattttatacaaatgtataagatataaatcacacttaaagtactataagtgataaaacaactcataccaaaataaattataattatgtaaattttttaaataagacgaatggtcaaacatatgagaaaaagtcaacggcgtcatctattaaaaaacggaggtagtattactactactcatttcgctttcgaaaatggaaaaggcagggccgcaccgggaggggtgggcccggtgctccaggcggtggccgcgtacgtggagcaggaggcgtccacgtcgacgagagctgcgcgcgcatatgggtggcttctgccatgcggatggcgtggcatcttctaccgccgttgatcttctaaccgacggcgctgcggcgatctggattctggaccaccgggggggggggggcttggccgaccgagtggccgcggggaaaaagcggtgagcgcatgtgtgatgcttttttttcctttcgatttcgacgtggacgtgaaccggatcggatcgtggaaaatccatttgctagtcacccaatcacacccgtcgtcattaggacctgattaagacctcgattagattaattaacccatgtggcaaactggcaaaattgatagtgcaggtcgtaacatgtcctctcaagcggccggtcgcctcgcctggctatgttgccatttgtgcgccaagccattgcgaacctcacttgcgttgtcgcgcggttggacgctttgtggtcggcagcaacggagagcgcgggggcgatatccgctgttatgacggcccggtcctaccatgcatcactagaggggccacaagataatccggcagtggactccggccaagagtttaagaacccgtttagaatggtgttattttgaattatatctttttaaagaaactgataaagacgtgagtgtatttagtttgttactaaactttaagtaatatttggcaataacacatttaatctattctaataaaatttagcaatgttgttaaaattttagtattatcaaattttgaaaaagtttatttggaagtactctgaacagctcctaatataggactcatgtaataaccagcccaaactaattagaaaggctggaccgcagggtagaggactaaacgaggaccaaagacctcagctccgtccaagccaacaacgtgcatcacgtaaaactatatgtttttttagtggacggagaaggggttgttgcttgttggtccgtggtccatggccggtgcggtgcggtgcggtgcgccttgccttggcgtcgtcgttggttaatcacgcttatgtcctcctgcccgcgtggattttagcaagaaatcgctccgaatcgcggcaggatcgcatctgtggccggcaggaggacacgaggtcctcgtgctcctgcggccaccatccatccaatcccgataatgaaatccctcctcattggtcaaatccatggtttcatgcgtgctcccccctcagctactagtacagtttatttatacattgtctaccaaatccacacgacattcctacaagttaaaaaatatacagtagcatttctttctgcatgacaatttaacaggaagatatgacctttctgtctaacaacagcaatggtgtggtattactgtacccgacaacgaaccgttcataggccccgtcccgtcctgattctgttgtccattccgcatgccattcttcagatctcgcctcgaataaaatcaggacttcaggagcatcttatgcaacgccaacgccaacgtagaccataacatacgtacacctttcatgcccctatcactctatcaggaccctgtgcaggtagtgtgaccgggccggatataagtgaacacggagagactagagagagctgcgagtaaacgggggcgccttacccacacttatcaatgggcgtccaatcagagggcgcgagcagcaaccggtagctgctgcgatatcgtgtcctctcccggcgcctctcatcacgccgtctcctcgtacatcctgctgattacgacaagcgagagagggggagaggctggatggtcagttggtcaccagccatccaaatcgtccataaacagtactatgtgctatctctcagtactcttgatggagattggaggcagataacatcgctgcacaagtgaaagcacgttgctctgctttgctttcattaactatgcgttagctggtagtacaaagtagttcaaaggaaatgataagctcaaaggtggtactacacattactgtcatcggttggttggtaatcaaggtggtttaggccatcaaggtctcaacgtaatacaagttatggccacagaaaccatgtaggccaaaatggtaaggagcatagggaaggcgatcgtatgaaaagatggcagaaagcccaaccagggatcatggcttccaccatttcttgttctccatggattttgcgatctgatgagcaagggaggcaaaattctctgactcgttctgaagttcggcggattcttggcttattctctgccaagtaaagaaccagaatcagttctttgtgttcaactgttcatagacgaaaggagaaaacaacttgatgcaaaaaaaaaggatggggaagtcgtttacagcaagtttctcgccccgttccttgagcttatcttttgcatgagctgcagctgcagcagcatcctgaaatgagcattcagggttagtcaggttaacaaatcagaggtgatcaattcgctatttcgctgcattggtgaaactagaaaaggaaaagtaccccgccaaatttgtatttggtgaggatctcttgggtgcttttcattcttggtttctcaacatcgcttgatccgtcaaatagtttctccctttccgtctctagcaaacagttaacattgcaatcagaagaagagtacctttttttaagaaaatttgagaagaagagtacatttatatatttcgaattgccagaaatcgcagcgctacctgttttggttttcttactaaacaaagaccttggggttgatgctggtgctggtcttgcttcatcgtcaatctttatgtcgtctgcaatgtactcttagttacatttcttgttaaatatgaacgagatagagagatagagagggcgcgcaccaattgccaattctcctgttggattatgggtgttacccattgacaattccacaaaatggattttgaagaaaaacacctagaactgttcaccttaggtttatccagcgcaacttcctttcagcttcttgatttctcttatgatgccacaagagtctaagagagccagctgctgtatcatgcattagaaaattcaagtcaaggcaacatacagaatatttcaacagatgctgcatgaacataataatgtcaagcatggaaatgattgtggaatcctgagatatagaccgtgcaatagaaacgcagcaagtacctgaagccgttctcagaaaaaaaaaatgcaaattaagacccagagcaacgtgagaataaacacaggaatttcacatcaaccagagagatgaaaggaattaggaagagtcttgcagattacgaccacatttggtcaccttgaattgtgtgttgccacggaaagcttggtgtttatttttggacaccacacttcagggttctccgttatttttccatttttaacaaccgaacaaggctggaaaacctgctgtatagagctgtagcccatttctgttgcagaaaggtaccgagaacagccaaaaatggctattgggcaacggcataaacattaaaaacgacgaagaaagcttccttcaagtttatcacaagctatgaaaatacatgaacctggactagtcgaaggtggcaaactgatactcgtgcgatggcactgcgagagatcggatggatggtaacaaaaacaaaagacagacgaccttcgactagtccaggttcgcaccatgaaaaagccaaaatattcactagtctgaactctgggtcgtgtaagctactcatttagaacatacatttgcagttttgcatactatcatccaagcagtcaattactaataggaagaaatctggcgttacagattaacttcagtttacaggatcagaaggccaactgccgttcattacctattgagaatgattaccaaccatgtatccatggctcatcacaagatctactgagaatgtgtactgaaaaaaaaaaggaacttggggctgcttaatttgaggtgttagtctacagggcaagttggctcttatagatgtactacttgctgaggttcttttttccgttgagttctgagaaggattacaaatttaggggtgggggtggttcatgttagtgtcattggtataaacaaagaattatatgagaccacacaaacgaggcttagagcaaaactgcttcccatttgctttcaccaaggctaccactccagccgtcaaacccgcacagataatggaggtgatgaagtgttgtgcattccgtccaactgctggttagatgagatcacaaatgtaaaaacaatccatcacactacgggaacttcttaagtgaaaacaagtacgaggaggcacaccttgactaagagtgaatgtggtggcagtaatcccaccaactatgattgctgaagccacaggaagatactgcaatcaaacaatattagtaatccccagtatcgaaatgaacatgctaattattaaggcagaaaaaaaatgaaaatgctgattaccgttgcagattcaaatccaccattttgaaaaggagaagagatgcctttgctgactgtatagtaaccgctgataaggtctagagcatcctgaagatgagtaatgaagtattaaaatttaaaagaagccagcaagagcacattttgtagaatataaactgcagcaagcagaagattttaacatagatggtttagcatgacaacaacaggagttacaacagataattacttcaaatggtttgtttgaacgttaaattaaagttgtatataataaggtacatccataaaactgttactagaccatgcaaagattagttaagtgctcagacgaactgtgtgcattacaaatcaatacaagaaacacctgaaaggatcattcactgataaaatatgatttgacaagaccaaatattagggaagcaatttactatgtatatcagaactggcagtggatatcacttacttgtctcactccgtcatgaaaattattcaaataatatcgtgaaagagcactcatgccatctttaatcaatccaggtaatgtctgccttccatacctgtgttattaagttgttgccatggatttaacaatacaaacgcaccacagttgataaacaaattattgttgtaacaataaatgctaaaaagttacctcactaggtccccctttagtgcataagaaccagcatattccaggcttagctcatctccatgttcaacccacactgtgaaagtatgactacaatatatgtaaaccatcttggtttctatagtaaacaaaaaggaaccttactttttttaaaggtgtcactaatgtctccagattgggaaatgctgccagatgatgatagagcccccatgcgctgcagctgtaagtccaacgattttctagcaaggaagctctggaaagcaaaagaaaagtgttaaaaacggattagtgttaatatagtcaatagatcactaaacatactacataacaccattttcagtatttacatttatcatcctcaacattagtaatgaaatattatatcacggtgcatgctcagtttaatcccatgggatcattgagaacaatgctaaataatttccctgctcactattttgctgaaggaatgctcattagagtgaagtggcaaattatggcatgtgaaaatgtgaaatacacattgctaagtaccaactaacatgtatctatccaaatcaattcaggacatgcttgagctatgcaatggatctgacttagcaactcacaccttggctccatatcatagaaattcaacttaactagagccatatgcatcagtgcattagcaatctgaaggattgacgagatagaagaatagaactgttagcatgacatgcaaaggtctaaggagtaagggctatcacaatatagctggaagttattacctttgtttcaaaaataatcatgatatttgttaacttgattcacagaaatgacaaaacatacctgagttacatttgtacggtccagacaatctatgcaattggatctaactatgccgctttgctccaggaatatctctcctttggagttgataagaaaatatctgctcagctggccccgaaattaatcaagagcaaattacttgccatagttaaaccttcagtagttgaaataaatcttaaagtagtctcatcaggaacaagagataagcgtaaatgttggctatttaaaggtgtttaaaaattacccttgtttctgaatagcttcttcaatttgattgtatagaacttgcagattatcaaagttccctccacgacagatatgatggaaatcaaaatgcacatacctgtagataaagtgaacatcagcataaaatgataattttatatacatgctaatcctgttaatcccagaaagatattttatcacttttataatcacaaatcaatagaaggatatcttatgattttcacgaaacatcaagcacctgatgttaggaatcctctccatttcagcagcaaatgcattgcttaaatttccttcatctccttgctgaaaccaaacaaacctagttagatgaactgtcttctgtcctcgataacctaaaataaataatttactagatctagattaatgtatatgcactaccaactgatgagaaaacatgaggcacgacacctcaagccaaagtgtgcaatacccaatatgtttattaagcttcatataagttggattatacaggattgaaattggtttgttgcactttatttttcatggaaaaaggtcatttacacaatttacttatccatatttttttaaaaaaaagtgtgaaatttcttcaaggcaaacatatttccttttgaatgttcatttcactaatttctagattggaaattaagcaaatagagaacagaatatcatagcacacaaggttcagctatttctaaccaagcaaagagactacatggatacaagttcatgtaatttagctcatactgtgaacacagcactaaatcatcaatcgtcataccgtcgacaactaagtttgataaacttcacagttgcattacagtgttcagttattactatattagataaactaatatttcaacatcaacatgagcacaggacttaccttatctgtcaaatcaacaacaactgtgtccccatatctttgtgaaagatcatgaaagtggcgttggacaaccttcggctgtaagcagtacaagtttgtaagagatctacagataatcagtgtgaaaggtcatttaagaggtatcaaactaaaaggcagtaaattcctaccgtttcctcatgttcaattatgttgagacatggtttgtagcttaaatccactatttgctcccagagaagtggaatggagcctcgaacctaacaagggagtgaataagattgtgaggcactggaaatgggacaacatcaaactaaatgacactccaaacttgtacacattccttaaagggctataaacgatatacaccacaattatgcataacacaaatgaaagtaactgtaagatattatatgaagcctataatatttgaatgaggataagaaattatgtaacattggattacagggggaggagagtctatcttattcttgttcatattgaacaatatgaatttatgaccaattttatcacattgaacaccacaattattttgttgatatagattgatgacattctttctttgggaatcaacttgatagtatgtataaaaaatatgaataccaacatacaatctagcactgatatccattgaatctatttctatattaataattaagatctcttgtcaataatccatgatcatccagcaacaagaaatttcatttgtagtatcaagaagccacctgtataaatgaagacatcaaaccttcatactctgccagctgttctgtctcaacaaaattagctgtggctccttcaagatttgcacctctcctccacattcttgttcctgcgttgaatgcacgtaaatgcaatacaagttggaaaagcatcattatgtttgtataaagtaactcatactacaactttccaattgaaacatcacaggtgagaaaaaagtacaacctagacgcctgttgcatctacgtgagaacaacgttattctgacaggtgcctcctttaaggaaaattgcgctgtctgaaaacgttaaatagtcaaggatatagcaaattgctaaagcatgtttctctgctgatgattgaaaaacaatgagcactgtatcacacattttcaacaactaaacacagataatccgtatatcctatactgtcctcctgggtaccaaaagtccaaaacagagaaaccgatgttacatgtaaaaggtaaatgctcaatacacaccagtgaaaagtagagataagaataaaaaaataagcagtgaaaatatctgagattttggatatttccttggaccagtgggatgataaattcatcaagctgcaaaaagaaaaaagggagaaaaataagcaaagatgtaaaaaaggaaataaataaataaatgttttaatttagtcaaacatgattacttttgcttcaataaactcctctagcaaatttttgttccaaacgaaacgtgggtcagcctgaaatataaacttaaagaactgtcaggaaacagagtaaagatgaatgattataagtaacataaccaaaaaaaaaaactagtatagttttctgacttagcatgtctccaattattatgctcactgtggctgttgcaagtcaagcttcaaacagtacagtgcaatcgagcatacataatgatagataaagtctctgtattaaatgcatcagcagtcaggtctgtgtgcagaagctgctctaacaaatgcacacatcccgttcatcaaatccttttgtataattaagaaatgtataaagtaatggtagttagaacagatatagctagcacttaacagtataccaaaatcagctcaatcaagaatcaataaaattcacaatgccaacagaacagattaaatgataaaagtagttgttccctctcttcctttttgactgacaattaagaatccatgaggtcaaacattctaaatttacctcctcttaaaactatcaaagttggatgtatgagaactacatcagtaaattcatcattaagaatacttccatagcattataggatttataaactctaacgacaatatatttacaaaaagtaatgctcaaagatattctttttctcaagcatggacaggagaaaattacacctgaaaagtaatggtcaaaattgcatctgatttgtttagatgttacatctccacatcccaagtccttacacagttcaggctttgcatttttgttacattttgcaacacaagatttcagccatttatatgagttcagttaatcagacttacaaatgcaaaaaacaatgcaagtttaattggaaagagtattataaataacttaagagaacaaccataaagattttctcaaagataacagccataatgactcaaatacccaggaaaatagtatgtactaaattatggagtgaatcatcactaacctgtttccagagtggcttatgtacccgcccagcaggcaactttgatgccctctgcaagctacgaagtaataactcataagacagaaaataactagtgacaaagtttattgcaaggatgtgaacagatagatattttagttgacctatccacagtcatgcataacttgatacttacttcagtgtcaaatccctgtcataagagtaataaagcccatgagtagtttctgcgattttcaggagagacatgaaatatgcctcatcccttttctgcaataagatggcatacacaaattatgatactgtgaccaaaaataccagataaagataaacaatgcccaaacaatgtggataaaattggatgctaactactcaattttgtcatacttcttgtgcagttaaatgctttatagcctcgttgcagcataagaatttcatcgagttcacattgtaaacaggggatccctgatatgaaccagcgtccctttgagaagtgatgacaagtacatagcttcctgataaaaaaaaagggaaagtggaaagcctgctgcataaaattataatttccaaaaaaaaaaggacagaaaattagcaattataacatggagaactttacaaaaagacataaggaaatcattttcctttatcaaatacttccaagcgaaaaatatttccagatttttatctaccagatataagtttgattatcttcagcagtgcaatgtatgctcaattattgagcaaatggattttgtatgctgcactgtcatactctcagcaaaacagtaattagttgcactgtaaaagtgagtatttggattttattttttgttggaccaataaattttctaataatccttttttatatttttcctgacaatgtggaattagtatgtataataaaaactacattcaagtgtaaaacctagaatgaatctaattgaaatgcagaagtttcccagcatacagttagtgctaggcaaatatctaaatttgaagacaccaacaagtattagtaattaattaccgaataggaggttcaagtgtcagaccatgtgattttgtatggtggaactttcattagcacgatgtaatttaaactgaaattgcttgtcaagcactgggtgaataaacttgagttaaacagtaatgattaatataagtacatggctaaatggagggaaaacaagcacatctaagcaaacaatcatcatccatatgtttctccctatgaggaaaatatgagtacagcaagataaatcagttccatgtgcaaatttagatcagatcactattgtgcaggcaaaaactacaaacgaagctatccaaatcgtacgtgagaaaaaccacaagctatatagaaatggtgactcaccggcgagcaacctgatcacgccagccactccgtaaatcttcgacaccctacaatcgcttcccgcagccgcttcctctgcacgcgaacaaatgcacaggttagtaaaaccaccatcggttcacgagcccagcactcaaaccaaccaacaaaaccggaacatagccgcgatttgttttcccctttgctttgcacggaacgattccggcggcggcgcgcttcacggtgaggggaggagtagtaagtggtaacctgcggagagggggcggagggagccgttggagcgggagacggcgaaggcgccgccgccgtcgaccgagcggatcacgtagcggtcgcggaactcccgcagctcgagctcgcggctgcaggcgccggggcggaggggctcctcggcgagcagcggcgcctcgtcggcggcatccgtcgccatcggcggcgaggcgcgtggcgtgtgtgtgtgcgcgctcggtttacgtttggatcggtggcccggccccccggatccgtgacgggagaaggaaaaggggaacgagaaatggctgattgcacgtggtcccttgggtttatttggtgggggctcagatcagttggggatcggggtgggagggacccgcagcaggtttacattacagtcagtattaccgtgcttaccgcgggtacggtaatataaatatcatggtaatcttcttacatttaaataaatttaaaaaataatttgattttttgataaattttatacggttttttcacagttactgcgcggtaaccgtgcttaccgtcgaggcgcggtaaccccggccccggcggtttgggaaccccgcagactgcaatgtttcatgtcttacacttccgtccccaggctcatcaataatcgtctaatttggacaggtttcattcaaaaatttaaaagagacggaaatgagcagcacattcctaatctcaaataatcgtgttgaatagcggtagagctgcctgcatcgtgggtagaactacggatatgtggtgtatatgagaacatcggtgacaatatttagggtaagcggagtaggagacgaagtagctaagatgagaagaggtgataaggccgttaaactcatccagtaatagagatggcctcgaaggttatctcattggatgtagcagtatatgaggaggatcaactaagaatggtagaggcggtatcacttagagtttagggaagaaaaatataactaagaaagaaggtggatagctgatttttattggttgtgtgaacattacatagcactttgatatgattttgaggttatttggccaatatcatgttaggttctacgcacatattaaagtgtgattagttttgtgttgttaaaaagaattgagtccatttaatctatgcagtgctattgtctactttgaattaattcccgactatctcatctcacatcaaacatgcattattaccacagaattttgtttcgtctatatattgagaataaggtattgtttgatcgagagccacacttctgaccaccgaattagtatagtattttgttgttgctataattatggtgtgccacacttttcaaggaattggagccatttgtcatgtcttattttcataccacagctcaccgcaatgtgtggtttgtcatcacacttggcaaaactttccgagcatatataagctagataaccaggtctatttcaagcatgcatccagtcatccatcctctgattatcacatttgcaaaccatgattcagtgatacacacagataaatatagtggttgattttgtttagctatagtgctatactactagtccgatgaggtgttatcattcaaaggctcaaaacacaataataacgaaagaaacacgatattttgtaatgggattgaaattaacatacttccaccatcccaaaacatttgttattctatattatttagcataaattaagatttaagaaaaaatattatattatcccttaataaatattatgtagttgaaagttaaggataatcatgggtagatttgggataaatttaactgaaagatgattgatttaacatgtactccgtattaaagtttgtagcgacaactattttaagacaaaatttgaatactaaaatgacaactattgtagaatggaggtagtacatccccaacatcagctctctctctctctccttcacattattatgggagcaatgagcacttaataaaaccgtgacactgaaaatcgcacttaccaatgttcttgtgctctcgagaaatcatcagttggtattgaattttttatttattcaaatattttttaaaaaaattcaaagtattacatatccatccactaatgttcctggggaggacgatttttatgacatggcacatggttgttagctcgtactaacggctacgcgaaggagggttggctattttttaggtagcccccttgcaaccttccacgtgacaattatcatgcgctaacatctatatgccatttcagtaaaaaaaaaaacatctatatgccatgctataaaagatgtactcggatgagtttcttttagtatgtattactttgaaaaaaaatattttgctcctttctcgcaggccaggaaggcctcgtcgcatggtcgatggccctgctgtgcaggctcctttcgtgtcatcgtgtgccggttgacgaaccgagtaggaaaggaaaaagtacaccggaggtccctcaacttgtcatcgagttacgtaatcgtccccaaaccgcaaaaccggatatttgatatctctcaacttacaaaaccgttcactttaggtccttcggcgattttgaacccggttttatccgacgtgacggctgattcagcgtgggacccacttgggcctcacatgtcaggctgccacatcacaccccccctctctctctttcccctcctctcccttcctcttcttcctcctctctctctcaattttctcctcaacggaaagccagccagcgggtggggagagggtcgtcggggcaaggcgggagaggaggtccggcggcgggcgacgaggcggtggaggcggggccgggcgacgctgcggtgggcgtcgacgggcgccgcggcggggggcgacgaggcggtggaggcggagccgggcgacgcggtggtgggcgttgacgggcgccgctgcgggggacgacgagtcggcgtaggcagggccgggcgacgcagcggtgggcgtcgatgggcgccgcggtgggcattgcggtggtggacgcagagacaaaggcgggcccgggcgctgcggcggtgagtgcagaggcgggcaccgcggcggttggcacagaggcgtgcgtcgcagcggtggatgcggaggcgggcgccgcggcgattggcacggaggcgcgtgtcgcagcgatgggtgtggaggcggcctggctatggggacgactgcttccccgttttcttcaccaagaccaagtgcacgtcggcgccgacgtggtcctagcactcctcgatgggttcctcttcgccgctgcaccgacgggctttgcttcgacccttcgctcctccacgctcggccgccgcgtcctcgaccttggtggctcacggcgtggccggtggtcagcaggggagaagaacggcggcggcgttcggtggtgaagacgggctgaggtcggggagaccggaggccgccgccgccgccgtgctccccctgtcctcttcgatctccccccgtgctcccgccgctgccacccttcccttctcccgcgtcgccggccgccggacatcctctccagccttgccctggcgaccgtctccccacccgccggccggctgcccattgaggtgaaaagtgagagagaaaggaggaagggagaggaggggagagagagagggggtgtgacgtggcagcctgacaagtggggcccacgtgggttccacgctgactcagtcgccccgtcggctaaaaccgggataaaaaccaccgaaggatctgaacgattgagggatgttatatatccggttttgcggtttggggacgattttgtaactcgatgacaagttgagggaccttcggtgtactttttccgagtaggaaacggacgattgtgacatccacggaaatccgtggaattcggccatggcccataggtggtgggctgtactgctgtggccattcgacgctgggctgtggcctatgggtgtcccgtcccgcgcgcaccgacaggcgcggccccagcccataggtgttcgagagcctttcgctgttgggcttttccgcactgctggaaccagttcttgacagtggacttgtaggaaagaggatcagtcgaactcgactccgtacttgactgcttctgattgaagctttggttcttaactattccatggataaacaggatcggctctgtttaaacactcgcgttcatgcattactcaagaatttgatggtgatttatctgtgggtgagggtaactatatactccctccgtcaaaaaaaacttaacttctagagtccaatttatcttcagcacataaaacgagaagttatatcccttaaatatcatttacctacctatcactattactacattttctattgatgagggttatttgggtcatttttactccccactaaatttgccttgggatgttaggaatctttttttttaggacagagggagtacgagttattgatagaaatagatggactcatagaatgagtgctttcgtcactttgttccatttccacccaagtacgggaaatgagaggccatgctaactctcagttttaattccttgttttgttctttgataaggtatcggataataaatctacaaagaaaagaaaatactacttgcctcactatcaaactggtgtccatatatggagttggaatctgggtttaaagaagggaaggggcggaggaaagatggccaatctttttttttctttttactgtcatagtgaattggcgcccttctgcaagaaaggcacgtaaatccttatcacctttgcaaaaaatgtgaatgttctgtcttcctcagggagtataaatttggagaccaaaaggaggctggttgacgaagtcataaaggagtctcactccggtgctttttacttggaagtgctttctacttggagtagaaagtaatttggatcgttgatctcatttaatccaaggtttcagatttatttctactaccacctcacttaagggtagtaaaatcatggagggtattattgtctatgaaaaaaatatttgcggaagggtacaatcatcttttacattcactaaccctagccgggctctttcctccgtcatttgttcctcacgccgctgcccgaagagaagtcccaaatcgcatccggcgccgacgccgagcgaccccgcctcgtggctcctcccttcccccgccattgccgcctcagccgaccttgccggctccaacgtcctcgcctcgtccgccgccctcacctctttaccagaaaatactagtatcctacaactcacaactgaattgtgaactagtatattgaaaaatttatagtaattccattacagctaacaaatgtgttctgttgagtaccctgatgaagtccactccctcgtgtcgtaggcaagcctcacagcattgttacctcttatctggcatccatttcctgcaccgtgcatgttgtttggagttgagtttactcatgttattattgaaattggatacaggatgatatcctataactccgatgcctctgcaacgcatctccggatcaactttcgggtaaacagctacttatcttacctgtggcctgactaacattagttgctcataatattttctatcttatcttacaattattgctgtgaagcactcctatttgtttagtttcttgagggaggctcgaagctgtttctaatcttatcaagactagagaagaaaggagaataaccagatgccaatgcgaggctcaaggagtgttgtcccatattacctctgactttaattgtactattttacaagtcatatttttatgtgacctcaactgtgcttacatgtttattgatccaatgcctctctgacttctttgatgttggctcgaaactgggataaggttgtaattttgcacataggaaaacctaggaccttgaattgtatagttttaaaatcatgtttttatctgatctcaactatgcttacatgttctggtgcccttgtgacgtcatgttcggtgaatgagtgcaagtgctatctatacagttgctccgtgtgcatgtgtaaatgtcaatggttccacaaaacagttgatcagtaaaaaagcagctctttctgagattggacgatgtcaccccaatgacctatcggtagtgtactacacatggtccaattttgaacaggataatggtaatgttttgagtgttgctaacgccagatggtctttagaaaaagggaaattttgctataggatacttgttatgtgtggttttagctctatgacactgcccaaactcatttttgggggaaaacactccatacttttgggggaaaacattccataaacatggtaatttgccagtggacaccgcgacgattaaaataatactttccggttggggaggagagagaaatcgcgtgaaatgtcaaaaataccattgggcccacatgtcaggtctatctcctatctctctcctcatctctctcttttctctcgcgcagccagccggcgactcttcccagcgcgtcgcagccagccaggtcctcccctcgtcgcggccggtcgacgagcatctcgtccggcgtgcaccatagccggtcatgtcctccccgtgtgcgtggctgccgacgagctttttctccgtagccggccatccttccacaagtcggtccctccccctgtcttgctcgcgcggctgcccatgagcttctcct

SEQ ID NO: 70174 - DNA, 875 bp, Oryza sativa
ttcctgcagcccgtggcaaatagttaaataactccatattggaaggacaatgggcggcggacaggaacgatggaggattcgtcagagatgtggtgggctggtggttacggagcaaggagtagagatgtgatgaggcagagggagtagagaaggtttctgcttttatatttttcatgagatagacatgtagggtccacgtaggtcccacactaacttgccgagttgactgcagtcaactcatcatatcaaccaaaattagacacaatgctactctgggatctcgggtactccgatattacaaattgagaaacatgttatatctagtattgcagttgaaggatacaatttgaagtcttgaagtcaagataagggaccttatgtgaacttattgcagacatgttatatctgtcactatgtcgtcaagtctgaaattcatccctgaaccgcaataccagatatgacgtgtcccctcaactcccaatcagtgcaaataagatcccaaggctgtttggatgacgtttttttgctgacgtggcacttaaagttggatgggaccaacatgtcagtgagttcggtgggacccacatcatcaccacctctttcccctcttcactccctttttctctccctttcatcatcgtcatggagcccaaagaaggacgaggcgttgcagcggcaagtggcgaagcacgggggcatgtgactggtcgctcatcagcaagtccatcccggggaggtccggcaagtcgtggcacatccggtggtgcaaccagctgtcaccatgggtagagcaccaccccttcacgcccgaggaggatgacaccatcctccacacccacgcctgcttcaacaaacaagtgggccaccatcgtcaa

SEQ ID NO: 70175 - DNA, 58218 bp, Oryza sativa
tcgccgccgccgcctccgcgccgaggccgccgccctcagccgctgccccgcctgcccgagtgctcgaccgtgagagagagaagaagagtgagaagagtgaggagagtgagagagaagagcgtatgacatgtaggccccatattttttaaatatagaatgctgactggactgccacgcgtacgccacgtagaccaaaaccaccgcggattgggtcgaggggggtaattcgttcggtttgtatagttcaggtgaaaaatgtccggttttgtggttcagggagataattcagacgaccgcgatagttccccggggagggggggtaatttatactttttccttttcacttaacaccacatatttctacacttgatttcactttgggtggggtctattatttgggccagcccatccatgaggaaggaggcacgagctaccgtctgcgactcagccgtcgccgctgatctctacacaaccttgctatttctatcacatccccgtcaatgggagatcaattttctctcaccacctcaatgaccttgctctcggaggctggtctggccggagctgttcttttctccctgcacgcactcgctcttggtcatgatgcacgaagaacacctcccaagctttgcacccgcacggcaggaccctgaatcttgcagaaactccatttttgcttgcggcaactccgactgggcaagacctccggtgttggagaagagaatcaaagtattgcttgcttgcatgaatgggccaaagccagcaaagcaccccaaatcgccaatcctagtccaaagtgcaatcaaatgtaaaaacatgtggtgttaagtgaaaaacttgagtgggacctggtccaatgtaaaacttgggtaaaaaaaacctagcccaatgtgaaatttactctagaatgtttaaggaaaaaatcaaagttaaccccctaaaatgttatggttgtcctgcaacccctcaagtatgaaactaggtattctaccctctaaaatatgaaaaccagttcaaataagtgcaaatagtggttttataaatggttggcttacatggacactgtgacatgccgatgtattcggttaaataacattttaattattgggacggttggaaaagaagcacattagtgcttataaagtgattcttgggcctgctgattggagagagaaaaggagtggttgggttgggttgggttgggtaattttgccctattgtgcttgccgtgtcatcttgtacacagcaaaatcactacaaaaccattccaagtggttatttcaaacaactttcatacctttgagggtgaatacccgtacttaaggggattaacagacggaccaaagtgctttaggcagtttagtagacttctcttgtttacagaagagttttttgctattttgttaaaatcgtattgtggcctttttacctcctgcaacatgttcttattcattcaaacagttcataagctgttttttttctttatttgcttattcagaagcatatttgaacacaacgagaaaaaatctatacaatggagtgttggtgctgtaagtcctcctctgtcctcctcttttattttccttctaaaaatcccctcattgtgacattggtatccgttttttttacaccaaacacatctaatattactttcttaccacttgtcaggtggtaccatttattgggtttgcagtcgcaatgttcatgttttactctctagttccaattttactgaaggtatattagcaaacaatgtttcctttgtgcaagtgtgtatctactaatttccttagtcatgatttctcagttcttacatcccaagtttacctactgttccttgtccatctccttaaaaatggaaaaaaaaaagaaaaccgacaaaagggatattgttgtactacgaaatggcactgccacattaagcacatggtttttgctctttaagtttctcatatctatattaacttgtgcagatcagtggttcaacaatgctaaacctttcattgctagcctcagacatgtgggctattctcatccgtgtgtttgcctaccatgaaaaggtctgatcatcgggccctcaatctgcaattctgcataaagcatactgcagtttattgtcttacatgtaaccagcaattgaatgcactttcgctttccaggtcgactggatgtactatgtggcattcggtgtagttgcaattgggctggttatttactcagggtactcacctgttttactttctgttatccttctccatgaaaaaactcaatactctagctttattagttgcaagacaccattctgaagtttgacgttaatcattggaacattaattacatgtttttaatcaagctgtaattttgtaattagcggttattcgtcctgcaaactttataatgagcgactgaaaaataaaggcaggaataaattccactatctaaaaaaatccatcttctaaattagaccatcacagctgttctttctgttcactaatgctgacatgtcgatgcagcgattcgaacagcgacgatggcagaagtgggcaagttgctgaggccactgatgttgagggaaagctacctgatgaggaggaggctgctgttcatccaaaatgccagggtgcagcatcatctttttttagataatggaataaataaatatcccggcctttacttaaaagagctacagccaattattacatagaagcgtttgacgaacatagtgtagatctaattgaatagaacacaccgcaagcaacaataaagaatccagtctaacaaaggagattacaattattcaagtctatttgtaaatctccacccataattggcaaaaagttgcataaccgtagtctccagcttccgacatgcaactttcagaaactcttcatcatcttcacacctttatagttgtgcccaaaaccgaagccaatgggttgctctgaaaatgacctgcatataggaaaatgatggtgatttgtcaaaaactatattgttcctactcagccatattgcccaataaatggcagaagctccaacaagtatcagtttactcattttcttatcaactcccaaaagccacccatcaaaaatatgagatacgctaactggaagattaaatccaaaagaaaactgaactgctctccacagaaacttcgccaaatgacaatcgaaaaagagatgttgaatagactcattcttcaaacaaaacgaacacctcaagctaccattccaattacgccttgccaagttatccttagttaacacaacccctttaagcaagtaccacataaaaattttaatcttaagtggcatcttaagcttccaaatgcacttattcctgtcaatataaccattattaattaaagctaggtacatagacctcaccgagaacaacccattctgatggaaattccatctaaaagtatcagacgaatcattcaattgaatatgtactatagaggaacataactcatgccaacaatcaagattctgaccaactaaagctcttctgaaagaaacattaagtggaacagaacccattacagtagcaatagaagatgttttcctacgaacaattgcgtacaaagatggatacttgtccttaaaagcccagttacctagccacttgtcctcccaaaatctaatttgttccccattattgacaatccaagaacccatatttaagaaggtacttttgacattcataagaccagaccaaaaatgggaatcaccttgtttcttgtcaacttgggttatagacttattataaagatatttcctcttcaataagtcatgccaaatcccttcctcattaattaacttaaacaaccatttacttaaaagacatttattttgtacctccagattatgaatcccaagacccccctggtccttgggttgacagacaacatcccacctagtgagcctgtattttttcttatgatcatctccttgccaaaagaatcgcgatctataaaaatcaattttatgaagaacccctttcggcacctcaaaaaagatatcataaacatggctaaacttgaaagaactgaattaatcaacaccaatctacccccaaccgataaatgcttgcctttccaactactaagctttttctctattctctcttcaataagtttccaatctttattagaaagctttctaaaatgcatcggaattccaaggtatttaaaagggaaagcacctaacttacaaccaaaaatgtccgaatattgctcataacactccttagcctgaccaaaacaaaataattcactcttgtgaaaatttatttttaggccagatagcttttcaaagaccgataaaatcagtttcaaattctttgcctgttgtaagtcgtgctccaaaaagatgattgtatcgtctgcgtattgcaaaatggacaaaccatcatcaacaagatgcggaattaccccattcaaaagaccagcctctttagccctcttaatcaataaagtgagcatgtcagctactatattaaaaagaataggagataaagggtcccctttcctaagacctttgaaagtttgaaaacaattaccaatttgatcattaacttttataccaacatgcccaccttgaacaaaagatgctatccactcacaccatctaggagaaaagcctttcattctcaaagtttgttgtagaaaagaccatttaactttgtcataagctttctcaaaatcgatcttaaaaattacaccacttttatctttgcgatgtaattcatgcaaagtctcatgtaaaataaccactccttccataatattcctcccaggaatgaacgctgtttgagtaggactaattaccttttgagcaaaatccattaatctatttgtagcaactttggtaaaaatcttaaagctgacattaagtaggcatataggtctatactgttgaatcttcatggcctcagcacacttaggcaaaagaataatagtaccaaagttaagtgaatataaaggcaaactcccagaatgaaaatccttaaaaagttgtaaaaagtcaaatttaattacattccagaacacttggtaaaactcagcaggaaatccatctggacctggagttttgttatgttccatttggaaaatagcctccttaatctcattttcagaaaattccttagttaaagcttcattctccaaatgtgaaacttgaggaatgccagcaatataattatcatcaaactgaagatcagattcattaggagggccaaaaagacctttataataagtggtaatatgcgactttaaattggcatcacctcttattaattgatcaccatcctgtaattgataaattctagttttcctgtgttttccatttgccattaaatgaaaatactttgtattagagtcaccgtccataatatccttagtcttagcccgctgataccatttaatttcttcttcccttaagatcgcagataacctattccttaaaaaccatctaagatcaacctcctcttgagacaaaacaacagtctcagcctttttatctagcgcatccaacttatttaagatctgctttttctcttttttgcataaaccactagtgtgtttagcccagcccctaagatgttgtcttaagcggcgaatttttgcctgccaacgctccataggagtattgccttcatcaacccagaccaaacctcctttaccatatccacaaaaccatcacgtaacagccaaccaagttcaaactgaaaacaatgttgagcgtcactaaaagaggaagattttgtatttagaagcaaaggaacgtgatctgataaatctctgtttagagcaacaacagaagataaaggatacttttgctcccattccgttgatactaacactctatccaatttctcataggttgggtttgctagattatttgcccaagtaaagttcctaccagacaactgtatctccctaaggcacaacccatcaataacagcattaaacaaaaagggccatctatcatcataattgttattactcttatcattaggactacgaagaatattaaaatcaccaccaataagaattggtatagtctcatgactgcacatgttaactaattcttcaaggaattgatctttaagctcattctgtgcaggcccatacaccaaaactaaagcccatttaaaattatcagccttatttcgtaaatgaaatttgatataaaaatccccctcatcaatcaaaccaatgtcaaaatttagaagattaattcctaaaagaagaccaccagatctgcctctaggagatttacagtgccacaaaaaatctttactaacacaaagattattcagagcagatgtagaaaattccttcttaaccgtctcagataaaacaataaaatcaagttgatgttctttggttaaatcagaaacaaacttatgtttttttcgggtccttgaacccgtcacaattccaaaaaaacttctcccactattagacctaacgagccacatgctcaaacatgaaagtaactatggactacagaatatagaggaaacagaaaaaaatccaacaaggagagattttgttaacgcggataattatgtttgtcttttaggaaatggcccatatcatgccctcagcaacgaggagctgagctgagaattatctcgggaatgactaggaaataggattatagaatcatagtattggaataaacatgtgtggtaggtcagcatattcatgcaatttgctgtaatgtaattttgcgatgtattcttttatcttttctttgatgcttctaaaggaagctccagttagtcagagtatttgagtgcaaaatgttgtattggggaaattctctgccatgtaactgggtaccgaagatttgatgtatcaggtgataaacaagcatattattatgatttttctcattttatttcttcatacttgaagactgaaagcatagaagagcaaactgtttctttaacggccataactttagagggctgcataaccaaattgccacacatatgaaccttacataggtgaagtgttcatttcctataaattttctttttttaaaaaaatgaccataaggttggcatttataaattgcagcatgagcaaactagaggtttctcaatcgttgataggaacatcatgtaatttgtggcatgacagactaattatcggtcagccagacagatcgcaatagcaacagggtaggaggtgattatctccaccttgaactgaaattccaaacatcacacatgttttcagtaacacacaattgtgttgaacgaaaccgaacaagacttaaaaaagaaagattacaatatactacaataaattgttggatccaataaaattatgactggacagtacacttgctatcatccgtgtgcgtggtagcttgagaaggagctatggtgtgcatcgaaggcggacgatgaacaagagtgaagctttctcccacatcagccgacccatagatttttcgcttgatgtagactgctatcctactatggcctcggctgtatgggaattacttcacaaacatgcagatatcatgctcttgaatagctcatgtagttacagcatgattcacttgcagcatctccaggattagtcttccatatagttcatagatcatacaacctacaaggtttcaatgaatggaaatagttgaggtcaattaatgtataacatctacagaaactatggagaaatggaaaaaatatatatacatgaaacaaggatgtgcaaatgccaagaacaacctaggaactaggaaaaatgaaatgcagcattgtgcaaatgatgagacaggaaccagcaacaagaaaataatctcagaagttaatccagctgagtcaaataatctcacagtttggaatgcaaataagtaaatcaatttgcaacttaaagaaatatatcatttagaaatactatacattggaaacaagcatcacatcacgatgtataactgttaaaatgacaattcttatctgccaaacaaaatgctaccttgagtgtatggcattttacatcttataggaactaagcaagcagggaatcataacaaaaaattacaaataatgatgtatgatcatgggtttatacctcagatcttaatatgactccaccacagaagtgtttatacctcagatcttaatgatcttggcagccctgatcacaggattcgcgcgggcaatctcctccctgcccgcggttttataatcgaaggagcactcatgggtctcggaatgccggtggcgaggacagaagagctccccgcagcggcaccggaatccggtcaaaccgaccctcttgcggcacacgttgcaccggttaacaaacagcaccggagataatggctcggctaccgccgccacgaccacggcattagcatcggtggcggtggcttcggctagtttcctcttcttggaaacctctatgagaataccttcgcagttcttggctgagaattgaggagctgctgctgccgatgccgctgctgctgctgccggtggtgttggtggtgtcgattgcggaggcggtggttctgtcatttgtgctgttggtggcgatggggaggctgtggttggggaaggagaaggtgaggatgatgatgatggcttcaagatctcagcctcgtccttgttgagatcacagctctcctgcgccatcggatttaacgcggacgaacaaatcaagggaagtggaggcgaatcccaagcttggacaaccagatcaggacgaattgggcgtaggaacagcaagaaatggagtttgttgaggtaaataaaaggttcggaaatgggaaatcaatggctttttttttattccttgatcgaatcggtgcaggccttagacccaaaaccaaagaggaaaacgagatctacgcaggtagaaatcagagaaatattattcggaaaaaagaagggtaaaaattctagcttttcctgcaccaaatcaaacgtggaaatgaacagaaaatcgggctgaaatgtttacagagtaggaattttcccccctgatttaaacgcaagaacaaaaacacaaaatctacaacacgcaatcgagccaggagaagagaacacgcgcagatcagggggaaaaaacccaaaaaaaaaaaggacgaccttttcagctcataccaaacgcaccgaaccacggatttctccccaccgcccaaataaacccaaatcgaaaccgcgggagatggatcgccgccgcgccgcgccgcgccggctaagctgccggcgagggatcgaatttcgaaggagagaccaaagaacaagaaccaaaggattggggaaggaagaatccgaagaagaagaaaagctccgaaacaaatcggcgggaggggggctcccccggcggccgcgtggaatcgacaccgaatccgggcagattcgacggatcgcgccgcgggagagcgccgaattggggacggaattgggcgaggaggcgagcgcaggagggaggaggaagggaaaggtgggagctttgggtggaggaggagagagaccgaggtgcgtctctgttgaggtcccgaaaggccaaagggaagggaggtagtggagaaaagtatttatttactcctcctctatacttatctatctatagtttattctttttttctattattttgttttattttatttttatttgtgtgaaagggttttgtgtgtgtggattttgggtgtcacacgacgccatctttttttattagttttttttttcttatggctcacctcacctgctgtttctccctagcttcttttaatgaccacatgtgttttactaccaacgagaatgggggatgtatactggtggtagtagtactagtctattgtagctgtatctttcattcttttctactcctagctggagaaaatctggtcaggctggctgctggtggagtttgtgctccttggagggaagtaacgcatataggattccaattaaaaaaatacttatcgcatttggagaatttggctcattttatagggaaagaaatcaggaattttgtaagagttagttcaatacctacgaaaatccctcaaaatcacgttattatatcaaagtattccggatgagtccatgggtcggacgcccgatcggtttagagaaaaatcgagcgctgatggcagcacgacatcagcgcccgatttacatgcaaaactattttaaactgatttttctcttaaattacttatccaaatcataatccgattgcaccattaaaattcgttgcaactaaatctttaaaacaagaccacacatgaatatattccgacgaaaatttttttagcttactattgaatttttttaaaatgttgcacgatgttccaccaggtatatcggaattgtttcactaagtagattaaaaatgtttcacttgtttaatcgggtgttgtttcaccttatataaaaacaatatttcagcaaatagcgaaagaatgtttcagttcactgcaacatttgatctatacatagtgaaacattataagtacactaggtgaaacatcttttatggaacaaggggagggacaagtaggtgggtccagcatggtgcgcgcgtggggggagggggagcgactgattttcccacctctccccggtcgaccgatagagagcattttcgtagtattcctctattgctcgaagaaggtatattaatattttagagagtattgttgttccatggtgtacctttcgaagtctacatggtttgcgctgttcttttctgataaagattcagattttatcttagtttcgttagcacgtttttgaaactactaaatggtgtattttgtgtaaaaactttctatatagaaattactttaaaatatcaaatatatcaatttatcaagtttgtaataattaaaatttaattattcatgtgtcaatatctttctcattttacgtgtgctaacttaatttgcatcttcatcagttttgaatactagttttgcaaaagtctaaatgttttttttataaaatggttgtcatctgttccttgtgttttaaatagtctttttttctttcatttatgttgcttttagttatgttgtctttgtaacaaagaaaagaaatatgcattccacctattggattttcattttcttttagaaactgaagtattgtaaactgatgcaaatttcatataaaatatgacgcattaaaggcatttcacatgttttccctacctttctattgtttacattgttatcatgtttggacatgctgcatacattatgttctcctcataggctgcgttcgttagcatgggttgggaacacataaaacaaagcatctgtttaatgcatgattaattaagtattaggtaaaaaacttgaaaaggggattaatattattttttaaagcaactttttagattttttttttgcaaaaaaataccctttatcagtttaaaaagtgtgtgcgtggagcacgagggatgtgagttgggaaagttggggaaagaactcagccttaatattactcgaaaaattctggcggccaggattttttttcatctggacaaacactttgacttttcatttctcaaacaatcatggcctttttacgtttatcattgactttgctaggctatgttagggagctggagattacaagaagccgctataaacaagcatccaactagtggtaatatgttgaagctctaggttccctagcctctagctattagctcattactggatcctagaactatcgggtttcacaatctaaagagaggattcagattgttattttagggtagttgtagctactcaaaacaccctcccaaataaacatgcatcaacttggtgaccacaattccacaactgtagtcgtttccagtgacatgctctttcaacgatttcatacaaaatagttgcatatcgagtttggttcgttttgatcatcaaagagatctatctgtatgtttgagaaatgcacttggccaaaatggattttcaccatcataatatatcctgaaactcagcataatatattgcattgttttgaggttaaaatgtgatactaaataatttcaagttcacagtaccaaattatgatccattgctgtagagaatcatgtcctataggatagagagagtttaaagttaccaatatatcataagaataagaacaagaatataagaataacagagtaggttagttatgatgcttgtctctacttcagtgcgtcagtgcccatctaaaattgtccctaaatgagtgcttctagagatggccttttatacaaactaggaaggtagatttgaaaaacctataaaggtggtatagcagcgaaataatatctgcaacgtttcaaaattgtgttttttttcatgaattttcttcattagaattgcatgacgaattataaaattacctattagagattagggttgataacttacggtataaaaaatggtacctaagacatatgactcttgaggttccatagggaaagagagaaaacataagttataaaagacattacatatacaaccatatataattaatggctctacccattttttataaaaaatgataattaatttattatttgatggcaaacatcgattggtcatagctatggataattcttcataggaaattatgagtttcataggaaaagagagaaaacttaagttataaaagacattacatacacaacaatatataattaatggctctactgatttatattgaaaaattgataattaatttattaaacaaaatatatgaccctcaattttagaccattatttctaaccattggatatgtagatgatctaacatattgtgcagagtcaaactaaccaaattattcgtctttcctcaccacggacggtggacatgttaattcgtgcctccggcaacatgctcgcatcaccatacttagaagaaaaaaaagtgccctgcatgtatatgcataatacatgtaactatctcatgccccttttttcatctgagaaaaaatattatatacccatgcatgcacaccgggatgcaccagccagccctccaatttgttcactccatggacattatgttcctttgttctagtgattagataatttaataaggataataagtatctaaaatcaatttttattagtaaaatatccataaggacagctctgtagacaccatctctccttcttcttttcttggtgtattagttggatttgagcaacgtgatataggtattttgggctataagttaatgtccaacttccaagggattaaggtttcccaaccttcagcgccgaacacagcataagatcgttcatttatccttaaaaaaagatcatatcttttatcaaggcattgggattaagtaaatagcatccacataaacgttgagagatataattaagttggttatgagtcaataggtccattgatgctataattaaagttaaggttaatggtttataggttattttgattttattaaaaaaataaggtggatattttgatttttaatgataacttttaggatttttttttggtatggatgtgggtccaaaatataataattttataagcaattaaatatagttggtatagatattaaactattgatttaattaaaaaatacaatggttcaaacagatcataaattgaatatataatttaaaatttacagctattgaagattctttatttatttataaaaacataccaagatcaatatgtatgaggtatattatctatgtctatatttgcaagtgcatgcagtctttgaaagtgcgatgaaattaacttaattaccttggaaaaaaatgggtggcgagcgaggaaaaaatcacacagactcttatcatgcgtatggatggaaacatgtacgtgcgtgggtggactcgtaccgccagattgatcttaagtttgttactaaagataaatctaatgtatctgaggtatattataataataataataataataataataataataataatagtaatagtaataatagtaataatagtaatagtagtagtagtactaataataataataataataataataataataataataataataataataataataataataataataataataataataataataataagaggtatattattattattttcatatataataggtggttgtatatgagatataagtacgtacgtacgatctacagggctgggtggggttaggtttgggttgttaactttttctttaagataaatctagtggttgtaaataatgggtccatcaaatataatgaaaatcaacggttatttgttagagtggcatgtggcaacttaggaacatttctaggatgccacgtgacgacttacgagtgtttgtagaaagtttcgtggacttttaattaatacaaatctaataacgacgtaaaatattgtgttcatcgattttagtggaaaccaatgtttggatgtttctctaatttaagagtgccacacacgcgtttgatgtcttttgtgggggtattcttttcgataaagataagttcaattttaattgtgttggaaaaagaaaagaaaggaacaaagggaaaaaaaaagagaatggacagatggagtagtatgtgcgtactgcacggaggtggggccggtgggaggttttggttttgaagatagatctaacaatgtaaaataatggttccaccgatttaaatgaaaatcgatgattagatttctctattttattagagtgccatgtggcaatatgagagcgttttgagggagctacgtgacagcttgagagcttttatagggagtttaatgaacttttagtacataatagatagatagttttcttttactttctaggaaaggcaattcacttagacatgtctctatttttttttttgagaacgggggcattgtgttcctagtttatattaagaagaataaggaatcgacccagtttatgaagaaaaccggatatgaaactaaatagtcggcaaaaacacacatggaaagcaggaaaaaaaagagcctgtggcaacaccactactgagacccgacacaaattatcgttaccaagctcatcacaagacaagaagctctgacttcctttgacaaataactgtctcaaaaccacctagcacactaattattaagtaggaccttctaagcaaagcctccaaggaagaaaacaatgtcaaagacgttgccaacacccatcgagaactagactagggatgcctccaaggaggaaacgacgtccacaaacgtcgacattgccggcaatggtcatataccaagcatggctttcacccaaagctctcacatttgtcgaacacctctagtgttgccagaacaaaggtattgcgggttatcgttgctcagcttgccacccggcgcagtagctccgcctccacgacaactcaattgctctacagaagccatcagcaccactccacctaaaaaacccttgccacacagccagaacgaaaatagttgagagttatcgttgtcaagcttgccacatcggccaagcggctccgctttcgcccccaacacattaatgcatggttgctcaatcggaactgcttgcatcgccacctctctcatatgggagagaaaacccacacgggatccctcgctgccacaagcctcgtgaaagcaatatcagtgtcatagaccacctgtcctccaccacatggaaatcctctcagtctaacggtagtccccttacatccctcagtgcttcccacgatcgaagtttgaaagcaaactagccattagaggggaaggagcaccaagaagagggaggcagcctagctggccaaaagaggactagctcgctgtcatccatgccgccaaccgtactgatgaccgccatgtccaactgatcgagccaccaagcgatcgattagcctacaagtaacaccgtaggccatgagctccaacggcactgcatcaaaaccacaacaccaccgatgctgcttgtgttagtgcctcgccatcatccggcccatctaactgtctctaggggcggcctacaccaactgcaccacatctgcactgagcaaacaccctcaagtccatctcagacccaatgcaagaagcttcctcgaagtggcgcccaccccaacttcccaacggccacctcaccacaacttcttggctaccacccgctcaggcttcctaggttaagccggcctccgccgacctttcttccctagcagagcaactaactcgtagcatcacctcatgtttgcttgcccgcatcgttagtcggtccgtgctacctctcccgacctgaggcctggaccaaaaccctcctttgaccaagtgcttgctcgcctgcggccactgctgggtcgagtccatggccatctcctcaccaccccaaccaccatcatcaccatgggagggataacaggtcctagatacatgttgcagcgctagatctaggtgaggaaactccagatccaaccgctgtccatccgtcatcgtcgcatcttgtcgcaactcccactaccaccgtggtggacaccggctctcacattaagctgccccggtgtggtgcccccgcagctcgccatgcatcggctgcccactgtcacttgctcgaggaagaagaagaggccccgtcgttgctgtccttgcggccgtgtggttcctggaggcttgctccggcggcagcgagggaggggaagggagaaggatggcagccggtgggatggagcaccgcccgtgtcaccccgtaaggagcgacgcgggagaggagtttttagaattccagacatgtctctaatgatgtgctagtatattatattacaaatttaaattttttatcgtctcatgaaaattttctcaaaactctcaatccatcctttatcttccattatcataaacaaacaaagctccgttcattttcttcctctccttgtccttctctcctcatctcctctcacttagctcctctgctgtggttataagtggtgcgtgtattctatgatgacctagccatagcacatgtatatagtgtccagacttgtagtattaggttatatttaattcaatattagagccaaatttatttatcaaggttcccaaccttcactccctcgttttcagcacgtatatttcccaaactgctaaatgatacgtattttgcaaaaaaaaaaaagaatctataggaaagtcactttaaaagtcacattaatccaatttttaagttttttagctaatacttaattaatcatgtgttaatctaccactctatttttcatgcgtggggattagtttcgaaactacagtaaaaacaaagcttagaccgatatattttagaagcgagagagtagaaaagtaagataacccaataactaaatttgtactgatcataataaagttgtctagttttatatacttcattaaaaggagagccaccatgtggcatgaagaacaccaatagaaattaaaggtgatcggtggtgccatatcgtgtgcaaaggattaaacaagtactcgcttgtataattgcatagcactagttggaaattttggtagaagatgggatcaattttaagtaacaggacaagattcgaactacagtattgtgcgccttttttttttcatacatttagaaaaaaagttcaaggggatctgtggcaaatttgattttagtatataaatctatataatcaacatatatagttggaactatatttgattctgatgattgtcttgaccaaactagaaggctgttgacagcaaacaagaaagccgcatgacggaacgaacgatcgaatcgtcaaaagatgattgagaacaaagatagaggaaaatatgaatattttgactggtttttgttagctcgccagctggtgatctgggagaggatactgtaatgatgccatacaatatttttcatttatgttagtttgtcacctcaaactgtggcatgtcctagtaatgatgttacctatattttgtttactatcattacctatattatggccctggttagatctcatcccaaaactttacaccagatcacatcgaacatttaacacctacatcaagtattaaatataggtttaaaaataactaattatacagattgcgactaattgcgagacgaatcttttaagcctccatgatttgacaatgtggtgctacagtaaatatttactaataacggattaattaggcttaaattcgtctcgcagtttacttacggattctgtaattagtttttttattagtgcccgaacacctcatgtgataccctatataatacccgatgtgatacgccagaactttacacccttaaatctaaacacccctatattagtaatgatagtaagtcctatctcacatatcatagacggattcagtatcgatctagtacattagtactgcagaggtagctacgtgaaaatgagtctggcacattgtttaaatgcacacacatatataaatgtatcaaaggtatgtaatgcagggcttgttcactttgctactattttcaaccttacatttttttggcaaagttactaaaaaagtggctacacttagtttgttgctaaattttaataagtacatatgaaatcttgtcacaatttgacaaccttaccaaaatttaacaatgtaaaacttggaaaggttgaaaatggtagcaaagtgaacaagcccgtaattctaccgtgtgaaaaaaataaaattgtaactgtaacatcaagattgtagggatatgattatcctcgggcgaccgggtgggggaggaaaaatcgggcactcccccagccccccgcgcgtgtgcatgtctgcactccccctggcccaccacgtgtccacacacaaacaactctattgcaacaaaaaacccatatattttggaaacaatctattaagggaatttggtttattttttggtccaccaaaaatgtttcacctagtgtactcacaatgtttcactatgtatagatctaatgttgcagtgaacgaaacattccattgcaacaaaaaaacccacatattttagaaaccccctattaagggaattcggtttattttttgttccaccgaaaaatgtttcacctagtatacttacaatgtttcactatgtatagatctaatgttgcagtgaactgaaacattctttcgctatttgctaaaatattgtttttatataaggtgaaacaacatccgatttaaacgagtgaaacattttcgatttacttactgaaacaattccgatatacctggtggaacatcgtgcaacaatttaaaaataatacaataataagctaaattttttttcgtcggaatatatccacgtgtggtcttgttttgaagatttaattgcaatctgatcatgatttggataagtaatttaagagaaaaattagtttaaagtagttttacacgtaaattgggcgctgacgtcgtgcgcccgattttttgaagttttcgatcgggtccctagtcacctccagattgtagcagataacttgaaccatccatatcttagtcggatggttaatttgtaacctcagtatgtttcactacatcgtccacgtaagaccatggatacatttctgtcatagacatactacagcagaactaggttcttgtaacacagctatgtgctactacagcccttaaaacgtgtgtaggtaatttttttttatcttttgaattcatatatacgttcatgctgtgtttcagcatttgattgcccattgcttgcctaacaaaggcttatattagttaaaatgtttgctaaaaaatataacattttacatctaaaaaaacaaagtctgctctaaattgtatgatcagataatatctgtgcttcctttacttatccacagcaacactagagtatcagttggttaactggtcattcccttccatttctttttttatatactatagagtatgatcatgatctatgttggctcatatatcatacagatggaagttctacatttccgatggtcactctgcaatattctttttgtatggaagtcactctgtactgttgaccatattcacatgtctagattgacaacatggtacgttaagatttagttaaaaaaatactaggtaaactaaatcggttttgtatggagcatggtcatcgacttctagtgagtgataaatataatctcagttttttattgaactagtactgaccaaaaaggcatttaccatatgttagattaatttgtaatatgctctaataaaataaacactagttttgcatatacaagcgagcatgctctttgaaatatattctgcttgagaaccctgatcatgggtgattcttgggtttatgtttgttggtaagctggaatatttttggcctgcaggaccatggagatcaagcataatttggcttgcagacctttggagagttggggaactgttatacttgtgcatagtttggttctaactgcttgtaccagatgcatgtttttctcatgactataacaaatgtggaccaaggtgctttcagcagagcacaagatgtctcgaaactgccttatgtaatactggcactaaattggcccttggtgctatcaactacccacatgcttcaattaatcggtatttttcttacatgattgaaatgctcttcctacaaagcatttgatggtttctaccaatttgtacctcaactgtcaaagaaatacatatgtattttctattttgtgaaagcttcttattttccttaagagtagcagtttagatagatagataacactagcattaagtcccaatttgcattttgctaaaactgaaaacaagacctaccgaagaattagtccaagctgtaaattacattcttataaaatggtgatatgcctcaaacgcatcaattgaccatgcttaatatataacagcgaaagtgaacaaggtttagttcttgctttcatagataaatatattgatgaatatagtgcatcctaactatttttacattatactgattctggtatcctgaatttttaatagtgcttgtcgtggggctacccaaacttgcttctgattcactaatccattgatcataactaggttcactgtcaacgcctgtgctgtacaactctccagatgcaagcttatataagttgtgaagagatccttgcagcaaacaaaatgaggagaatgccacaagctttatttgtagcctgtgtatttgttctgtgcagatatgtggcacaagttttaatctacagatagtttcagaagattctttttttttcccaatatgagcacatttttgtattctatcatgggaactataggttatttcttaaactatttgttattcttagttagaaatttgtattttcacatgtatgcatttattttgttttgttttacatgaatgtcaagtgcgcaccacgttttaaaacttattgttattatatctcaaggtttaacatgctggagtaaatatttattggctctgacatatgcacgaatggtttagcctttcgatcttcataattgatataatgtgcctttgggacatatcctttgtaacatatattttgtgatcctactagtgcattcctggaaaaaaattttctttcttattccaatgtgttacagactactcttgtagcacatatgatgtgttactgtgatatttcctagcagcacatctattaatatgttacagggttatgttagtagtagtgacaatggtagtactagatgtattaatcttgcttagtactactaaagggaattgagggggcaaaccaggggttgtcagcagaagtaaaaacgaaagggattgtcggccgttcagaactggaacatttatagaaaattaagtcgcttttgtcgtcccatgtgaacctacagatccatcgtttgcttatagacttattggtgaaaaatttaaattctactaaaacttaactttacaattgattataagtttttttcatcgtagtttattttttatattggattttagatagcaaatgataagctagtgaaacttgaaactcctgattaatcggcgttagaaaacttgataaaaataaataaaacattggccttcttggatcatcagaaacaaaggctttatttagagaagtttagctgtagcttatttcaaaatcgttgatcattaaaatcttctctaaacaatttagattgttataccgattctgagaatccaaaattatagaatttagaaaataaactagaaaccagaaaagaaaaacccagctttttcacactttcactagctagcttattaccagctaattgactacttctcaaaatcttaaattctcttaacagggctaaagttgcccactccctcagctggattgcactagaaatcttgtttctttagttgggctcacctacgtattcggttaatgtttttgttttttgtttttattctgtggaaggcacctgggcgcaccaccacagtccacagagtcacacacatcaataagagcctcattttaaccgttaacacattcacgcttaatctttatcttcatcttgttgaaataataagcacataatgatttaatttatttcataaataaatcatgacattgcatatgtaaactagcatgaatgcatcattgcatctacacatataaactaagtaaaaaaatatgaacagatcaaatatgcgcataccgaggttgccgaaacatcggttgctcagcaggaattacttgcggttgcgggcgttgatgaaagtgcgcaacacgcgagcgaacaggaagacgagccgtcatgtacgaacagggagcagtcgcgtgaagcgcttcccaaaaaccttattgccttcttttctcggtgcaggatgtcgaaggcagaggttccggagacctgctttcccgatcgccggtgtacgccagcgagcgggatggagtagtctacgagcgatggcacggcatagagtaggaggcaaaccttagattgatttcgcgtatgttgcgtgaaggcggtggctcggtttatatagagaaaggtcacttgatcagggtgcccgcacgatctccactccacgtaaccgaaccggataagtcgcgcgtaacttatccggactccacgccgttttcacgcaacggatttttcggaatgtttccaaaacaaacaaatccgaatttcccgcagcaaaacaaaactgcaaaaggaggctacatcagcgcaaaggtgaggaaccaattttgcggaccatttgacgcgtacatcgtgcacgccctgccaggcaagggcgtgcgcgcgtgtgttccccctcttctctccacctcatttgcttcaagtggctaggagggcatcctcccttttaaggaggtcaccctctcctagaataagtaatgtggtactaaacttcctatgcatgctacctcataaggtgggtttttatgattttccaaagaattaatcttcgagtggcctaagacccatctattaattccaacacatcttcatctttaggagattcaaacaccacctaatacccagtgcctgtctttttgtcatttcaccggtttcttttttttttctattcacgatcttgctttttcaggctatctgcaacttggtgattttcaccaaagaaccaaatccaaattgctataaatcacactaaattctacaattaaagatcaagaaataaacatataggtgaattgagccatgcacgatagattgaatatcgcatgcctatggtacttcattgtccctctgttttgtgcatgaggatagatgacttctagcaatcgaaaatgaaatttataattttgaggatgcagacgggtctcattgtctactccttggtttatctgcggtaactaaaatttaattttagagttaatataggtatctttcatcataatctatttttcagcataaagttttatgcataaattttatattttgtatttgtcagtaatttttttatatctatatttttagcaatttaaaatctaatgttgccaacaacgatttgaaaaaaaaaactcaaaatcaaaattttcaaattaaatttaggccctatttagttcccaaaatctttttcccaaaaatgtcacatcgaatctttgacacacgcatggagtattatatatatagataaattaaaaaaataactacattgtttgcatggaaatggcgaaacgaatcatttgagcctaattagactatgattagccataaatgctacggtaacccacatgtgctaatgacggattaattaggctcaaaagattcttttcgcggttttcagggagttatgaaatttttcatttgtgtctgagaaccccttcagatatccggtcaaacatccgatgtgacattcaaaaattttcttttcacgaactaaacaagaccttatatttcaaatttctaacagcggtttataagatgaaatacaaatgatcgttcttttgttattccaatgggatttcaaaagactcattaagtcccaaagtatataaaaaatattcctagaattcacagccgacataaattttaaaaacatttttttccagaagaaaccctacaactgaaatatctcaacgaaaatgggagtactccgtctaaaaaaataaaacataagacatgatataacacatctagccctataaatctaaaaaactcccctgttcaaaaatcataatagtactcttttcgttcaaatataaaaattttgagctaaagatatctagctttgagaataattagagtttcaaacatgacattagtacaagtaaaccccagggcctcaaaatcctttctccgccgccgatgtgaggagaccgaggaacgggcggaaataaaaccccgcacgtgctgctgcagtgagccagtcggtcagccgtcagccagcgccgcctgccgcagcgccaccccggcggtacaagcgggtagtatatccagggaaaagcagcagcagcaaaaaataaagaaaaataaaagtgacagggaccggtgaaaaggcagtgggacgctggaaaaaagagctcctcgcaaaaatgctctcgtgtcctcgtccgtccgtcctcccctgctgagcctgcagccttttgtggaccaccccgccccgcgcaagcgcaacagaagatgaaagaagcacaagcagtcgctactagttcgctaccgcttgcgctggtggtgatggccgaaggaccagaaagaaatacgattcattcatgccaagccagtgttgaggccttgaggaggcccaaagagggcagttttgctgcgggttgggcttttgttgtagcggcgatgaaacgttctctgccttcgctttatttccttatgctgtggtttttgttgtagcggcgataaaacgtcctctgccttcgctttatttccttacgctgtgtttgagaggaggggaaagaaaaaaagattaaaaaaatacgtaaaatgagataaaccattaacgcatgattaattgagtattattaatttctttaaaaatagatcaatatgatttttaaagcaacttttttacatttttttttcaaaaacaccgtttagcactggcttacttgtagtggcgtatgtgtgggtggtttgcatgtgatgatgtgagtttatgcataaatttagatactacatagcttatacttgaagggctgatgcataaaaaaagagttttcatgatgtcattcagagttcaattttgatctcttctactccattgaaaaaaaagatcggttgcaatgcgacaggagagaggttttttagtggcgtgcatgtgattgggaggatgtttgctacagagccatccttagcattttggggtctgtgccaaatataaaggaagagccttatctttagaaaatactattatataatatattataattatatagtattatttataacacattgggttggatatctgcaactactgttattttgcttgatcgaatgcagtcaatggccttctaaccacggcaggaaagccgtcattaatctaacactactttctttagctatatcctattatcaaacaaacataaattgtttttaaccaattataactatagctatatcaaagaagttcactgatctatctatcatatagttaaataaatggttttactcattcatcgtgtgacatatccaatgatccaaaatcattctgtgagttgcatccgacatcacatagctcgccacgctccctccctcccttcgatctcattcccctgaaatcacgcaaaatcacgtctaactgttaacaaccaaatttggtaatccaagtatccgaaataaagataggatcgaagcagaatttgagatggaaattgttccggaaacagagtaaggattggctggagtccgaatcggctgcgactgggatcggcagagtccgaattggacaaagttagccgattgagccgaatccgacaatgtgacacggtacacgttgtcgggttgagttaacgtgcttcatgaggattgctacgcacggattgagtcctgagaaggcaattgtatctattaattaggatatttcatgtaatttccttagagatatgtttgggcaaaagtctgcgtatcttagagtttgttagagataagagttgtatccgacacggacatatattgtaatcttgggtataaatagaccccgagccccatgtaatacaacaatacacattcaatacaatctcagagcatcgccaccattttactttcgttttgtttcgacaagttctcgctttcgggttgagctacatcggtttcgatcttcaactagaggtaaaacttgttgtggcggcttgcgttctcgagattagtgcttccatctttacgatactctaatcttgtttatgtaattcatcgagttaccatatattctatataatctttgacaatattgttatctaacctctagtcggctaacatcttttgctagaaggcagccgattaggttgaataccaacgttgacttagattatatatgatatttaccactctatgaaacatccaacggcttaataccaacgttgacttagattatatatgatatttaccactctatgaaacatccaacggcttgattgtctagatattgttcttcttttcatacttatagctgcatcagttgagtttaaccttataagtcgtgattagaatctcaatctctagcctgcttttggttgccgattagtgtagcatcgggatttcagccgaccttacctgatttaactactttcatctcatatgcttgattgacatgttaaatctgccctttatattaagatcttgttgcatttaagtatattaggcttttgtttagtatattctacttgctttaatatcttaatatagagtagtatcggagtattagccgatacatgctagatctatctgatcggctatgctatgaatatatatagtctagttgttaatatatatttcgatctaagtgatttatactgtctcggcatggtgatcgatctatcccaatcacttgatgtaagtatatattgacataaggattatatattattaatatctatagccgatcgagtagatttagttctttcttattcattcatgattgccgatcgattcacatatgacatcggcctagagatagatgatatgtaatcggcaactagccgatcggctatcatttatggatttaaccgcggtctctttgtctttatttcttgttgattgcaggatcaaattaactggcacgctcacacatctaaaggaaagcttttggacctgcactgaagttaagcagatcccccaggcctcatgttttcacatgaacactaactgcaaaaatgatgccgccgtcaccaccactcggattcggtgcgccacctcgcccgtgagcccctccacacatcggcgcccccctctaccctagcgtcattgttccccttgtgctagcggaggcagtggccggttataggaccaaggtccaagtatgcggcagcggcatatgtgtaggatggattttgttcggtcaggcgggcggccgtgaagcggcgagagaaggatgcggtggtcgaaagggaggcgtccagttagcgttgacacgatccaggcaacaaggtaaccttgcctcgaccgcgtccacgccccgccgcgcgccagtcgctatctgtcatgaccacgttgcccccggtgtcctctctctcctacatcatctctgtctcccctccctctcgtgcatccatggcggcggcgagttcttcaagcacggcagcacatctgacaccctgagatcaattcaatcttacaagaggtaagcatataagaaccatacgattcaccattatcaatatcttgtccaagattcatgcttcatgcgggacgcggagggagtggaggaagaggtcagaggaggtagtctgttcggcacgaaaatctcaggaagtgcgggcaaggagaatggtccctggtgaatccaagtccgttgaggccttaagcagtaacgaaatccatctactactataattgcatctattgtttctgtattgcagtgtgcaacacagtgctgtttgtgtatgcacataacaagaatgaaattaaggttggaaacaaccaaaaagtgtggaacctctttcgttctaagctgacatccgctgaaggaaattgtggcctccttttttctgattccttttctattttgtgctatctttttcatgtaggggagcagctctggtgcgacggggaagttggcagcacatacgcatttcattgagcacatcttgagcgttttagatttcttgaatgttttatattgtgatcagaccaataaggtattcaactggcatacagttttctcatttgggcttaagtgattggattggtttattgtatcttgcaatttgttgtgttaaaaaaatgttatagttttattgctaaaagcaatctatcttttctgtcatccagatgaaagcaattacttgtggtatcttatgttagtaggcataattatggaagaactggattagcatggataattaatggactacattaattggcgatggtttttggtttagttgagttttctatgcacggtatcttctggtaacgatgattgaccttttccattttaaattaagtgaaatgaatcattagggctgctatggacacttgagtacatttgcatgaactatagcaacaaagcctgtgctttgcaagttgctggtatggacatccagtgtttcttcactcaaatcttgcggacacacaagagtccaatttttcacatatttatttttcttttttgtctcgatggacaaaaattacaattttaacaagtagtggggattgaatttgtgtaacacaagaattctccaaaatggcacactgcttgatgagatccacattgtctgaaacttgttctgcgtgatactcagtacgctaatatgaatactaggtttttgtagtgtcttggcttaactatttgtttgggtaaatctaaaaccactaatagtaattttgctttgttgatccatttggggaaataaatgagataggacagtacaatgatgccaggtacgtatcatcgccagaggctatataggattcttggtttcccacagttcgatatctatccaactattttgcagctccaacttcatcttcctaacatacagtatgtcacgtatgatgaggatggtaatatcgaggatgttgtcaatcgttcatcttcttatatggcattaaataatctcgaggatggtttaaatttaaatttgttggatgggcagtatgaacggtctatatgccctaaccttttgttacatattgggaaaaaaaagctatgtgtagagatcagatggacttttcctgtgcgaaactctggattatgattcatgttaggcatgttttttaaggttaatatcacacatctctttttttttttgccttgtgtttgataaatagtttatttcagtattagtttgtattcatattaaaatggatattccattttaattttttttatgtataactcttcgaaccaataaatttatttgtctaatgcaaggtagctaactattcaaatttcttagtaccttgtcgggttgtatcatacatctctttatgcgtgccttgaaaattactttatattatttttatttattttataaataaatgcatttgtaggatattaataagctaaggcaacaatttttgctacatatacaaatgtaccaacaaaatgagtgcgaaagcaacattcctagcgatacatgagtgtcagggttacggataaggcataccttctatcctacgacttatggaatataccaataaggcataccttcacgtacatggattgtttccgtatacgtcgttaggaatttatcttaaattacggaaaatatccctatgagttaagaaactaccaaagtcctactcggagggggatagaatctctgttatatcgtatcagattacatacctccaggccttacttggggttcaagataatccacggtataaaaggggacccctagggggaggtgaaggacatcgaatatcatcgccaacacacccaccatagcttacgaagccggagtattcggagccaagtcaccgggagatctcgtcgaatccatcgactacgatctcgtcggtatcgtctgttccatctactctctttgtaatctgttctcatcgtcatcaatcttatataaactggactagggctattacctgttagggggcctgaaccagtataatccttgtcttctgtttgcttgatgttgtactacgtagaccctcgttccaatgtaccccaatactcaacttatccggtccacgagtatcactcgtcgacagtggcgcgccaggtagggggacttggtgctcaaggatctaccagtatgacttcaagacttcccgacaacagaaccatctccaacgtcaatcaaggagcttctacctcgacatcgttggtttggactcaagtcggatccattgtctttccggtctataccgttacgccaatctcggctggcccaatcatcatcgggaatgagaaaggcacggtaacgactcagagaaacgacgccccgccgataattcctcccactcaggtggagaatggaacatcgatggccccaacactcgggaggaatcctcaggcggctgaattttgtcccccatacaaaagatcagagccgacaaggatgaccaccctaagaccgagatcttggtgtcttgtgcataagacatccaagcatactcttgaggactgttcggtgatactccatgtgcaagctgaactctacgcctattgggaacgtgggattcagcgtacttcatcgacaggagccacctactgtccgaaacatagatccagatctcatgatctcacaagctgcagaatcttcctcaggaccctcaaaccaccgcatcatcgtgtccaacaaccacgagttcaaactccgtgcgttgccaaggaaccagatgcagccccaatcccgtatcggttcgtgggatacatcggtgataacgagccatctgttttacacctcttggaaggctacgaatcctcttcggagtcaacacgagatgtaaacgtggtcgacaacactgagacaagcgcgtccgcggcagagagaacgcccgctcaccagttgcgaaatctagacgcgatattgagggaaagtccttttgatccagcgacaaacccagacgccggccaatgggtagagcgactgcgagagaccgtgaccaacctcaatgccgcgtttgccgaagcagcaggtggcccagaaccgcgcaggtacgaagaacaacctaccgaggacgcggatggagaaaatatcgccagaggacgtctcaccggtgaccactcacctcggcaggaatgagatcctactccgccatgccgcgaaaatcgcgatctccgtgagcaggagggatcgtgacaacaacgactgccatcgacatcgctctccttctcgtcgtgagggcgacaccacgcatcgacaacaccgtcattgctctcctccgtggcaagaaaggaaagacggccgagggaacacccccaatgaagaccgagactgtcgactccacaatgaccgacgcaacaacgacaaccaccgagatcaggggaatgatcgccaaggccaagagcgggacggtgacaaccagcgagatcgaaactcccaatctccacacccgagtcaagattgaggacgcgatcatcactcgagaagccgagctcctgagccaagcagcccctcgtcctcatctttgtcatcttcttcatcagatcggcctcctcaacggcgtcgcaaccacgggccacccccccgtcccaggaagtggatgcagggcattcacgcccatgctccaaaacgtgcgatggcctgagaagttccgactgggagcgatggagaaatatgacagaagtacggacccagaagaatttctgcaagtctactccacaattcactacaccgctggcgcagacgacaacgcattggctaattatttgcgagccgcgttgaaaggctctgctcgttcatggcttgtccacctcccgccctgctcaatctcttcgtgggaagacttatggcaacagttcgtcaccaactttcaagggacatacaagcgccacgcgatcgaagacgacctgcacgctctaacttagaacccgagcgagtcattgagggactatattcgacgctttaacgagtgcaggaatacgatccccaagatcaccgatgcttctgtcattcgagcattcaaatcaggcgtccgagatcgatataccacaaagaagctgacgacgcgccgaattacgtctgccctaaagttgttcgagatcattgataggtgcgctcatgcagacaatgctctgaggcgcaaggagggaaaaagcaaagcgggagaggagaagaaatcgaccaataaggatgcaccagagtcaagcaaaaagagaaatcgcaagagtgggaagtgcaagtcctcaggagaggtcctcgccactgagcaaaaggaatcacctaggcgccctaacccccagaacgacgactcacgcaagacttggtgtccaatccacaagactagcaatcacaccatggaggattgttacgttatcaaaaaggagctcgcgagacaacatgcaatcgaaagggggaagcgagtacgtgttgttgaaacggcggaagaagccgccaccggtgactctgactccgccttcctagagtatgacctacatgtctcccacatcttcggcggttccacgttgtacacctcaaagagggagtacaaaaaagtggaacgcgaagtctgcttcacgtcgcagacgagtacaaccaagatgaagtggtctcaacacaagatcgaggtcttttggatcaccccaagatcgcgactacgcctgacagatatccaactgtggttgaacccactatacggaacatcaaagtggcgagagtcctcgttgacagcgggagctcaatcaacctactctttgccagcaccttagacgcgatgggaatacctcgaagcgaactgacgcccacagatcagcccttccatggaattaccctggaatcatcgtctaaaccattgggcaaaatcacgctacccgtcaccttcagacaagctgagaacttccgaacatagcagatcacctttgatgtcgcagaattcgacaccgcctataatgccatcattgggagaactgcgctcgcgaagtttatggtagcgtcacattatgcttaccaagtgctcaaaatgccgggaccaaaagggacaatcgctatctaggagaacgccaagttggcggtatagtgcgacaagcggagtctcaacatggtcgagcatactcccaacccgcccgccacaaccaattcggagtctcccatcacgattagtcgcttggcgccaagtgcacaaaggctacaaatgctctagccctgagttagccaaatatctcgccgaggttagaaaactggaacgcagattcgatgggatcgaagttcgacatgtctaccgaaaagacaacgtcgaaccagacgacctcgcacaacacgcttccaggcaagaaccgcttgagcctggaaagtttttggacgtcctaacaaaaccatccatcaaggacacggacaacgaaagcaccacaactgataccggcgtcccgcagggggctgcagaggtcacaaacgtcatcacaaatgcagagacgacaaacgactggcgcactccgctaatcagattcttggagtcagacgagctaccggacgacacagatgcagagaaactgtctcgtcaggccaagatatattgtatgatcggcaacgatctatacaaaaaggaaccaaacggaattctcctcaagtgcgtatcatccgacgacggaaaagctctcctcctcgacatccactaaggcatttgcggatcacacgccggcgcgcgtactctggtcggaaaagcttttagacaaggttttttctggccaataactctcaaagacgcctgtgaaatagtgcaacgatgtgaagcttgtcaattctttagcaaacacaccaagttgacagcacgagcgctccagactatccccttaacatgtctgttctcatgctgggggctcgatatactcgggccattcccacgaggacaagggggctacaaattcctgtttgtggcgatcgacaaattcaccaagtggattgaagcagagccgacaagagaaatcaaagtcgacaacgccataaaatttatcaagggaatattctgcagatatggattgcctcaccgcatcctcacagataacggttcccagttcaccagcggtgatctccaagattactgcatcaaactcagagtcaagatcagctttgcctcagtatctcatcctcagagcaatggacaagtcgaacgggctaacagaatagtactccaggggatcaaaactcacgtgtatgatagcttattggctacgacgcaaagtgggttgaagaactctcgtcggttctatgggccgtacgaactacaccaacgacatccaacaaggaaacacccttctttctcgtatatggatctgaagccatgctcccaacggagctacaacatcagagtacacgagtacagaagtatgctgacgaggaacaggatgaaaggcgaagcgacgatgtgaatctactcgaggaacatcgagaacgagttgccatccaagcagccacatatcagtaggccctacgtcgatatcacgagaaacacatcagagctcgcacacttgccatcggtgattatgccctcctacgagttcaaaaccaggcagggcgtaacaaactctcgcctaagtgggaaggaccatacacgatggtgcaagtcctgcgaccaggtgcgttcaagattgtagacggcgatggccgtgagttatccaactcttggaacattgatcaattacgtaaattctatgtgtaaagtcaatgtatctcaaatatatacaaaccgactatccaaaggtattttgatttcttcatgaaatacattagtgttcttcccggagatcccttaccacgataacacctactcttgaaatcgaacctactgaccctttacgctgtttcgacaagcttccgagaaacctacgagaatttcgactggggacgcccagagcagataaggtcttgtcagattctaagagccgaacgaccatgtaagacctagtcatgtaagagttctcaaaaggtgtattaactaagccgtgtaatcggaaattgatttttccaacttcacggctaggggctaggtaaattgcattttcagctaggcaggttacgggtcatcgagccttcccctccgagaacaggtttccccgaggacaaggcttagggctagggagagtacctcactcgacaacgggccaaaggcagcctgtaaaaagagtagtactcgctcacaacacaacctgtttaagcatttactagatagatttctactttgattacaagttcttaatagagataacaatgtattataaacccccttttagatatttttctatagggaatgaagcctaccacgacggccactgccagttcatggaagcgaaaacgtcctcggctaaaggagcaagggatcacgccaactggtcgatctcatccgccgataaccgagaacggcgaaaacccccgcgcaagaatctgaggtacatttgcgagcggcgatcttggatgcaggcgaggacgtgacctccggcgtaacggctggcgcggcgacactcctcttttaggctgatgtcgatccactgtccaatgccttcaagctgagcacactgttgatagtcgttatcaatcagtttcgaccgtcaatattaccaaaatagaggagaactagtgatggttgcaatgcatatgcttgttagaataataatattccactagtattaggtttactaaccttttgcagagaataacaataaagtgaaggagaatcgagatcaactccaatgataaatcaatcggacgatgtcgagaaccaaacttgtgtatgaatgggccaagaactcagaattgacacgacaaactgggccaaaattcacaagtctgcggagaagaacaacagaggaggctgccagccaaaccttgggcttattgggccggccccaggatcggccgaacctggtggttcggccgaacctggtggttcggccgaacccccctcttcgccgctggatgcagggtttcttctggacagtgtggattagctcccaatgacggttggagggtatttccgaccattccaaccgtcacaaccgtcattgggaggctatataaacccctcaccttctcacttcactcacacacctcaagcaagagctctctcgttcctctcaagtttagtttagtagtatatagctggtggaatagaattagaataggaatcaggagtccggaagccttcggaagagttcgggtatggctctagtagctttcctttcctcttttgtaagctttgtacttttattagaatactcttctaaatacatttctggtattgaaatactttccgagtatatgagtaccaactttacattatgttcttgttatactgaatatattgctagcttgtctgggagatgcatgctttggtgcgggtatagtgtttgcttatgcaattactctatgtcatgacgatgatattagagtagtatctggtagtttagacgtggtgtctagattacaggatatcattatttggggttatatattgcggatgagaggtgggcctctgatggtgacagctcagtacgggtattcctccacgcctatatataatcctaagttaatttcctggggagggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcaggcatatcgcccaaagagggcaagtcgatcatcgcgacatcgggacatccgcattgctggacatcctcggaatccacacagctatgaagaataaaagacgctacagattaacaagtgacgtgaagagaaggaagtcactccgcctaggagattaacagaagtacttgtacaaaaactacaatacaaggtaaaaaaaagtttactcctcataaagggggaggacgcactccccgagatccatcacactagagacatgtcctcgcgcgtggcatctgctgcccccttcgacaagatctccttgagatcggtgacagggagagccagcttcacgcacgcgaggacgtgacacgccctgtgtgaatcccgttggagatttccttcgagaccttggcagtatgccgcgacgggatgacctccatctcgcccgccagctccgacaacgccaacgtcaaggacgtctcgtcgaggtgcgtcgggatagaagacatcacaccacacgccaaggctagctggtgaaggcctatgaagctcttgcggagggagtcgcggagggagaagaggtggtcctgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaacggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggcttcctctgggtcccgctgcctcctgcgatggctggaacggaggggatgttggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtacgtcgtgcgttgtactatcgcgtgagtgctaacgagcgcacatccaaaaaatagaaactgatgcagttctcccgtacgcgtcttttcaagaaaaaaaagaatcgcgcaacgcaactgcgatcctacccttgtgcgtgagtttttcttgctagcactctctccgtaaaaaaaatcaaactcgtagtacgatgtgacatatcatatactccctccatcgaaaaaaaaggcaaatactgggttttcgtatccaacgtttgactatccgtcttatatgaaatttttttataattagtattttcattgttgttagatgataaaacatgattaatactttatgcgtgacttgtctttttaatttttttcataatttttttcaaataatacggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcctgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgcctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgctttcaccatcgaccaccttcgtcgctgccgactggtgtctttactgttattgatggacgactttgttcccacattggccacctctgccatcaccaaggggaatattacaaagctaagtcatcattaattttctttatatgatattttccttttcctctgcctcactacatcaactggttcgccgttgactagtgagtcgggggactatagatgtcatatcatattttttaacaatttttcataatatttatcttgattgcttgcgaaataatccgagtaacaataaagttcctatcgagttatggagttctattttcctatgctttccatttggtttgtcgatggatagttgcctttgggccgattcctagcacccgggggctcgttggatggaccgagtaacgcaaggtcctaagtattattcggaataaatcaaaagcatagagataagataaatttattttctgctcttacaattgcaaaagtacccgagtagtaaattttgattcgtgaaactttgttccattaatgacgaactcatgtcactcatatgcatgtttgggaagtgcctaaaccaactcccgatgcttgggggctatgactagtcgggcagagtgtttaaacgtacggagtcatctgctcggggaaatcaaaattgacaagaggagaaatacatatttataaatattttaaaatacttgaatttttctcaagtactgtgcttgcatcagatactactcattctatatgtttgttctgcaggatccagatccagatatgcataatagggatttatagctttaagcttatctcctacgcttcaggaatggattagtcagaatatcaccattggcttgctgtcgtcgtcgccgactggtgtcctcgcctatacggttgggtggtcacatcaccgttgttggacgtcatcgtcttcaccgccgacttgccttcgccgatgtcgactggtgtctccgcctgcacggctggcctattatgccaccgttgttgggcgtctacgtcttcaccgaccagcttgccttcgtcgccgccgactggtgtctccgcctgcaccgctggcctattatgccgccgttgttgggcgtctacgtcttcaccgcctgcttgccttcgccgccgccgactagtgtcctcgcctgcatggctggcctattatgccgtcgttactgggcgtctacatcttcaccgaccggccacctcgtatgacaccgactggagctatcgtattcacggctggccatatcgccgccgctaataggcgtcatcatcttcaacgtaagctgtctacgtctgctgctgactggtctcttcacttacatggctgcatgattctgatactgttgattggccttatcgtcttcaccgccggtcgtctcgtctgctgggattcgagcccaggtctccacgaccacaacgtggaattctcaccactaaactactgccgactggtttgttcgcctccatggctgcgcgtcttcgtcatcattaactgggtcatcatcgccgtttgccttcgccgccgtccatagtgttttcactttaatagctggcctattttgccaccgttcatggacatcttcgttttcatcatcatactacttctttcgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcaacgagttggacaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgcttacgtcattgccgacttgttatttcgccttcacggttgacctactacgcaaacgctgatgagcgtcttcgtcattatcattagctgctacactgcattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaggcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacaccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcagaggctcggcgcagccgctcccttcctccgcaagccgacgccggtgcagatccctccatccgtttcccaccaccgccgctccttcccttcacaagcgtgtgccagcgaggatcccctccacgcgcttcccatcaccgcggcccctgcctccacgagcgggcgccgccgcggatcccctccgcgtgcttcccgccggcgccgcccccttcctcccttcagacaccgagtgccaccaccgcaactcgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctctcgcaccccgcacacccacccatccactttagctggacctttggccgctctaccctctatcaaagtaggaaataacagcagcaacaacagctcacagccgtaaaagctcacacacctcctcctcctcctcttccacgcgcgtcagtgggccgcgctgcaccgcgcattgcttcacctctgcacacctgaaaccgaaaaactcaatttggagtgaagcagggagagagagagagagagagagagaggagagaggtgtcgtggagggaagtttttgaacaaaaaatttccccaacccgttgggcacgatgccgtcatgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccgccgcccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtaggaaggtgactgggtaagggggtgtgactgtggaacggtgaacttgagctggcacacggctggctcaggctcaacaacacgagcaccgctccatgcacacgaactcccagtctaccacaaacgccacactccctaacgacattaccgattgggagggtgagggagagatgagaaagaggctaacatgtggccctatcctcgtcttggatccagatcaagtccatgagggatccatgtggcatatgcccacgttgtctcatggagcggatcaggggctagtttttgaccagtgatgatgcacagtatacaactcatacttgaagggttgatgcataaaaaaataattttcatgatgtcattcagagttcaattttgatcccttctactccaatgaaaaaaaaagatcggttgaaatgggacaggagagacatgttttttttgtggcgtacatatgattgtaaggatgttcggtgcagggccgtccctagcaatttggggcctgtgccaaatataaattaagaccttatctttagaaaatactattatataatagattagaattatatattatttataatacattggggtgggtatctaataccacttcttttttcttgatctgcattgcaatcaatggccttctatccacatcaagaaagctagctttaatctaatgctactttctttagctatatccacaataagcatgaattgtttttaaccaatgataactatatctatgtcaaagaagttcaccaacctacatctgtaaatgttatggcaatccggctaaatagaagaagaatttatgggatctgaaagtgcattttgagaattcagggacttcgatgacatatacgaacaagtttagggactagtcgtgtactttactaaaaaatactagtaatttggtactacagctgcgtccaatacaaatttccatccaccctacttaagaaggtggacaattggacggtttggaggccctcacacacctcgtgtatcatgaggaggaagagcaaacggtgggatctactaataagcctctcacatcctacatgcccatctgctctaaactgatctttggctgcctaccaccttgtcaaagtaagaaatatgcatcaacaacaaaagggatgtttagatccaggggtgtaaagttttggcgtgtcacatcaggtattatatagtgtgttgcatggagtgtttgggcactaacaaaaaaataataattacagaatccgtcagtaaaccgcgagaagaatttattaaacctaattaatctgtcattagcaaatgtttactgtagaaccacattgtcaaatcatagagcaattaggcttaaaagattcatctcgcaaattagccgcaatctatgtaattagttattttttagcctatatttaatacttcatgcatgtgtttaaacgtttgatgtgacagggtgaaaaattttgaggtgggatctaaacagggccaaaaacacattcccaaaatcgaggaaacctagtggctagggcctaaggtagcatatttacattaattattgattaggtggtacaatgaagacaatagcaaaagggagaggcagtacaactccctattaaactcatgttaatatctatt

SEQ ID NO: 70176 - DNA, 952 bp, Oryza sativa
ttcctgcagcccaattgagttgctgtctgattgccacaccacagtgccatcgtagtccttgagaaccatggcaccgtccttctgcagggtaacaacagagcgcctacatgcacagggcgtccgcggttcgcggtccagacaacagtcttgttttttgagttggtataccatattgagaaggcaaaagcattgctgtagatggtgaggaagccgcaggagaaagtgccatcagctgactgtaggacatcattctggtaatcatcaacagatagagaggattttagtggtatcttgtcacgagacatgacaattgggagcagagcaaggaatgatagagcagggaggatggagaagaagggtgccatgggtggattgaaaggatgaccaaaggagcagtatgtccaatttcttctcatacctccttgcttcattcttatattcaatagaaggttggtgtcctatgcctcgtgatgtccacaggcagtgactgtttgcatgtgttcaggacatctgatatattatatatatatatggtcattttgcttgcttgtaatgatctgatttgagcctaccaataatcatattaatagcatgtgataatggtgacagcactaatgaaaatgctactgccagctggctaggaacttgcttcgaaaagcacaggaaaaaaatacaaaaatattaattgatgcacctagttgaagtcagaaaagtacgctttaatgttcaactatgtgtatattatcttttagcttctaggcgtattgttgtgatcaatgcaaattttagaccatggaaggcaacatctagctggattgatgtgaacagtgggcagaagaccaagggaagtgtcacttattggaagaaacagtcaaatctgcaaacagtgagccaaaaaccaagggaagtgtcaattcttggaagaaacggttaaatcaatttgatgggcttg

SEQ ID NO: 70177 - DNA, 528 bp, Oryza sativa
atacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccgcggctcgccgtgcacattcttatgggaccctttcaccggccgccgtgccgggctgccccccgaccacgacggcaccgtcctcgccgccgaaggcagccatcgccggaggtgcctcctgtcatgctgcggtcccatggacccgac

SEQ ID NO: 70178 - DNA, 30569 bp, Oryza sativa
  unsure (1)..(30569): unsure at all n locations
tggcctatgagatgaatggcttctggtctctgaaaacctcatcaaacgtctatcattctggccgtggctatgattgcagctagctaccgttctctcgatagataatacggacgatcgacgcatctagcaatgactctgaaatccaggtacttaccatctgcaaaggatctgttatgcgctgcttgtgctaagtcacccaatcgttccccacaacattctcaatggcaactgctcaggtagtgatgagtttcacgcgctctaagcccggcccgcgcacagttaggaggattggccgctatctgagcggtttaaagccaaggagcaagaaaacggatgcgccccgagtaatcgacccgtttcccaagcagagtttcgcgaaacctcccctcgatgtgatagcatcgtcctttgtaacgatcaagactggtaagtccattagtccaaacagttgtccatgtaccagtagaagattcggcagctactgcagcccctgcttcaccttcatatttttcgtggtctatatcatgcgagttatagcagtcctaggaaatggttggttttagaatacacgaaagtgacgaagttgctttgactactgaaccatgcctggatcgtcggagcgaattggatgatcgggccgagggctgccccctcttccccttgctctcctttccttaatattcaccgtcgagtcatcaaagccgtcaactaattcagaggggctcggcgccctttgagtctatagccgccaaatctaaatattccttaagttgtcgtacggcgacgtcagatcgatgcgtctgttaattaaacgttaataacattgatagaagaaggaggttaatttcgtggttaattaacttggacggtattgtacgtcgttgtcgatcggtatcgatttcactctcaatctttacgtcttctctctttttctcgtctttgggtacgatgattaagcatgacgaggacaggtgctgagctgcatttaggttaatttttgcatatatcccccaagggccaaggcccccactgcataacaactcgtttaggaacattaattagtggggctggatgtatgagccactcatcagctaataaaatgtatagtagattatttaaaatatgcaatcaatacatcttattagttttatgttgtcttaatttttctctatacttgttccatgctatggcatgcagggacggatattgaactataagagtatgatagctagggctgcagccctatttccgaacctaaatatcaattgaaattgcattataaaattttaaaagataaagacaaaattatgtaaattatatcgattgagtcctaggcttaaaaagattccggttccgtcactgattgcatgcataattaactttcacttcaacttggtaacttctacaggtattagcaagggttacaattcgacctttttttctacataaaaagcacaatagattatcaaactggtgacaaaagagagtgagatcgtacttgttgggtatatattaatgaaaatggaggaacaatcaacatctcgctcatttgttgtttagtgggaccaagaaggtctgactggatatattacaaggacacacgtttttttaaaagaaaaatcaaagagttacatgtttctcttttgctctatggataaccaagtaaactcgaaccacttgcatccctcttgccgttttgtatgcttgttacatcaatcctagtgggcatgcattacagtatgttttggatctagcatgggttttctttaaggttaatttgatccatgtcattgcaactatgtcgtattgaaaaaataccactactattcacaaaatcgggtagatgtcactacaatcttctaaaatttgaaccgtgccattccatcacgatttcttttatctccgtcacactttgtgtcaccgcatcttcattctaagtcaatactagtcgtctttgtctccaagtagtaagcccgcaccggaggctggccggcgagctctgggaaggctaggcggtggtcgtgggtggtgatgactccatgcaatggtcgtggacggcacttgctgctccgcgcctatcccttcctccatggcgaggctgcggccagaagacggctgccttcgactatgacgaggcggaggtggaagtgctcctccacgcggcgcagcagatccccttgatgctgaactcatcggctgcttcgacacgctcatgtcccaaccatcggatccgaagccgaagcggcctgatgctctccccaccgccaaggcgggatggacgaaatggaggcgtgttttgcagcgttgaagggggcggcatggctggagaaggaggagacaagatcatggttggcaagctcgggaaggaactctgcatgcgggacaccgagctccgcgctatgcacacactagaggagcacgtccagccgaggagcactctcgccgcgctcaacggcctccacctagatctctagcactggcgttgacgggctagctccgttggatatggccggagcgtcgtgcctcgtcatgtgcgtgctcggcctgcaactggagaatatggtcttgtgcggcaagctcgacttcgccgtgccatctttcggttcgagaacaagttctccggcaggagacagcaagggattgaggagagagagctgtgagggatgtggacggaggagatcgtcagtgagggacaagcctagagccagcggtggaggtgcgggacaccgagctctgcgctatgcacacactagaagagcacgtccagacgaggagcactctcgccgcgctcaacggcctccacctagatctctagcactggcgctgacgggctagctccgttggatatggccggagcgtcgtgcctcgtcatgtgcgtgctcggcctgcaattggagaatatggtcttgtgcggcaagctcgacttcgccgtgccatctttcggtccgagaacaagttctctggcgggagacggcaggggattgaggagagggagctgtgagggatgtggacggaggagatcgtcagtgagggacaagcctggagccagcggtggagggatggggctggggacgcgagacgaccatgtgatggggatgatgaaaatcatgatggagtggcacggttctaattttagaagattgtagtggcatctacctggtttcatgaatagtagtgatgttttttcaatacagcacatttgcactggtatggatcaaattaaccattttctttatcaagttaaaatgttgtgtgaacatagattgtttcctttgcaccaactaagaatgcacacaactatatataatttatgagcaccaagattaatttggggattttgttatggtagaccgatactttgtgaaccatccatcttattattctttattgatccgatggttaatgttcatcttacatcataggaggtaagacgtcatctacaaccatgtaaagttaattaatctcaatcttttactacaggaaggaaaggagcgatgtttacttgtgtcactataaaaaaccattactaatacaataagaattaactagtaatttcatttttttattattactagcaatagtacccgtgcgttgcaacgggaaaaacaccatttgatattgtgacaccttgaaaacctcaaataggtaaaaaaaacaagtctaatttgatatattaacaaatagatagaaccgagtctaatttgatgaattagcataggatttaggatttagttttagatttatttttcgagccttcttaggcgtttatccgacggactttaatttaaaacatctgagccacattgtttgataaaatttgcattcggcctaggtcttctcatccggtccaaacttgggctggcccatcttcgtcgagctgagtcaattcgacagcccgcaagctgagcagctgagcgcggcccacatatgcggggacagtccgatgcacttccgcggcccattgggcacagtgtaatcggcggtgccggtctgacgttgggcaaatctgagccgtccgatctaatggatgctccgatcgtccccgtgctagatgaagcgccgaccgggagagaggggcaaaaccctagctcccaaatccctctctcccgatcctatttctctccggcgacgagcgagcagaacaacagcgaaggcagcgacggcagtccggtgagctagtgagcgctcctgcttcgctggctgggtggcgcacccgagggtggtgcaaagttgtgccacggtgttggaggttcggctaggcaagcgcgcaaacggcgctgagcgctgagcggcctggacctttaagattagataagattttcacggacgacgaaagtaaattgaatcaaactttctttttttttgttttatgttttctttcgcccttttttcgttattacagaggacagaaacgattagtagagatagagatagagaagataaagaaatatagtaccatgtcacatataataggattcgattttttttaccgcgtcacatataattctttgtttaatcggacataattcatttttataattgttttccaccctttttttaccgcgtccacggaatcagatttgtttttttgcccggtttttttcacaagattttttttctcccgattcttttttttcgaataggacagattggttttttttttttgcctttcattacacggaatcgtcattgttttttttgccccttttttcgcccggctttttgcccgatttcttattttttaatcggacagattgggttttttttcgcccttttctttacacggaataggattcgtttttttcgcccttttttcattcggttttttttcgcccgatttttttttgcacgaacgatggaaacatttcatattttttaagtagtagagataaagaatcggacagattttttttaattttttttcgtcctttttttaccgcgttgacggagttggattcgtttttgtttatcggacaagttccatttttttccttttttcgccccttttttggatcggacaggtttggttttttttttctttttttcgcccggttttttctggataggacagatttggttttttcgcccggttttccttttttcacctttttttatcggacaggtttggtttttttccttttttccgccatgttttttttcggacaaatttggtttttttcacccgattttttttacggacgatggaagcacctcttattttcttaagttgtagagatagagattaatatttaccagaaccagattacaatattgatttgtctttacttacaatttgtagtagaagttttcaaatattttcggaattttaaggtaatttatttattttcttcactcacagcaatttgaagagatgtttaactatggtctcttctgataatagaatctatgtagaccgtttatcttttctaatccaataaaccgaatctttttatactactacaataatattttttatatatgtagtatagaactcataaatagtaaaatgagcgttgttcaactggttaggtctattttgatggaaccagtctatctgggttcaaattctaaatttgagatggatgctcacatttacggccaattattctttcagtggtaggcgatttacccgtcagagacgtccgtgatgacggctataatctcaagatatatcggtccatttttcggaggtgctcataagggtagggtatatgtgtatgtgttcatagaggtgcgcgcgttatgaacgcccgtgtttggattgtgttttaaaaaaaattcataaattaaaggccacctcaaaggtactcgatgatctatacagactatactcgtataatccactctgaccttcgcccccctatggttacctatttgattacctcattcctgactactgaaaccatctttacttctctcttagcgcaacttccagtggatatatcaaactctaaacaaagtgttttaaaatgtacagtagtactgtggaagtgttctaaaacaaatttagtgatgtaactttcgtatatcgaacactccatgtacaaagttttgaacgtttgaccttttgcattctaaaacgttaatcaaaagaaaaacatacaaacagtacaactatttctaagtatgattgtgttctaatccactaccatatccaccaaattaaatgtgttctcaatattggtccaatttttcaaaatccagagaaacatcacacaattttggcaggcacaagaaacagagtattgtttgtgaagggaattttgttaagggcatggccacatataattctttgtagcttaaaaccctaacttttcccttggaacattcaagtgatcaaacaactggtgacccgatgtttttaaagattggccgacctattttaattcagaacgagaagataacttgtgttgttagctggattataggccattatgcttattaacgataaaatataaaacttttatacatatattgtcagtaacttaacagctagtgttgaataataaactacgaggagaaaaacattaaaatcaacttaaaaacaatagttaaattttaaattttaaaaatcatggctaataagccgaagagcaaacgatacaaagattttgcttgcgaggcatatgatggcacattcgctccttgtgataaggggaggcaggaacaaactttcattagttgtatcatgagacaacttcacttccaatgcatccggcatccctagacaccaagggcggcaagcgagggaaatgcatgaaagcggagatgaatgggacacaagcagttaattaggcacatcgctttcggtttgggcattgtgcgagggccgctctcgaataggcagcctgtgccgttgtctgttcttcacataacacccgttcttttcgatagcaactcgtttattttttttaaagagaatccatttctagctttcttcacctcgcttgattgtaaaatccatcgatcagaactgtctcacttttgtttctttcacggttcaccgtggatcctggctaaaataactaaagcaaattggcgaactggtttagttcaaggtctctgtacccagccgaagtataacagaaaatgtgaaactgcatcctacagtttacaagctgagatgtacttggtactgcagtggtaagaggaggtatttagcttcctcgcaaaaccagaatcccgtcagtgatatgtgtaaactcgaaataatgataaccctattggttagctgattaaactagaaataatgagctgcatgggtcttaacgagtcgagtagtatattttagtgcaaatgataaccccatcagtaatctgtgtaattaagcaagctaaaattaagctgaggtgccgtagctaaacgtaatacttcctcaatcccagtttgatcatctctaatagcaaagataatactccctccaacccaaattaattatcatatatatttattcaccaagactaaagataatttaaatcacatcaatcaggacaccatacacacattctcccacattacatgtatcgaaacatcatgctaaaagcaaggataataatagagctcacttcctactattagggcacccataatggttatctataggctctctacaagagatccatatcagcatattttcctatttgaaagatattaaataaagagagagagatcaaagctatctactaacttgaagatagtctatagagaaaaacgaggcaatgtattagagagctatagatacccatatagacatattattgaggtggtttactattaatctagtctattgctgagatgtacatgttttatagagagcatcttactttaccattgcgggtgctcttagctaatcttaaagccaacacatataatagattagctataaggttggctacaattttcttctcatctctctatgtctcacttatacattaattgcatttgtcttggagcttgtgttaagctagctcttgcatgagagccaacacccttaattttttgttatatctctcctccacataagcttatagtagccttatagctcactattatacttgctctaagagcaagtttaatagtatagcccactactagctctatatcatctatagtcaatgtaatagccaattcatacaatagttgcttactatactattaatatttggttccacctatcatacacacattacatcttggagtccatactgtagctggctatagatctgtagcccgctgctcttctctctctttctttatctctctaaaatatgtttatagctagcttatagactgctactatacccgctctaataacaccatagcatgtacacattctccaatgctgcattaattgtgttccgatgaaatacgagtccatacggttatatcagagtaagtacaatagcaggctataagccagcataactacataacgagaagaaaagagaagagagaataaagcgggctacatatttatagctagctgcaaaatggactccaagacgttgtgtgtatatgagaggtgggaccgggtattaatggtgtagtatatttttatagataactattgtatgaatgggttattagattagctatagataatttggagctaatatttagctatcatgaccaatttgagaaaatttgaattgcattatatgataatcaatttaggaaggagggagtaatggactataaggtaactatatacttatatgaataagagagataataaaaaaaataaaagatgttggctcttatataggagctagctttgcacgtgttccaagacaaatacgctgaatgcataagtgaaagtaaaagagaggcaaagaaaatttaaaaacgcccttatagctaattattatatatgttggttttaaaatagactaataggtggcagttaactctactattaagcaaaagacaccaagactaaggatgctaaaatattcatcattcttaaattaatctttatcggttaaggtgctatatcattttgtgtcccgtagttttactcatgctttaaatactgtatgtcattgtgcaaaaaaaaagttagtcttagttacatacgacgtattcaatgatatatatttacttttgcgcaaataaaagaaaagatacttgttaagagatgatcaaaataggataggatagaggaagtgcaatatatgatttttctattaatccatgatgagagagagatactttagaaaattcactcggcggatcatcgaatctccctaccatcagcccaacgacacgttaatcacacagccaagatgctctcaataatggccccatttgccccacgacgcaaatttcccaacgatggaaaacaaaactggttaatcacattcgcataacaaaccatcgatccatcgcatcacatggcagcagagcgcagcggccggccattggtgaatccggcggtcccccgtgcgggatgctcaaattcatcccagaaactgaacaagtatgtccacgttcatcggcaagtccagattcatagatatttccagattcattgtaatctagtactaaatgtagtaacatattatagttccgatccgtaaatatatctagattcattgtattagtaagtgtcacatctaatactccctccatctagttttgatagacatatttttaaatctgaaaaatttatttttgatagccatattttaatctaatcacttaccatcttaatgattttctcggatttaatgcgtggctctccattcttgcacacaagattggctagatgggcatcgagaaatataaatattaatgaatcgtttgtttacaaggaataactagtagtatatttaaatatatgataagcataattacttatttttgtcattgtggcaagataaaatatgactatgaaaaatagatagatgaagcattatagcaagtttaatagtatagccaactactaacttcaaattatttatagtcaatgtaagcaagttcatacaatagttgcttactatattattaatacatggtcccacctatcatacatacattacacatcttggagtccgtgatctagttgactacagatttatagtccacctctctctatttttatctctttaaaatatgtttatagctagcttatgatctgctgttggtctgctgttgcagctgctcttaagagagggagtagcccccaccaacccctccccacggtgcagggctcaccctcctgtccccagcctcacggcacccttgatccgtgatccgacggcccgatccgtggcatgacgcgcgcgccgggccccacgctgactagaccgccgcatccgaatccccaagaggggattatcctctcgcgcacgaggccgctcgaaccggcgcccgccacgtgctccccccggcgtcgcagacgcgaggccccggagccgcgcgcgccggctataaattctcgtcccgcatctcagcagcgcacagcatcacactccccacccatacgcatccatccaccgtctcaatctcggtagtaatcctcgcggcctcgccgttagttccaccaccgggcgccaccatgtgcgggatcctggccgtgctcggcgccgccgactggtcgcaggcgaagagggctcacgtcctctcctgctcccgcaggcaagcacgccacacacccccgcccgcgcgctgtacatgcacaatatcttaattctcttatccatattttagccggacgcatgcatgatgatcatcgatcacgagggtgatgggtgatgaacgtgccggtgcgacacatgcgtgcgtacgtgttcactgttccggtcaccaacttgtcatgcacccaccggctttaccgctcttgaacttgctatagtgaagaggcgtagggatcatggggggtgtggtggttgttgtggttttgtccttgtttatgtatttttgtctctttgtgaggggttcgcataggaatcgtaaggatatgagacagtaataacaaaggaccgacccagaaaaaaggaacacgggaatcttcgttgtgcattaagacccatgggtttagatgttatttttcgctgttgccgtgatgcgtatacttgcatggttcttttggggacggattggttctttctgaccgggagacttggtccggtgtgatattgtaggctgaagcacaggggacccgactggtccgggttgtaccagtgcgagggaaacttcctcgctcagcagcgtctcgccatcgtctccccgctctccggcgaccagccgctgtacaacgcggaccggaccatcgtcgtcgtggtaagagaactaactcatccatcaatccatcgtcagttcgtcacatgtgacaagagctgtcacgtctatctagtttgctgtttactaaaccttttgtgctgggtggggatcgaattgaaggccaatggagagatctacaaccacaagaagatcaggaagcagttcgcctccaagcacacgttcagcaccggcagcgactgcgaggtcatcatcccgctggtgagaccgaaatccgcccctgcggaacgtaatcaaggagatgaaaacgattaaacgtagctggatgtactgatactgacgttactgcttttcgctgttgtgtgatgtctccaaaagtatgaggagtacggcgaggacttcgtcgacatgctggacggcgtgttcgccttcgtcctctacgacacccgcaccaagacgtacatggccgcccgcgacgccatcggcgtcaaccccctctacatcggcaggggcagcgacggtacgtacgccgccgtgtaccactctgcttcaattcttcacgtctctgctgtgaccggaaccgagagagagagacttgacttgagttcactgatgatgtttcatctgtttttctcgtcttcttccttggctgtcgccgtcatgcacaggcgccgtctggatatcgtccgagatgaaggcgctgaacgaggactgcgtggagttcgagatcttccctccgggccacctctactccagcgccgccggcgggctccggcggtggtacaagccgcagtggttcgccgagaacgtcccggcgacgccgtaccagccactcctcctcagagaggccttcgagaaggtgccaagctataacacactgacgagagctagctaggagagatggccttgtacggtagcgtgatggtgaccgacacctctgacactgaccgtgacgtacttgctctgctccgctgcctttgcaggccgtcatcaagaggctcatgaccgacgtgcccttcggcgtcctcctctccggcggcctcgactcctccctcgtcgccgcggtgaccaagcgccacctcatcaagactgaagccgccgagaagttcggagctgagctccattccttcgtcgttggccttgaggtctgtggctttgcccatagtttttgggacgacttatcttgttatgtcgtcttctctaagaaccatggaaagtgattttttttttggcttgttcttggacgtttcagggttcccctgacctgatagctgcacgagaggtcgctgaccacctaggaaccatccatcacgagttccacttcactgtccaggtaaaatgaaaagaataaaaatgtaggagtagctgtccagtgcaatgatcgacctgacagaatatccagcttgaacagctcacaaaaaataaaacatgtctcctaagcaaaatttcagataattaaagattccaatcagaattcgtaaggcaaaattttgccccaaaccatatctcatatggataacggctgggtcagaaaactgacagaaagatgaaatatttggcctttcttaggatggcatcgacgcgatcgaggaggtcatctaccacgacgagacgtacgacgtgacgacgatacgggccagcacgccgatgttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgcccccaacaaggaagagttccacaaggagacctgccgcaaggtagcaaccgctgacactacaaccgcgactaacagaagctgttgctgaaattcctttctgatgctggcacgaaactgtctctgaattttctgactctgatgtacgtgcaacgcaggtgaaagcacttcatcannnnnnnnnnnnnnnnnnnnnnnnnnnnnnnnnnnnnnnnnnnnnnnnnnnnnnnnnnnnnnnnnnnnnnnnggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcacatactgtacaagcagaaagagcagtnncaatgatagcgtcggctacactggatcgatggcctgaaggctttcaccgagcagcaggtactaattaccgaccatttccctgtgtcctgtcctataaatcgcctaattaaattgacccccgtttactctgtcatttcttcaggtcagtgatgaaatgatgaagaacgctgccaaagtgtacccgcacaacacgcccgtcaacaaggaggcgtactactaccgcatgatatttgagaggctcttcccgcaggtgactgatgtgtattcaagcgttgtacagtacagtgtagtactactacacttgtactagtactaatttggaaccgtgtgctgacacatggtgaaacgcgaatcttgatgcaggaatcggcgagggagacggtgccgtggggcccgagcatcgcgtgcagcacgccggcggcgatcgagtgggtggagcagtggaaggcgtcgcacgacccatccggccggctgatcgcctcccacaactccgcctccgcctccgccaaccacaccaaccacgcaaacgccaacgccaacggcaacagcaacggcaaggccaacggcaactgcgcgatggcggccaacgggacgaacggcgtcggcctggttgtggccaacgggacagccaacgggaagatggaagcataacgctcgaagctggccggccggacggccattgatcgcgctagccgatgagatcgtcgacggccgtgtggtgtacactaaaaaaggataaagctagtactagtaggtgtgcgtgttttctcaccaatcgcccatgacgttggcgcgttctgtagtactacccgtgtacgtgcgtgtttgttgccgctgctgttgtaccgtctccccttgtcgttgtacgtgtgcgagagagaccgatccaagtatgtggagagtgatcgatcactcatccgaactcatccttgaaacgatacaccgtaattaatatatctcctcatttttcgctgtcattatccgtatcctttgtccgctagctgctaccactagtcactagtgggcttgcgttgcgttgcgtgcttgtgacttgtgagagccgagaggctaggctacaagtgggcgtagaggagtcggttccatgtgtccggcacgccggggatgcaccagtggatgcagtcggtgtagcgctgcggatcggtcttctcctcgtcggtgacgaggaggccgccggtctcggtgtagacggagacgtgggcgtcgacgcggtgctccgtgagctgggtgatgttgagcagcgtgacgggggtcctcatcctgcccagcacgtcggacatcacctccatcatccgacggtcggagccgctgcctcggtagccccgctgcgtgatcggccacgtctcgttgtagcacctgattcctccttcccttccccagtcctcgctcctggcacacggtacacgatattttaattacacccttatcaatcatcgagcaagttggagaggatgagtatgaatgtatgatgtgtgtgcctcatgtgcgtggtggagatggacatgaagaagacgcgggtggtggcgggatcgacgttggagtcgacccagttggcccacgtcttgaggcccagccggtacgccacccaggcgtccagctcctcgtacccatcgtccccgaacgatccccacctaagaaagacgtgtcgtgtcggtgtcacggggtgtggggttatttttgcttgttggacggcatcgagatttatcgttcgagtgacgggtggcttacaccgatttgatcctgtagccggtcatccaccagacgtagctgtcgaagacgaggatgtcggcgcggcgccagtgcttgccgtgctcctcgatggcgtcgacgtgcaggacgcggccgcccgcgcccagcgcgatgttccggtccgagttggactccaccaggaacggcgcccagtagaactcgatggacgcgttgtactcctgcgtgcagatttgcagttagccgagagctaattcgaggccttctctctgccggcggccagcgccgtcgtcgtcaagcgggtagggacgtactttgacggtgtagacggagagggtgcggctgcgctccatggacttggcgcccggggtgtccgggacggcggagttgacgaggcagacgaaggagagccactggcccagctgcagcgagtcgcccacgaacatgatccgcttcccccgcagcttctccagcatggacacagggtcaaacctgccatggtacacgatccggtccattattcttcagcaaagtgccaatgttggcccagcccaattacaatggaaaaagaggatactgtggaaggaaagattatagggaatatctttacggccctgttcgagaacccaacggagcggagataaagttttgaattttcatgacatgcttcttaaatggctaaacggtgcgtttcatacgaaaattttctgtatgaaagttgttctaaaatatcaaattaatccatttatcaagtttgtaataattaaaagtcaattaatcacaagttattactgtctcgttttacgtaaaacacttaattttcatcttcaggagattcaaagagagcctacgtcgtttaattgcatcctaaatcgtaataccagaaatctttacccttcatctttgcaaaaccattcaaatcgggtcccatagcagtattaaaggctgctttgactaacatagcttcctagccaacaaaaaataataattaaaagacatgtgggggcccacatgttagggtatgtaacatcccgcctcccccaagccgggtccacttacatctgatagcttcggtcacccatcccaaattgctctaggccaagcacgcttaaccctagagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccgcgcaactgcgacacacgcgagagtcggctctgataccattttgtaacgtcccgcctcccccaggccgggcccacttacatctgatagctttcataggtcatagactgccctcacagaccaaatatcttttctgcacactttgtcctcactcatgtgcacccgggaagaatttcccggtcggtcacccatcccaaattgctccaggccaagcacgcttaaccctggagttctttggagattggcttccggaaaagaagttgcagatatgagtattctattaattctattaagccctaggccgggatgttacagggtatttctatttcctccaaatccaaagcggcggccagcgctgataggaggagggggcagtggcggcaccttgccttgttacggccaagacggtgggagagaggagacgaggtgatggcgatagcatggaccagatccggtgtcgacaacgccctatcgaagaagaggcggcggaggtcggtccgagaaggaaccgacggtggagggtggctgacaacccagaggctagagaagagcgtcgagaccagtgtcctagcgaacggagaaggctgagtaggcgagggccttccaccaggaatgggcttggtggtggaggccgtcaactcgtggcggtgtcgggtagcttggaccggcggagttcctgatagggctggtacgtggagatgaggtcttgcaacccccaagcggcctcctccaaatcggcagctacctcgccttcccacgaacgactcgctggctcccttgcttgccacctattctcctccttggatcaccagcgatccctcgtcgtcgatcgttgacctcccacctctactgcctctcgcagataggctcgccgaccaccatccctctccccgttagcgagcttgaagagagagaaaaggtaggtggggaagagaggagaggtggaagtctacttagatgtgagccccatatatttttagttttttttactaggatgccacatctatactatcttaggacttgagttgaacggttttgcaaaggtgaggagtgaagatttctagtattacgatttatagggatgccaattaaactcgatgtaaagatgagggatgacaagtggacttattccagattatggggaccttggaaagaggcactaggagtatgacactgatgaacttcaaaatgccaaaaaggaaaggggaaaaaaaagcatagctgaataatctgagattataccaaattaagcaccactgaaattagcgcatacggttgcttgctgacctcgggagaaggcagtcatcaagatgccaatcccagtataggtagtcgctgtccggcctgccgttcctctggcaagagtcctgcctgtcaacgtatgggcacgtctggtccgtgtaaggcagtttcttggacctgtcgtacgcccagtacccatccgtcacgctgcaccgggtcgcgttgaacgccatcttcggcgctggcggcggcgttgccgttgctggttcgaccgagagcaccgctggcggcggcggctgatcagcagagagcaacgccgacgtcctcatcacggtccgcagcgacgttctcttcttctccttgtctgtcaccttctccttgacctctgaaaagatcaacaactgtcaactggagcactataacatgtacgctgcagaaggtggagctaggcgcaatgcatggatgcaaatatgcattgcaatctgcaactacgtcgataagtttatgccacagattgcattagtgttgtgagtgatgattagtgatgggtttaccagtgagaccccggaggtcctctgtaaagatgatgcccgcgagagccagcccgccgatgatcgccaccaccactgacagtggggcccgccccttcacgcgcttcattgcgggaagctgaaccatgtgagctcactacgtgcaggcagaggcactgatggttggcttcttccagagtgagctgaggtttctgtgattgcagcttcaggtgctttagtagcagattattggtacctaatggtgctcatgccggtgcaactgcagcaagaaatgtaattaaagtgagggaattatatgactgtactgtcagggacagagctggtgcactaggcacttgctttttaacgacctatttcacttgagtaggagtgaagcaaaggcaatatttggagttgagacagccaaccgaagcgtgagcatcttttactgtatttcactgtcgttgtcaacccgaaaggtgctgaaggatactgctttgaagtagaagtactaggcattatacgtgctaactaatctgatactgttccaacaaattgtgttctcaacgcctgcatcaaaaactgcttattggccctgagccactgagtgtttgcccaactgcttctgctgtagtgggcaggggcagcaagtttcagacctgagtggttcgaaagctgcagatcactaaatcatgctttgcacttatggaagaattgtacgatatcatcgttcaattatactgcctgttcagcgcccgatttatttatttaatcggttatattatgtggtaatgtagttgccttcatgctgtgccgtgtaccactcgagacttcgatctccatccgagaaaagtccaggtttggtccctcaactcaactatggcattgttcgtatggtctatccactttttttttattagagaagggcatttatacccgggcctctatatccaaccagatatatgcagtatttttaaattaggaacttagcctttaaataacccaatctaaatttatttgaactgtcagtacaacccctagactgcatgccctttcacatggtctatccactatacgaagctcttcattgttgatctctcagttcttgaaatcaactatatttcatccttagacctaaatcagggtagtttgtggtgtcacgtggcatctaattagcaattttaagtaaattgtgggattttctagatttcaggcgtgtgaaaattgataaattccatatacctaaagttgtatattgctaagctgaaaattacagatgctgcgaaaatatgtaactttagttcaatttaattttaatttagttgttatatttcgttttactttgttttttattaagtttgaattttgttcaagtagtttatttcgtgtataatattatatgataaaataatttattgtttaacctttcatctaaaaaagaggcatttttttaaaaaaataatgagtaataggagaatgatgagaaccattgaattatcattcaagggaagaaaaaggtggctgaaaattttgaaaaatctaggcacatcaaacgtaaaacattcccataactcgtatatataggatattggtgagaaagaagaaaatgagatgatgttgtcaggtagttttgtagagtttacttcgttttagtttttgttattatctataactatgttgatgtcagtggcgaatacaggatgtaaattgagggggtgctagtgtaaaaatataatgtgattaaaacaaataaagatatatcaactaaagtattttccaatgaataccaaaagcgcatatgatcaaaacaattttctctattttgatttgtgtctatcttaaaatattcataaaaatctgtgaatatattgttttgtatactcagagtatattctattttaccagtttggacagtagaagcagggaggaagcctgcatctttgccgtctgggaattttcttcagtaatgactaactagacttgttaatgattaattaggggcagggattagagctgggtctggcgcaccaaccagccccaacagtggatccgccactggttgatgtcatcactgttcactcatatgaattccatgtaggcatcataaaaaaccatctcagtttagatacagagataaaatgtgaatagttttgagagttaaagggaccagtggtgaatagttttgtagctaagggaccaaacactactaaaaataaaatatttttgcatgcggttgaaacctatttttccatgcggctggggccgtccgtctgctcggaaaggtatacgaaaatagcaattttttcatgcgagtgatgcacccacatgtaaaaatatgttttttacgtgtggatgcttatgtggtccgcccgcaaaaacaaaaacaatgcaaaaaaatataaatataaatcccaaaaatcgaaaatcgaaaccctagacatgataccccccactccttcgccatcgtcgttggatccgtcccggtcgacctactgttgtgcacccttcagtcatcgagagagaagaagccaagcgagagaggaaggagaggcggtgggatctgcgcgatcggaggccgagcccgccgtccccgagcccactgccgctcccgtcgtcgtcgagcccgtcaccgctagatctgctccggccggatccacgatcgacagatctgctagccatcgggattgaagacgatgagggagaggaaggagaggcggcaggatctgcgtagttggaggtcgagcccgccgcagccgctcgtcctcaccgacgtcaccggtactcccgcagcctcctgagccctcgttgccaccgccgctcgttcttgtcgccagcccgagtaggaagtgggagaggagggaagaagttggagagaaagggtggagaaaaataagtggggagacagaaggtgaggagatgataatggaactttggaaaattttaaaatatgctgtaagggaagagaggagggaggtcaaacttgtagataggtctttttcgtatgcggctacttaggaggccgcctgaaaaaataattatattttcgcagaagggcctcctaagcaactgttcgcatgcgacccttcaactaatccccggggaacgatttttgcaagcgagaacggttatgattcgtctacaacttaatgatggtcttgtctagaaaaatcaattctgtagtagtgaaaatcgtcccaaaactatatttgggggaacaaatttggacttatctctgttgtttataggttagacttttggagggagaagtatcgatcatgtatactatgtgttatttatgcatataaggtagtactatatatattatattaacgtacgctcctaggagctataaacgcattgtagttttgatatgatgttcgaccgatctgttggagagatcttggtatgttgtttgcttcgatgctttactgatcgattgggcctgttttacattttactttatgatgggggcctataacatacaaccatcttccaaagttgtgctttaggccggtacaagtatttttttttcatgtgattcttggtcagtgatcaatgatcagcgaacacacagcacttcaactaaaagctaattatttgcaggcaccattaaaatggatgtagtcaccaacagcaacctaatgagatttaccgatttatttataatctttttgttgtttaaacttgtgttgaggcattcacagtgatgagtgcacattcatcttgtatctattccatattatcgtgcgaaactcacaacacagtaaggcaagactttccctattttctaacgccataggccacatatctctaactcagtaggcacataaaaaataacatcaaaagtagcatgacgacaataaattagatagcatgaataatttttttacgagcttctttaacatatatacagtgagttatacttttaaaaaaaaatcgttgtaatacatggtcattatgctagtgttaggaaacaaagaagaaaattgaacgatactacaaatctccttatgagatttgcaggaaaaaatatatatatacacaaacttaagacaacatacttgacacgttctttcatattatcaggaccaataatcataacatctcttgatcaacatcaaactaaaaagtattctactggtacagttactacaatagtggaaaactcggatgagtcttctctgaaatgcccattagtcgtagggctcacatatcaaccactaaaagttagatatagagaacgatacataattagaggatccatttccagaaaactgcgtgccccttgctgcattttttattagttcaggtttgtgattttctttggcaacgaaaagatttggccattgccaattctccttttcgttgtaaggtgcatgtttggattattgcatttcttttggatatggagttgctgatattttgtttggtgttaaagagatactaaaattttggttacaaaccaaacaaatatatatatttttagaaacaaggaacaaaacacatcgtcaggtatccggccaatcgaccatgacacaaacaacgtcaaacgtagaaatgatcgaagattcggaatctggttagctggggcctaaggaaacaacgcttcaaatctacggaactggtaaagtaaaccagacaattattctctctctagctaactaattcctgtaggactgtacccaacaaaatagataggtcaaccgaatgatcaccagtgcacgtacttactccgtacaaggtttagtcgatcttgatgacaccagactcattcgatctcatttagttgctgttgctactactcaacttcagtctgcagactacagtacttcactgtacctcctacttgtttgcttgtctcagcccctctgtttagatgagactaaaacttttaaaacttttaagttcatatcatatcggatattttgatattaattataaatattaaatgtagactattaataaaactcatccataatcttggactaattcgcgagacgaatctattaagtctaattaattcatgattagcctatgtgatgctacagtaaatattctctaattatagattaattagacataaaaaatttgactcgcaaattagcttttatttatgtaattagttttgtaaatagtctatatttaatactctaaattagtgtctaaatataaagactaaagttaagtccatggatccaaacaccacctgagttgctagcgaataaggccgtgtttaattcaccctcaacttccaactttccatcacatcacatcatatctaaaacttttctacacatataaacttttaacttttttctaaactttcaactttccctaaactttcaacttttttcagaaactaaacacagcataagggtagatggtaaatcttactcaggtgctgacaaattgactgatcaaatccctgcggatactcccccgtggacgtgagtggcgagacatcacacgagagaatgcgtggtggtatgctcctctctgatttgcatgcgttctgtttttttttctcaaaatacttctctttgttctcctctctctctacccgcatcattggagccagaatttcgcgaaatggttcatccgctgtgtttagatccaaagtttgcctctaaactttacatttttctatcacatcaacctgtcatacacacaacttttcagtcacatcatctctaattttatctaaaatttaaactttagatggaactaaacacagcctagtatttttcttccggaacgcggctcgatttgtgaagtggcaagagagcgcgaggaacccggaaagggagccggcgcgcgtgctcgaatcgaatctctatgaaggccggattttccgttgatggcccaaaatcagcccattattttccgcagcccgtttgcggcgcgcgtgccaggcctgggccgtagtaggccgaatattttgcaactgttgacttagcacagataggtgggccttcgggtgtaaacgttggaattttttttatttttaattttttttattaaaagttttacaaaaatattttccattttgaaaattgacggaagtactcgcctaccgccctctgggaaggcgatttttaaaaatcgccctcccaaagggcggccaaaatgacgtggcagacgggccgttcctttcgggcgacggccgtcaacgaaaattgcaggcggcccccttgccggcctccgcgagggcgattttgtactgtgcgggggcaaatgggcggcaagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctaaataatctcaaatctagattacgtattaccaatgaataggcttccattttcgtgtgttgtgtgctagtgggaaagaagatatgaagaggttgccttcaaattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcatgagcataagttgttctagcaccatatgaatgaaaagaactatgtagacgagacaaacacaagtagtactgcagtagtaatagcaaaagtagtactactttacaagtttgtaagccaaaagaaacggtcacataaggactgaagaggtagaacactactgacgaggcctcttacccctatccctcctaccctgcgccctaatgtgcccgtgggagtacgtgagtcggtccgggggtacggcacggccaacccgtcctgcctgtacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacaaatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcgtaaacgttgtaccgtgcggtagaccggtagttgatcctcgtttgtatttacaatgcacattatttttttcgtttgtaatcgtgaattgatctgagaataatcatgtccgaaaaaaaaaaacaaagggagttcgtagttgaaagaacctcgcgtgtggttattagcgatcaagtcaaatatcctctgttgtgcaaggttatcaaagatgtttagatgtgggtaccagagtcacaattatcagagtatttagcgacagatcacagacagatcatagtacaaccgtgtacactgcaactgcaatttggcagcgcatgatcaatcaatgtacattcttgattcttctcagagtctcatccatgtgtgcctactgtcaccacgcctcctcaccttcactctgaagattgttacaccgagcgatataaaaaaaaacgaaattaactgcctacaggctacagctattggtagaagagaagcgcatagaagagctggttccacgtgtccggcaggccggggaggcaccagtggctgcagtccgccgagccgccgccggggttggcgcgctgcgccggcgagaggtcgccgctgtacaccgacgggtgcgcgtccttgcgcagcgccgacagcgccgagatgtcgaggaggcgaacggggctcttcatcgaccgcagcgtggcctgtatcacctggtcctgccccgacgtcgcctgcgccgtcgtcgcgttcagccccgccgccgccgccgccgccggggccgtctcgccgtagcagttcttcgacaccgggttggcccactccttcgagctggtcgatcgatccagcggcccacggcacagatcagaacaaaattagatcgcgttgtcagaaaagagagtgaaatacaatacaccattgccacatagtacgagtgtactactgtacacgtgcacgcacatggtaaggtgtctagtgtactgtgtacactgtagagagagatggggtgatggaatcatgaggttgagatgagaatatgagattggctcttgtgagatttacctgtagtgtgtgggggacatggactggtagaagacacgggtcttggctggatcgacgttggcgtccacccagttggcccaggttgccatcccgcgctggaacgccaccatccggtccatgtcctcgtagtaccgcccgtccgcgcccatgtaatcccacctgcatacgtgaagtgaaacgaagctgaagaggaaatctggcgggtgcgtgtggaaaagggcgcgtatcacgacgtttacaataccgtctaactagattcaaaacgatcagaaacgatttgataccgatactgtaatttttgttggaccggagtaaatatcttacaatacatacccctggagcgtgccggtgtgcgtccaccagtggccggagttgaaggagagcacgtcggcgccgcgccacgcctcgccgttcccggagatgtcgtccagccatagcaccttcttcccctgagccacgccgatgtccaccaggtacggcgcgcggtagaacgataccaccaaaccgtactcctgctcgtatacatacgtacgtacgtacgtacttaccatgagtacatctatatgacatttgcagtaagatcatgcaagtgcaatagggaaattaaatacgtacgtaccaggaacttgtacgtgtagagagggtcgacgagacgagctgcgccggcgactgcggcgccgcggcgtgcagcaggcagatgagcgactcccactggttccggcccagcgagtcgccgacgaacatcaccgtcttccccttcatccgcgtcaagaagtccgcgccatcaaacctatagcaaaatcgcgcgtcgatcgctgcagctaattcgcgctctagtcgtataatatgcgttacctgggtagctcgcagccggccggcttccaccggtaccggaggtagtcggagtccggccggccgtacagctggcagttgaactccgcgtcgatgaccgggcagttgtacccggtgtacgccgccgcgccgccgccgccgtcgtcgcggacccagctgccgctgaagacgtcgcagctcacggcggcgtctttccggtggcggcgcgctagcccgaaggagagcgccgaggccggcagcgagaaggcgtgaaggaggaggaggaagacgatggatgtagacacggcgacggcaagaaagccggcgccgtgcttgcagaagagcggcatcgatggcgatgagaattggaggaaaggggaggcgaagccggcctttcccccggccgctttataccgccgtacgctgacgattatgaatcgatcacgagaccagcttagccaagattaatcgtcctacaattcctgctgtcgcaagcaagagaaaaggcaatatagctgccctaattattttgctgtgcgatccaagcaaggaagcgattaaccgattagcagcagctcgtggagaagaatattatcaccaaaccgatggattgattttttttttatcagcgcacggggcagttcacgtgaggggttttgcagatcatctttgtactagttcgcgtagctaagattggaacctgagcctcatatatttggattcgttgccttcgcggctttgccccatggtgcacgtagacggtagacgtacagggaaaaggtttggttttggaattcgtgttcgcatcaatatggaatctgtggaattcgccgggtacgtttatgtttgcagtttgcacgtagcgtagtgtcctagtccgtctcagaggcagcaaacctggggtgacaaaaatggcgcggcagaagtgaagtgtgcgtcaagacaaaacgattggctggagccttggatgtacatggagcttgtccatgtcgttaggcccagttcctgccttggccatcggtagtatatcatgttggatgtcggatcgggccaaaattcagaagcagcggcggataaaaagaacctgtgtgtgtgtggtatatttagcagaacagagtgtctgctagcaaggttgcaggagtaattaaccacggtgattcgtcccctgaacaacgtgacttgattctcccgttcctgtgctctttagatataggagaataaagtgtggagaatatatcttcttgggcgacgctccggtgctttctacttgtagtatatactacaagtagaaataatccaaaccgtcgatttccaagggcatattagtactatgttaggactacagttaggggtaaacttggtattaggaaaatattcgtgatttttattacgtttcaatcttgtatcgcatcgatccttcgctaactttagcactattgccgttgttgccctatttcggtagctctcagccggcgttcatcactgtcgcaacgctctgcttcgctcatgtctgcaggcaatttgtttggtaaatttctcacatggtaaatccttctagtattttggtgcgactccttgatggtattttcgtgaacgaaaatcttctagacttttttctagggaaaattttgctacatgacacttgttatgtgtgattttagcactaagacactgcccaaacttatttttgggggaaaacactccataaacgtggtaatttgccagtgaacaccgcgccgattaaaataatactttccggttggggaggagagagaaaccgcgtgaaatgtcaaaaatgcccttgggcccacatgtcagctctatctcctatctctctcttttctctcacaaatggcgaggacggtggctggcggtggcggtggacgagcgtgcggccgctggagccacccctcgccgtgcccgtgcccgcagcagaaaggggcgtcaccgccacagcgggggagggggacgcgatgtaaagccggcgagtttcggggaggacgacgtgaagccaagcgagcacgaggcaggggaaggaacgacgagtgggaggtgggccggctacggagaagaagctcgttggcggccgcgcgagcaagatgcacgggagggacaaatgggcgagaggatggctggctgcggaggagaagcttatcggcagccgcgcgagcaagacaggggagggaccgacttgtgggaggatggccggctacggagaaaaagctcgtccgcagccacgcacacggggaggacatgac

SEQ ID NO: 70179 - DNA, 9925 bp, Oryza sativa
cttcgagcttctgccgcgcggcgccgtcaccgcgcggtccgagggccccgtgccaccgcatgcagaggccatcgcctcctcctcctcctccttgagccactggaggtcggcgtgcacggcggctcgcagggcagcggggcatccactgcggcggccgccaccaccacgacggcatgcgccatccccgcagcgccgacgaaagaggaaggagatggagaggggaagacgagggatggaggggaatgggagggagatcgaaggggaacacgtggacgcctccggtcgcgcgccgccgtgcatgccgaccgtcggcgcacccccacgcggcgccgcacaccgcccactgtccccgtgccatcctgtgcgcttgcgctcgagataaagaaagagagagatagaggcagtatgaagaggaggagagaagaagagtggttgggctgacaagtgggtcccatgtcttttttatttgttttggctgactagactgccacgtatgcgtccacgtaggaccaaaaccgccctggatcgacttaggggggtaattcgtccggtttataaagtttagggttaaaaataactggtattggagtttaacggggtaaatcggacgaccgcaattgttcaggggtaattcatactttttcctatttattattaatttggtggtcatgttattgtcagccgccatattatttttacagctctattgtgtttgacccacattatagctcagcaattagattaaaaaaccatccaagtgtgttaacaaatttgaaaaacaacaccaaggtatttcatgggcctcacatgttatttaattttttttgacttggatgtcacgtcagtgaaaacaaccatatgtaaacatgagttgatggttttgctatgatggggatgaagatttttggtattgcaatttaggtgagggacgtggagtggacttattcctattatatacaaaagcttaataagggctgctggggtcattttctccacatcaggtttgctcgagtagagcatttcgctgccaccaccggtgccggctgctcctccaatgcccaccgctgccagtgaactcgaggtatgtggttcgagtgtccattgtagaatgctagtatgtggtgcggccgtgtggtccctcttctttgctggttacgatgtgagatcgctttgggctcttggtgtctggttgttgcacaccgtgtttgtagttatgcttcaatggaccaacagaggaactttcgctgtttctgtgaaatgatgtttctcagctcagaataatgtatgtttgccatgttagtaatactgtgggtcccagcatcacgtagtagtaacttttgatacactccacagtgtttaatacctactatggtaaatcaggtagatgcgccacaaacaaaaatcattgataccaagcatcaacagtgcacaaataatatattttacttgcttgttgccggtagtaagtatactatctggtagcttttactacgtaccacaatgtataactgctgggtacgaaagaatagtgtttattaccagcttttccactacatcgtggatgtgttaacaccaaaatttgataagattctttagcggattcggttaaggaatgagcgcaatcagctgatgaaaacttattgttggtatttcttaacgacattactagaaatataattcccagcaatggcgcataaatcttctgctttattatggttatagagttcatctgcaagcacacggatataccattgtagcatttcacccgagagaattccaagggtatcgtatttattttatcctgtgggaagatcatgtagagagaactcgactaataatttatatattacttgtgataatcatattctaagcaggggatgagataatctaaggatagagtgacacacaagcattaactactcattctcataatatattatctaagctaagtggatagaaaagagaaaaataatctaatcctatacttctaatatacatagtatacatacattctagttaactgatatactagccaataccctctatccgatgccctcctggtacttcgagaagccacccctgactaccgagttccttacgacagcccgtcatgatcatacaaccggggctaaatacggaggaatacactccccagggaattaacttaggattatataccggcggcgcggaggaatacccgtactgagctatcaccatcagcagcccacctctcatccgtaatatataaccccaaataatgatatcccctaatctagacaccacgtctaaactaccagatattactctaatatcatcgtcatgacatagagtaattacataagcaaacattatacccgcaccaaagcatctcccagataagctagccgtatattcagtataacatgaacataataatgtaatgtaggtacttatatactcggaaagtatttcaataccataaatgtatttagaagagtattctaataaaagtacaaagcttacaaaagagaagagaaaagctactagagccatacccgaactcttccgaagacttttggactcctgatttctactctattcctattccaccagctagatactactaatctaaatttgagagaaatgagagagctattgcttgaggtgtgtgagtgaagtgagaaggtgaagtccttttataggcaggtatgacggttgtaaccgttgtgaaatatctgaagtacaccgcaacagctatcaggacaatatatggaccgtccctgccaaaccccacatccaacggtggagagggaggatcggccgaacctcctggttcggtcgaaccaggggccggcccaacctggcacaaaatcagcaggtggcctcctccgttgcttcacttcatagacttgcaaattttggcccaattcatcatgtcaattctgagttcttggcctattcacacataagtctgattctcgacatcgtccgattgatttatcatttgagttgatgttgattctcctccactttgtggttattctctgcaaaaggttagtatacctaataccagtggaatattattattctaacatatttatggattacaagcatcactagttctcctctattttggtaatattgatggtcgaaactgatcgataacgaccgtcaacacttatccagaagagaccaagttcgaggaggaatcgtgaagaccacggaatgatagtttaattccatctattaattaggcaagatatagtaattttccttttatgtttagaaaatatttatcgagtgtctgatcagcacttgtaattttccttttatcattagaaaagtgtgtttaatgtccgatcgggactcttaacggcctatgggtataaatatgtgtacccggggtcattgtaatctatctccaaagatcaacacaatctactttcggcatatcgccacccttttattttcgatgagttcttgtttcaagttgggctgcatcaacttcgatctccgatgagggataaggcttgttatggcggcttgcattgtcgggattagtgcttcaattgcttgaacactctaattttatccatgtaagacgtcgagttattatatacattattgttggaggcatgtcacgagggccttcgaccggacctgccgaaaccatccaaccgacgaggaaacaagccaggggcgtcgggttcgaccaaggcaaaggcatatggcgaaagccatgtggtgaagcatgtgggcgaagaccaaagccccgtatccaaacttcgcaatcgagaggatcacatgggcgaaaggcacatggcgaaggttatgtggcgaagcacgacggcttcgcccaagctggaatctatgcaaaggaggaggactagatggctgctaggcccatggggccccgttcgccatgactaggccagcctaattggcacattagagcccataagtgtaatagacactgtgtgcccttactaatatccctataataagggtatccatgtaaattcccctgtacaatctaaaccatagaaggtgtaagcctgtactaaggctataaatagccccctagggcaatgtaacgggggatcccaaatttttttttcaagtcaatatattgttttactgttcaaaacatccaaccaatttccttgttcttcgacgtgacgcagttgtcattcgacaacaattatatataatctagattgatagcgttttcttcttgcatcgaccgatctccatttagggttttgtcgatattggctagattactttttttggcttagattatataatgtttgcaccaccctgaaaattagtcaaaggcttgattgtccagatattatatttcttttcatacttagtgttgcatcagttaagattgatctactaagtcgtgcttagaaccataatctctagcttgcttcttaattgccaataagggttttatcgggtttcagccgatgagttatctggacgttgtatcggcttatatggattacatccaagttggattgagccgattgcagcaaaggtttcattgattatctaattgtttggatttaatgacatcggacctccagccaatgtatgttttaaccttcggattagatcagtgcttattccatcatatcgttattagccgattggtttatactggtttacattgttctgttgttacattatcattagccaactgtttctatatcatcatttactcaagcattagaatatacattggatatatagccaattatttcaaaaccctatcgacatcggctttttgatttgcaatctatataacttgtcagttgcaggatcaaattgactggcacgcccgcatctcatcaatattttggacctgcactggagctaagcagatctcctaggccgttgcgttcgtcgacttaattcgagccaacatagatctggcaccatcggccaagcgtgaatttttcgtcaacaggattcccatcattttgcatacttttggtgtaacgtcccgcctctcccaggctaggcctgcttgcatctgatagctttcataggtcataaactgccctcacagaccaacacaagtcttttctgcacactttgtcctcactcgtgtgcacccgggaagaatttcccggtcggtcacccataggtcatagactgccctcacagaccaacacaagtcttttctacacactttatcctcgctcgtgtgcacttggaaaatttcttttctgcacactttgtcctcactcgtgtgcacccgggaagaatttcccggtcggttacccatcccaaattgctccaggagccaacatagatcctctcccaggccgggcccgcttacatctgatagctttcataggtcatagactgccctcacagaccaacacaagtcttttctgcacactttgtcctcactcgtgtgcacacgggaagaatttctctaggccaagcacgcttaaccctagagttctttggaaatcgacttccggaaaagaagttgcaacttgttgatatgagtattctattaatcctattaagccttgggctgggatgttacatcctcacccccttaagagagatcgacttacaaattgttgatatgagtattctattaatcctattaagccctgggctgggatgttacatcctcagccccttaagagagattgacgcccccgtcgacgacgggggggatgggatgttacatcctcacccccttaagagagatcgacgccccggtcgatcaacccgatgggggggctgggatgttacatcctcacccccttaagagagatcgacgcccccatcgatcatcgacgcccccgtcgatcaaccccggccaggaacgttctcttggccacgtccgtgtgtccagtgccaacgtatgtatcatgctgtctgaccactccgggtccacaccagccatgcgcaccatgcccactttgtcctcactcgtgtgcacccgggaagaatttggcaccatgcccactttgtcctcactcgtgtgcacccgggaagtgaagttctttataaattggcttccggaaaagaaattgcaacttgttgatatgagtattttattaattctattaagccgtaggctgggatgttacatttggtttccaactaccagtgtaagttgagaaataattagcgatattggcttattagatatttctctgtcgctgacagtacaagtgtacagcagcaactgaacaaagaattactacatgtaaggtaacatttgacagatctttgctttgttccaagtctaatttttataagtgatatgttattgtacaaccctcgggtgtgtccaatttttgttttttacgtaatggtgttatcaacacaccgttgacagcccttaaatatcattgggaattttttatgtctactactcggattgcagtggtgcacatggatggcttgcgtggttctagccgtcagaggctgtccttggtctcatcagcctcagccaatcagtcatcaatttgctttatgagcccttaatgctcctgctttactcacctgcatcttttgtatttttgtgtttcaattctggtataactctcatttcctaacaacttcatctcttggaaatctgacctgtgcgcacatttccaatttatttttttacccaacagaattttagttgagttaaaatggtctcttacgtaccataagcattgcccagtgatgatggttaattgccaatgcaatcaagatcattagtgcattgcattcaaattacaaacttgaagtcgttccaaaatccatgtagtcttattgaaacatatgacttacttcagctcctggatcttaaaactgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcctgggcagggcaggcggcgcgcgtgcacgacgtacgcgtcgaatggtccgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacattccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttt

SEQ ID NO: 70180 - DNA, 2704 bp, Oryza sativa
agcatgcggttgtgccgcacacccccctgaacgcgtagatcaccgcgtgtgcagggatgcatggtatggtgttgcggacttgacagaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgatggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgg

SEQ ID NO: 70181 - DNA, 2284 bp, Oryza sativa
ccccttttaagagacccacttctttagctctcttaattaacaaagcaagcatatcagctactatgttaaaaagaattggtgatagcagatcccgttgcctaagacctttgtatgtttgaaaattgttgccattttgatcatttacttttataccaacatgaccaccttgaataaaagaagctatccactcacaccatttaggagagaaacccttcaccctcaacgtttgttgtacaaaggaccattttactttatcataagctttttcaaaatcaatcttaaagattacaccgcttttgtctttacgatgtaattcatgcatagtctcatgtaaaataaccactccttccataatatttctacctggaataaaggccgtttgagtgggactaataactttttgagcaactcccattattctattcgttgcaactttggtaaaaatcttaaaactcacatttagtaaacatataggtctatattgttgaatcttaatagcgtcaacacacttaggcagcagaataattgtgccaaaattaagagaaaacaaaggtagagtacccctatggaaatcattaaaaagctccaacaagtcatttttaataacattccaaaaaagttggtaaaactctgccggaaaaccatccggccccggtgctttattatgctctatctaaaaaacagcctccttaatctccttttcagagaaaggttgcgttaaagcttcattctccaactgagagacttgcgggacatccactattctattctcatcaaattgcagagaagagtcttcaggaggactaaataaacctttataaaaagtggtaatatgcgcttttaaattcgcatcaccatttattatttgatcgccatcctgtaattgaaaaattctagttttcctatgctttccatttgcaaccaaatgaaaatactttgtattagaatcaccatccaaaatatctttagttttagctctcagataccactttatttcctcttctctcagaattgaagaaagcctattcctataaaaccatctaatatcaatttcctcttgagtcaaaaggacattttctgcctttttatctagcaatttaaccttatccaataaatcttttttctcttttttataatataccactcgtgtgcttagcccatcccctcaagtgttgccttaaacgacgtatttttgcttgtcagcgctccataggagagtctccttcatctacactatcccaaacctctctcaccatatcaacaaaaccctcacgtaaaagccacccaagttcaaacttaaaacaaggttgagcattactttgagaagatgaatttgtgtttaaaagtaaaggagtgtgattagaaatatctctgttaagtgcaaccaccgaggctaaaggaaaattatgttcccactctgtcgacattaagactctatcaagcttctcataagttgggtttgctaaattatttgcccaagtaaaatttcttccagacatctgcaactccataaggcacaacccatcaataatagcattaaaaagaaagggccatcggtcatcaaaattgctattacttttttcattagggctgcgtaaaatattaaaatcaccaccaataagaattggtaaggtttcacgagagcacatattgactaattcagcaagaaacttatccttattctcgttttgagccagcccataaaccaaaactaaggcccatttaaacttgtcagctctattacataaatgaaatttaacataaaaatcaccctcatcaattaaaccaacatcaaaattaagtaaattgatgcctaacaacaaaccaccagacctaccactaggagccttacaatgccacaagaaatctttaccagcacaaaggtttttaagtgtgcccggagcaaaatctttcttaacagtctcagacaaagcaataaaatccaactgatgttctttagttaggtcagaaataaatttgtgtttttttgggtatttgaacccatcacaattccaaaagatacctttcattaagactattttttttccttcttatttttaccttttttcccctttttcttggagttagaaggagaatccctagaatctaaggtggtctgaagacaattatcacagtccccacctgaatccattacctcctccataatttcactacataaatgttgcagtaagaaattatcatcaaaatgatcatctactaaatcaccatcaacattattggaaaaacctttagtagttgacaaccgtacatgatcacttaatct

SEQ ID NO: 70182 - DNA, 15750 bp, Oryza sativa
atgcaaagttcaatgctaggtgtgtgtcaaaatacgctttgaattatatggttactaagtattatatttgtatatctttcaacaataggtatgggacatggggtatatgctttacctatggggcattctttgcaataagaggactaattgctgctggcagaaattatgagaacagccaagctatcaggaatggatgcaagttcctattgtcaaagcagcttagtgcaggtggatggggtgagcactacagttcaagtgaaattgaggtaaatattaattttgttgtaacctagttagtttaactatgtaaacactatgtaagttagtatgctgcaatagttatattaaaattaatggttagagtggtatgaccaactttaaattaaaaaaacagtcggtactactatataaatgaatatgtttagtacattgtaacatagttagtttaactatctaaacgttgtataagttagtatgctacataagttataaaaattaatggttagagtggtatgaccaactttaaattaaaaacgcagtcggtactactatataaaggaatacatttagtacaccaacctttttatatgtacaaaactagatcattatctccccttacaggtgcccccctctccttccctcctgcgcccctcctttctttttctgtttctcgatcactctccactctcgtgccccctcctcccttccatttttccttctgttttctcttttctcgatcgccctcccttctccttttcttctcgcccttctctctttttttttcttctgctttttctcttttctcgatcaccctcccttctccttttcttttctgctttttctcttttctcgatcaccctcccttctctcttttttttcttctgctttttctcttttctcgatcaccctcccttctccttttcttttctgctttttctcttttctcgatcacccttctcttttttttcttctgtttttctcttctctcgatcgccctcccttttccttttcttttatttttcttttatgctttttctctttacccttttctttctgctttttctcttttctcgatcaccctctctcctcccgcacccctcccttctccttttttatatttttctcttttctagaaaataaaaaataaattggtaaattcaagattcgaacccatgatctcatagttcatagtatgttcctctaaccaatccataaattgattctatttgttttcaggattattgtttttttatctcactttgtgagaaaggaaaatggtgatcgattctaatctctttcactaccatcgtagaacaaaatagatatgttattatgaaactcataacacatgttactatgttccaatagtaaccttattgtagaagtatagtaacacgtcacgttactgcagaagatataagatgttactgcacttttggtagtagcatcgtggtgaaattgtagtaaactaggaaccgaaacaaaaatgtatggattaaaaatctcacatgctaaacatacttgttactgcacaaaagtagaagtgttactgtttggccgatacacgttaccacatgtttatacagtcacattacccaaaaattgcagcaagacacgttgctactacaaaacttattgtctttacaacacttttacattaacatcgtgatgggattgtagtaacgtacagcaagcagtactaataagtaatgctatagtattactatctgtgcagagtcaaattccaaaaaagctaagctttgaagaacaatatgtctcatgtgatatatcatggtagcaaaaaagtgtttatcagaagtagatctgtcatgactatatttcaaatatatttgagtgttgttacaacacatcaaacagaaggttactgcacgatggccatcgtgttactacatagttccgcgagattagagctgagaaaagatgggtggttggcggagttagcaggcgggttgactgaggtgggaagtagtgtcgaatagttttgctatatatagttaatgccccagttaattttactatatatatatatttatgtgcttagtttgagttcatatttatgtctaccattactttaacaacgatttcaaacaggtctatgttgatagtgggagtcctcatgcagtgaacacctccttggcaatgttagctttactttactctggacaggtctgtttgtcaactgttcgtttgatttggcacaacaatttctcatattcatgtgattttttaaccattaatgttatgaatagattgaacgagatccaacaccattatatcgtgctgcaaaacaattaattagcatgcaacttgaaacaggagagttcccccaacaagtaagttttgggatgatattaatgttctgaatgcacttttataagatggattgtacaatttaatttgtctagttagcagatatttgttcgttgaatgaaaaggaatggagttgcagagtgttcaccactaattttttttctctagatggagagcacaaaacacattaaaataacaaaattgaagtacaacaaattttgtatatcgaagtcctagataagaaagtagaaaagtagagtaggcacaaatcgtttacaaaagacaaaatgcatatgaaaaaaaagtttgattgaactttccgacaattaaattgattactagcattgaaatatgctcccaactcatatatttgtgcaacttgaatgatcatgtgaaaatgtataaatggctttccaacaaaaagcaattttcagatgtaagcttcgcaaaaagtttcatccagtgctgattttttttgccaaagctagcacaaactcataaactagtttttaagtatttttggcttaatatccatcttacttgtttatatttggctttgattgaaggaacatgttggatgcttcaattcttcactttacttcaattacccgaactaccgcaacttatatcccatttgggctctcggagaattctggcaccgacttgttgcaagcaaggactgaagaaggcagccatgcacatacttatgtgatgacaatccacactacatttgttctctacaaatttgtgcaattattgaagagtgcagtatagaaagtacattgcaagttatggcgattattgtatgaacacaatgttaccctaaaaaatatcaaatttataagcaccaaacccgaagtcacatgtgctgtaccaaggacgtagctctgaaataaataatttgttactgatagaaccattcgtccgatggaagtcttgtatacaactagagaattcatagtttgccaaaattatgacgcataactacatttaattcatagttgtagttcaaaaagttttagtgttgttttcattcatactagtttaacttttgatatatacgtatgtaatgatgtttcccagtctagaagtaaaaatgccgctttcatcacatcctgtggttcctatattagagaagaaaatgtgctgaaggcagaaatacagagagaaaatagacgcaaccctgcaaccaaagccatagggaattacatatagtgatttggtttcttgtgtggaatataggcagcacgagcagatcggcacttctccatcattccacatctcctgtaaatggccatcagagagagagagtgtgtgtttatatatatatatatatatatatatatatatatatatatatatatatatatatatatatatatatatatatatagacacacacacacatatgtgtgtatgtagctctgaacgattcggaaatccgcagtcattagatatagttatggttgatgttgctgtttaatatctcgagcagtgaaggacctaattataatattgagatatggtgtgagcaatcaaattagtgaggaatggagaatgacataacaacatacagacatgattgacaaatcagaagcagctagaagtgcatagtggtggaggcggaggcttgtctctcctccaggaagcagggttcagtggcgcacatgcgaggtggttgggcgagggagatgaaacatgagtggagcggcaccatgaccacacgcgacgctgaattctagcagcgagcatcacgttcaactctatgcacgcctttggagttggaggggagagggtgagaaagaagatggaacagctctcccccgcaaggcccgtcgacatggccagcttgcattgattacggcgccgctacaagaggacatccgtctagcaagagcacacatagttgttcatgaggttttggttagggggcctcctagacaacatctcgagggagaaaagtgatgatgagcactgacgccgccgtctgtcgacatatcaaggagaaccaagacaaaggttttcacccgacagcccacccaagagagagggcgcggctcgacaacgcccccaaaaggaaaaacgattcctcttgagagaaaagcgatgatgagcactgacgccgccgtctgtcgacatctcaaggagaaccaagacaaaggttttcaccctacagcccacccaagagagagggcgcggctcgacaacgcccccaagaggaaaaacgattcctaaaacgtcgttgttgccggcccggcaatactgggctaggttttacatctgccgcctactcctgacgtcccacggttaacgcaccaatgcttcactaccgacggtactctatcggcacgtggtcacagctgaagtgacttcgctgcccccccccaatatatttatttcacgattatgggaaaagacaagagtatacacatcatatgcatacactcgtaaatatattcctaaccagtattcacctagacgctagtcggtggtcagttgaagactagtcagttactagtaggtgattctaatatatccaccaataaaattttgcacacacgtagctatctatttgatatgttactgatgattaaaagaaatataaaattgaggtttcataagagactcaaggtgaatatctttgaagtgattaattaggtattttaaaatattctaatatattttaaaatttaaatgattaaaatatatttgaagtgacttcgaatgtttggacatatgcatgaagtattaaatataaacgataaaaaactaattacacatattgcgtgtaaattgttcacgaatcttttaaatctaattgctctatgatttgaccatgtggtgctatagtaaatatttgctaatgacagattaattaggcttaaataaaattttaaattgaagtcacaggaggtgatatctctttgagggattaaatccattcccgtttaacatgccaatatatttatttcacgattatgggaaaagacaagagtatacacatcatatgcatacactcgtaaatatattcctaaccagtattcacctagacgctagtcggtggtcagttgaagactagtcagttactagtaggtgattctaatatatccaacaataaaattttgcacacacgtagctatctatttgatatgttactgatgattaaaagaaatataaaattgaggtttcataagagactcaaggtggaacgtgattttgacttttgtacgagaagatataaatggcccagaaagttttgcttttcttcaaccgggagtattccagcttttctgaaaagaaaaaggacaaaaacatggactaaagcaaatatatagaagctgattgaatgttttggactttataacttgtctccacacccaagtcgtagaatctttactgattgaatgctatcactcgtcatttccacaagcctaacctgtaggaacaattaattatgtttgacttaatttgtgatatactaaaaggaagcttttgtataaatccaccttataaaatgactaatttccacatcccaattgctcccagaacataaccaatacggggaacaagggaataccggaccatatctgcttttgcgccatgacaatctcactcgaattacagggacctacacataaccccccccccccacccccaccccaaaaaaaaaaaagcttcagcggctcgctgctgtcactgcgtcggcctttcatttcaaattccaaatcaacgcctttcattacaaattccaaatcaataaaacgaagacattttgttccggcttcccagctgagtggctcttgtcagtcaaccaactgaagcccgtgcacccccacgcgttcacactcgctctaatcatctccgcaatcgcgacggccctgcgacctccgcccatggcggctacaactacaagtagcagcagcggcggcggcaaccggatctggacctcctcactcgccgtcctcgcgctcgccgtcgccctcgtctccctcctctccctccgcgcgccgccacctgctgcgcccagcatggccgacgacctgcccacctccgtccacgacatctccgtcaaggtagccatgctacggcgtctcgcttttctcttttttgatactgtctcgtggtttcttgaaagagggtggatgaggaggttctttccgtgattggggctcgatgcgatgtagtctagtgagatgttgcttttagttgtggggggtgattgtttttatctttggccaggaaccctagattgctccttttgttgggaatatttgtaattcttggcggaattggatcatgtcgccatgatgggacgttggatttcaggttaattctgttgttgtcaccgtaaagatgaactttattctatattaaggttagatgggaagtttaccttttctctgaacatagcacagtgtggatagatggcgtcagttctgatagggactttcacatcctaccgatgttattagtagtaattggtttaacattactgtgcgaaatttcagttgaacatacttagtgattaacgctttcctacttaactctttatgttactccgtattctgtttctttgattcggcctgtcagctgatgtttggttcttccaaaggatataaagggaaatgatgtgaagctgagcgagtatgaggggaaggttcttcttattgttaatgtggcctcaaaatggtacttatcagatcagatttcatttatttagtttttaggtagacctaacgtattgctctcggattctcatgaattggaaaattgaagtttatctaagaattaattcattaagttgagctgaacttgtcaaattactaattctttttcaatgattggtatatgtgtgcttgtgacatatatgctcgtttattgggatttagacctcgcatattctgtcgaacataaaagtcattgaagtccaacacacttgttccattgttggtcttctcaccaatacatttgtgttaggcagagtgttgcgtaatgacaaatgctatgtcgtcatgttttctcctctagtgtgggctatatgaacatttatgtttcattacttcacctttactcttttgtagtggcttaacaaattccaattacaaggagttgaatgtcttgtacgagaaatacaaagaaaaaggtatgctcattgccactgttttgaagtttaatcctgattcagtttatctcaaaagtagcttttgtacattcattatcactctgttgtttataaatggcattcaggccttgagatactcgcatttccgtgcaaccaatttgctggtcaagagcctggcagcaatgaagagattgagcaaacagtttgtaccagattcaaagcagaatttcctatttttgacaaggttggtgggcttcacctagtccttccatctttccgtaaaacagtctcttgctgtactatgttattgatttttttcctacaacttggtactattttaagtgcaaaaataaggtgtctacttaatgttcatagctttgtttagattaatgggttttcaatgttcattgctctgtacagatgaatgtggatttcccccctctcaattctagaccaattgtaatgcctttctagataatatttttagatcaatttcatatttccaggaatgctttctttgtgaaaaagatttgtatgtaataaattactctcttctgtaaaacattcaattaattcactatgtcatacggaagatataagaggcaagtgattttaagaataaccctacattgcaaaccaagactgtaacttatcaagttattattgagttgtgtgaactaactggttccctcaaaacttgaagttacttcagaacagatactgttatatttccatatatgtcaaaacaaatacttctatattccaatatacatacttgatgcattgtgaatgcttagattgatgttaacgggaaggaggccgcaccgctatacaagttcttgaaatcacagaaaggtggattccttggtgatggcatcaaatggaacttcacgaagtttctcgttggtaaagatggcaaggttgttgagcgatatgccccgacgacttctccattaaagattgaggtttgaccctctatcaagcgccattcgtatttatttgtttttcttctttgtgagctgatactcctttggtaccctatgcagaatgatatccagaagctacttgggacctcgtaacttattaacacggaacacatatgtgtatgtcatatgttgtataattgtttgaaaattgtctatgttcgtaagaatgtggtttgcttcttttagacgcagaaaatgttctttgtgcattacaactattctggagtaggaattaatctcgatgttgtcaggtgacctaccagggttcagtttctaaagtcggtatttagattaaatattaaccaaagcaaaatgtaggatttaaactgtgataagattttaggcaactagccacaagcctgcttccaacctctctggtttcaaatatttgtcaccgcgtaatattcgccttttaactttaacctcccatcctccaaaaaaatgtatacttaaaaatatcccataataacaattactcactctgtttcacaatgtaagattttctagcattgcccacatttatatataaatgtttataaaatctagacatatgtagaaatgtgcctagatttattaacatttatataaatgtggacaatgctacaaagttttacattgtgaaacggagggagtaatatgtattgtggcataaatgtaaataccactttcacaaatcatagatcatcgtttctacaaaatattagtatatactaatagtccattaaattttcaatgaatgctgctaccccatagtgctttaagaaataaagaaaatatatgaaattccaagaaaagaagaaaacatctaccattgattttgacccattatacgacatgaaaaaaaacatcacgaaataaaataatctaatgcataattagactagatctataacatcacgaaataaaataatctaattatgattagcgctttcccaaaaataagacctatgttctaaaatatcggcatatcaatgtaataatattatctttttatgaaacaaaagaattttaattaaatgtgttatgaaaaatattttgacatgattatatctttaatatttagcgacctacaatattgcaaaactaaacactttaattgtaattagcgttcctaaataacattaccgtcgttctaaactatcaacatgtccaaataatgtttattagatatgtcatgaaaaatattttgacataattatatttttaatatttaaagtgaacacattataaaaagaaggcatcggatgtgttcttgaaaatggtatcaatatgtcttaattaagaagaatagggtgcttctttgtcggtcatttcctctcccatgtttagagtttagatctaactaatcttagtataaagtataaaatccagtttaatcgacccatatagggtttaccttatgtatcaattctacgtcacactcagacacttatatcaattctgcctataaaccggcaaaccgctatccaccaataattgagtcaagaatattggcgagattattgtgtgtaacatataatatccaagacccaatgaacccatatgctatcaagcgataaagaagaacggcaactaactactatacaaactagatgactaccccgtcgcggagttccagacgagattgctattcaatcaggccttcagccaagggctttgagaatcagaaggatctttttcgagtttctatttcttcatttgaaatctgggctcttctatcttcgacttttttttgctttattctttatttatttcatttcgatttttcccacggcttaatacttctctgctcagagtcaaagaggcaaagtgctaactaaactactaaggaaagaaattcctgcagtcgcattcaagtaatgccccttaatttcaccggtttcgacccaaaatgagtaatttcataattgaataaaaacgaggagccgaagattttagggggcgggagaaaaggtcaagtctaagcgacatatggcacgaaaaggcttcaatggctcgatatgaaagacgaccagctctacaacttttggtgttcgtaagaagatatcgtgagaaatagttgaggatcgaactctatcttaaaagaaaaatcgatgttttactaccagccacaagctttatgttcggcacagtactaatactggaacttatgagcaagaattgctctatcaatcaccatctactttagacatatcttctgaaacttttttcaaatacaaaagtccattatcttcctacaaattagtgaattaggaggagctctttgtgcccaaaaaggtcaggtagggcggttcacttgagtcgctcaaccgtccctttgcccggtgctcatgacgcgctacggaacctccaccgtgctagcggcataggagcctactcagcgtcagcggcttcgtgccgcactggagtgatccaatatgtggttccgtctacggaaaattaagttgcataatgtgtataaataagatgtaatttgattatcaaaactaaaacaatttgatataattttgagcctaaaaataattgagattgcatgtttttaagagagaagaaagaagagacaatttggaccatagatctatcatccaaaggctagaaataattggggtgatatggcttattgagagaagagagaaatagcattaactacacttagtggggatgaactatataagtatataggatttataagtatataggattaggtctgtgtatgtcactttataaacacaaataactaaaattaggtcggcaatctcatgaaataaaataaaaaaatgcatcctcgtgacaatattcaaatcaaacaaaaaaaaatacatgtacataacaatgaaaaaaaattgacaaatcctcaacaatatacaccctacatataattaaaaaaaaattgacaaatcctcaacaatatacaccctacatataattaaaaataaccaccgctaatctctatggcatataacttatgtatttattagcccattaaaacatactccctccatccacaaaagttatacctattacttttgtcaccaagaccaaagaaaaattaaatcatcttggatgctacaaaatcaaggagtaaatgtaagcatgcaaccaatgagtatttaaatgactccttgggttctaatcaaacatttaatttatctactcatttaagtcttgaatgcataaagactacaaataggaacaacttatttggaaaaaaaactcaaatgtgaaatttttctaacttttgtggatggagggaatagaatcaattaaataaattactaaaatttttcctatatgaagtaaatacatctatgtattatttatcaggaaaaagtacgaattactcccctgaactatcatggtcgaccgaaatacccccctgaacccaaaaatcaaacgttgctcaccctaaacttttacccccctcgacactattctgagtggttttgatttaagcttgcacacgtggcgctaacgtgttaatccagtcagcaaaaggactccttgggcccagttgtcatatctccccctccccctctctctctccccctggttcctctctctctcctcagcgccctctctctccccggtggcccagtccctctctctctcggacaagcggctgcagacgggctctggcacgcggctgcggacgggtggtgggcggctgtcacacccataaattcacgaactagaatttccaagctgaatatgcattaaacccctatctaggaccagccagggtacacaaacgacaattgttgacatacagatccacgtcttacaaaaatataaaagattacaaatgcagcagaaaagataaaagcgagctaaacttggaagcttgacttctgcagcggggcgactccactccacaggcaatccttgtcagcagcgacgaaaccaacttcaacaagacagctcccactaggaagatcttcagctctggtgtgggggaaaagagagtaagactgagtactacccactgtactcagcaagtcataccagaaaaggaggtacgatgcaggatataaccaaaggaggctaaaggttcttttgcataaaactagcatttaaaagcagtagttgaaagtagtaaaaacaattatagtaattagtaaatattaaccactcactgtcaaacgctacaccacgttacaacatacccaaccaaccacctgaagtacaccagttcattaagctaaactaggggtgagactaatcacggtgaatctagttgatcgcccataaccgcgggcacgactattcgaatagttttactctggctaaaggtgtacaactgtacccacaagacacgattctacacatgtcgccatgccccaaagtatcaccatgatactgcaaagggggaaatcgtgacaagaccctttgcataacccaccgctaaccatccacaccacgctaaggtttcacccccacccctcaaaaggcagtgggaagtcccctcgtgcgtcgcggtgaatccagcagctggacaaccggacaccctggccgacccaactccatcacgcccaccctcgccaccggtgcctaggaaagggtcgagctatactttagatcaagcagttacccactcccgcttgtggtaagaatggtaagtctcccagggtttcccgtgaaccggtccttaactgccatgggtgcgaccagcaaaaccatgcacccacggcccaccattcagtgtattttaattaactaacaccattgcggtggcaccaatccaaagctatgctaatagtcaaagtctatgtaataatgtgatccccagttgtgtactagttgaactaagcatggctaagcatttcctaaaccaacatctagtcattttgatacccaagttatcaatggcatagggtaaacaataaatggctgagtaataggacccatcccatatgatgttgtaaaaggatgcaacatttaatagaaatacagaatgtttgtaaattgggtacaatatgatcaaatgtaatgcatgacttaccttgctctcgcactgatgagaccaaagcaacatcttcgaggaaccgtggattgatgaaacggccaaaatctacgcgacaaacaaagcacacaagcaaaacacactataagactactgaaacaggaagcaaaaccatttttattggattctagggatttttatgaatttactgagacatgaatggacttaaacggagcttggatgaattagttatgaattttagaagattctctgtgtttttcctaataaagaaaatgccttaattaattattgcgcaataaatccccagggctgacggcagcgaggggggacggctcggtaggcgggccccgcatgtcagtggcacaaagggcggccggtctaccgtggacagggaccacctgggtaatccaccgccggtccacgggaccgacggtccagatcagccgggaggccgatcggacggcgtgggcacggcgaggcacggctcggctcggcacaaagccggccggccggccatggcggggtgacggcggcgcgcggccatcggcgacgaccggcggcgtgggagacggcggcggccgtcgcgaaggcggcggcgctgccaaggcatcggcacacacgggagaagaaaggagggggaggggcttctcaccgcgggttggccggcgtgggaggaagacgacggcgaacgacggcggctagcggtgaacggcagggtgcgcgggatggacgaggcggtcctcgacctcgcggggccgatggtggcgacggagtggcgtggcggtgggactagcggcggctagcagcggatggaggcggtagtaggcggcggcatgtggggagagcggtacggtgatggcgcacggcaagcgtgcgtccgccgagatagctctcgcggcagcgaagctagcggcggcgattgcgcggctcggcggcggctagagcagcggcgacgcgcagtcggagagccgcggcagcggcggagcttggcgagatcagcgcgggcgcggtagggaacacgggagggtgcggcgagagcggaaagagggagagttggctcgggggagtgtttttatgggcgcttgaggggtggaaatggccggggatggcccctattttgccggcgacgtggggagtggagggagagagaggggtgaattcgaattcgaatcccgcccatttttgggcgcgcgcgagagcgggaagatgtgttggaggtgggcggcgtgggtgcggggtgcgggtgcaggaggcggggaaggtgggtggcgtggggagtggcggtttcggcggcagttggcgccggggcgtgggcggctggaggtaggggatgacctgacaggtgggccccacctctcagcgttccgaagagaggaggagggggcacgggccggcccaacgaagaggaggccgagcgcgggaggcgaatgggccgacggcccaagaagaaaaagaaggaaaagaaaaggaagaaaaaggaaaaagactttccccgggattaaatattgcacttgctcatttttatttggttaaaattatttatagggctctgaaaattccacaaaaaatcttgttaatgcattagggcatggggaactcaagaaaaattccaccacgccatttccgattattaattgcatttattaattagggattagctctaggttaatttaaacaatttcttgaggcaatttatttaacaatttttcaagaaagaagaaggggaaaacttcagggcgtgacagcggctgtgcgtgaggacgcgcgggggatggctcgacacggctcggctcggcacaaagccggccggccggccatggcagggtggccgcggcgcgcggccatcggcaacgaccggcggcgcgggagaagaaaggagggggagggggttctcaccgcgggttggccggcgtgggaggaagacgacggcgaacgacggcggctagcggtgaacggcggggtgcgcgggatggacgaggcggtcctcgacctcgcgaggccgatggtggcgacggagtggcgtggcggtgggactagcggcggatggaggcggtagtaggcgacggcatgtggggagagcggtacggtgatggcgcacggcaagcgtgcggccgccgagataactctcgcggcagcgaagctagcggcggtgattgcgcggcgcggcggcggctggagcagcggtgacgcgcggtcggagagccgcggcagtggcggagcttggagagatcagcgcgggcgcggtagggaacacggggggtgcggcgagagcggaaagagggagagttggctcgggggagtgtttttatgggcgcttgaggggtggaaac

SEQ ID NO: 70183 - DNA, 693 bp, Oryza sativa
  unsure (1)..(693): unsure at all n locations
cacgcggnnacggatagacgcttnnnnnnnnnnnnnnnnnnnnnnnnnnnnnnnnnnnnnnnnnnnnnnnnnnnnnnnnncggccttcttatactttgagaggaggaggacgctatttaacacaaacgacatgataacaagttgatgaaggccttgtggccgtgggattttgctttccgaacgatgccaaaattccccagagtggaggccagatcttgatgaactgctagaataaaatttagtgatatcccaatccaagagctacagtaacatacatagactgctgaatgcaggattgggtttcactgagggtgtacttgcatgctagcccagtgattgaccctgacaagtactacatggtgacatacaccgtgcgtgcgtccatgattccatcgatgagcgacgagatgagtttgggcttgcggccagacattcgggcacagagtagccgaggagttcactgcgatagattgccaaaaagagagatcttgtcacatggggcgattggttttctctcgccctagccggaatgaattctagtaagcagtggggggaccgatccacatactaggcgtatattggctttcgtatgcgcactgcctgatagatagtgctgtctgacgatggtgcaccattagggtttcatgagtagcgtgcgggatcagaagttgtgcgccatacaacgacagcact

SEQ ID NO: 70184 - DNA, 71465 bp, Oryza sativa
  unsure (1)..(71465): unsure at all n locations
ctattttttttccttcttatttttaccttttttcccctttttcttggagttagaaggagaatccctagaatctaaggtggtctgaagacaattatcacagtccccacctgaatccattacctcctccataatttcactacataaatgttgcagtaagaaattatcatcaaaatgatcatctactaaatcaccatcaacattattggaaaaacctttagtagttgacaaccgtacatgatcacttaatctattttcctccatactccttaaatcattaataacatcatctaacaccacatttggactagaagtaatgataccaaggcttttaatagaagcggaaatctgatcattcgaaaaatgtaaaaaagaaacatcattaattaaattacctttaacatgcagattttccaaattcttgtcagccttcgacttctcagctctttgaagaacaagttgatcactatcacttgctcttcttttactcctcctggatggagagactgctgcctcaggaatagcagagagttttgcaaccagactttcctgagattggactctctcaactccaattacatcatcatgtaaaccatcaaactcttcatcagacagattcaagccaccagaatcagcagtcaagcccacctgaatagaatgtaaagaaggaccacccttctcatagaacatacttccagaacccaacttagattgacttgagcccccagggcctggctccttccccgaatcacccttctcattaccatcatttttcttctcaaagtcaccatcaccaatattgtccatatccattggtataggctcctcaggaccattctcaggttccactctaaaggccaactcatacaaataatccccaataaccacatcaaccacctcaggaatcaaagatggatcaaggactaacacttgtaaccgggcaatgtcataccttctagtaaacaccatatcaacagttttagttataccaagaatggaaccaacggcccaaataattaagtactcccttaactctgaagggatacccttacactgcacccacaccttcgggatcacatatttaacctcattacctacccctctctccacaatctgcatctcagcatcaccaaccttagtatgcactttaccccattccaccatgcgttttaattcagcggcagaaggaaaaatagtgcgaaaagaaccattcccattatcatgtactacccacctccatcctccagggattaatctttctaactcagaaatcacagcattcaccgtcatctgtcctttagacaccttaatcaaagctgctctaggctcatgtttaattttctgaccagctgaaagaggaatatggaagaaacccaaaccatctcctgcatatccacataactgagcagaaggtttaacagatgatcgaaaaatagggcaacgagcaacaatatgatcctcgctttcacaaatctcacaataaaatttagacaagcattcctgcattgtatgccccttagtataacacctataacagtatggcttacccgaacctttcacctcgacctttgcttttcccttgctctcatcaatcggacaaaacaccagagcttgctgatcaacaccacgaacaccctctgacccatgagggaccaatgcaccttagctcacacagattaaacatactggccaagaatattattcgatatgatcatagtagtagtagccgagtcaagtacagagcaaatgcttcgaacagttatttgatgaactgacttggcgagcatccggctccaccaaagaagaaatgtagcccgctgtcatatgaagaaggacggcctacttgatagcagttcaggtttgtcgttcttgtaaaaatttcgctaagattgggagacacaaatttggatgtcgatgaataaattacattcacatctgtgaagaaagcagctcttccctctccttcgtctggtgaatagccactacccatgggaggaaaaggttcacctgttgcagcacttgctacacccatccatccaatcatatttgcagctccagacaagtcagtgaagagctcccccggccagtatcccaccaattcctctccaaatagcaacacccagacatcccatatctatgaatttaatggaaaaagaaaattatggcagtaaacttgactattgcaacaacttaattatttgctgttgcaattaaacagttgctttagatatgaatctttgtactgtgcaatatggagcaatacttttggtagagtcagggatttaccttaaaaattgaaattattattaagtatttttttccatcgattgtggaaattggcttgagtactgctccagggactattctattgctaagctgaataaagcccgcgcaacgaagattagtacatgacttgtctttattagtctgttgcatgaaaaagaaaaacgtgacagttatttctcataaaaatgtgattcactttaatacaatttgagatggtgcttttggtaaccgatcatacccatgcaatctcgaaatgagcgtgattgtcaccgtacatatctggatcaacctgggattgaagtaagcagagttgtacattactaaatgataacaaagcatgtaaaaatgtttgtcataatttatatattgttgagacttagtagttagtacaggttgaaggtgacaacaaatgtattgcctttctcatgtgacgaaaatatattttgttttctgaaaaaacaactttaaattgttcaaattagattctttaagataataggaacttacataccagcctgcacctattcgactttgtccgttttgtattacaacaacagccccagtatatcttggtggtcttcctgtacaaagatatggttcccatactgaaatggatgactgtgaaccataaaaggtagatggttctgtttcaaccgctgccatctagaataaaacaatgaaatggggtatcagtattaaatgaagaataagcatagagaataaagtgtgaaacatgtgatgggaggtaatacaattataaaaccattgttcctacattttcatatcaattggtgtttccagtatcattgtgtcctatgttgttgtggaaatgtctggtactcatggatgacatgtagctcgttaggattggtaccgtcccatagggacactcaattttgcacatatcaatactggagatataaattttagatcctttagcatcattcgtactataagggaaagaacctggctgcatctgcataactcaaaaaaaaatccaatatgtacattaaaatcattcatgcttcttaatggcgcaaaccatgtatcatatgatgagatctataaacaacaagttaccaacaactgggtggtatgattcttcagcaaaagatgcttcaaagatgcctgtgatttgaaattaacacaggcaaaggtttgcccatctccactctaaaattcgaggatcacaccagttttgcattagaacaaactaaataataaaactagagtggtttgttagaattcaatacatacatacatacatacgtacatacatacatacatacatacatacatacatacatacatacctgaaacatcttgacgactgaatggtttacaaactcttcctttcttggctctgcactgaatgttagtgatagcaaagaaagtagtataaatatttttgcagttggtcctctatatcccattgcttgaaagattctcatagaacatgatgctaaaacatatgtgaaagaaactatttatattgctcacatgactctaaatctaaagaaccatatttcttccttcatttatttcaattatgaacataaatgccttttgcttcagaggatgtatatttatgttggtagcagcaaataaatttactgatatgactaaccaataaactgtaaactgaaaaaaaaataatatatgcctccggtaatctttcctctctttatgaaactaggttgttgttcaaatgaattattgcatatgcgttacgacaaagttggtgatcatccacacttgctggtgcgaccattctatatctatgcacgatgatggaatttcgcgaggtattgctattaacaaggtgcaagatgtaaataaaattttttccactcgtatagaactctaatataaaagaaatcaataaattttgaatcatttaaagcttttgcatcatgacgttttgcgtaataccatttggaatctataatagatccatgcgggaaaatgtaaatggattaagatttcccccaagagtttttttactgtccagcaagctggccttgtaccaaatatggtccgttgagtggccatgatcggacggctgacatagattggtacctccaggtaccatttgccctgaggtaccagccaaaggtgagtgaggtggaagggtaaatttgtattttcacattagaaatgagtcaatcgattttgatcctccgtatttggacgaggcttaattagcttttgcaattctacagcggcggtgacggtgctccacctcgacttcagcggcatcggtggtgttcaaggagctgtcttcagtgacagcagggatgttatagtgttgccttcattgtgcttcatgttctccacgatgcatgcctagtgcgtttggaaaactagatgaatactccgtcgcgttggtatggaaaattatgttgcataatacgtacaaataagatgtaatatgattatcaaaactaaaacaaattaatacaattttgatcctaaaaataattgagattgcatttttatgagagaagaaagatgaggcaatttgagccatagatctatcatacaaaggctaaaaataattagggtgatgtggcttaatgagagaagagagaaatagcattaactacacttagtggggatgaactataacaccatgaaaaatttggttttgaaatacgaaattaaaaattcggtataaccaaaaatctttttgaacttccttgcatactggaatttattggattttattttccgttttccggctatgcatgggctaaaggacgaacgtctgagaatatgcatgcattttgacttcaaatattatttattcaaagaaccatgattatgaaatatgttagtatttgcaaataccaaatattttcctgaaaacccttctctatgtaatagatcctctgtggcatattcaatttataaatagggttacatattctaagtttgaatggacaccctctatggtatagttcattaaaacggaaattattttacaaagggaatattgctttgattattgtctgagaatatgtccggtttttccccattaataaagtatttattagaaaccgtatttgtgaaatataattcctaaagggctattttaaaagaaatggccttctcaggtaagtccgttttttcccattgaaatgcatggcccagcgtgcataataggatttgttattagttgtgtgtgtttagctgttgttccaaaagatgtcaattaacccttatttgctaaaaggatgccccctatttgacgtcctttccttatcctccgcgtctgttgcattaaagcgcttcggtactaatcagacctgaagtcgtttcctttggtcgcaatgcgatatatatctctctcaaactcttaccctacgattaatttagaatcaccctatcagttcaaaactcgataatttcctcaaacacctacaactgatcgacgtatttatttattatatgttggttataatatcctcgattctattcctaccgtgacgaatcgatttgtataccacacgtcgtccctaaaattccttttgcattaccgtcgttcgttcgtgcaaagtgctcgcaaataagtcctaatgctaatcctcgcacggcctctttgccaaatcaaatccaaatatcccagtttaaacagtccaactgctgagctaagtaagttcccatctatacggaccaattatcatccaagctaaccaagcctcctacatacagtccaattatacagtccattatacggtccatttcacagtccaaattatacagagtcgaatcaagttacgaattgcctagctaattacaaagtttcctagcaaaatgtccgagtctcctgttacatttggtccacccttttttctgccagcccaactacaacacaaagtccattccaccccccctctcaaggccggcccagcccctcactagcccatgacctgccaaccaatctaagtccttttgtcctccctctcaaccctcagcccgacgcgacacagccaacacgcacgcaaggtgctctgcacaagcacaaatcctgcaaaccaggcaagccagcataccgagccgccgtcttcatcctcccccacaccttccacccgggattcacgtacaaacttgatgccggtcatcaactcgcggacgccgccacaacaacacccagtgcaccaccctcccaaaatatcggcaacccagtgagaggtgaatccacaccgaaaaatgagaaccgaaagagaatgcgtaccttgtcctccctggcggtgtcgacgatccggacctgaccgccgacgtccatcacatccaccgctgctccaagtccactgccccgctccctcgagctctagccgccgccctcgctcgcccatgccgaaagcatgaggcgagttcacggggccgccagcgcaccaccgccgatgtcaacatccggccccatcggcgccgcccatcccatctgcggccgacgctacgccgcttccttggccgtcgctcgcccatgcgccgctgctccgggttcaccgccctcgcatgtacgagctccaaccgccgcgccgtccaccgttcctcgcagtcctgtgccgtactgccgacgacgtcagccgaacagggcagtcggccccgtcggccgagtcacctctgccggccacgatggctttaaggattggtttggtttgtggtctaaattggccttgccaatatttggcaattttaacagtgtttagtattggtttgaagctaaattttggcgtgcctaaagaaataggtcatttcaatagtgaaattaggttgttttggcttcaatccaaacacaactttaccttaccaacattgaccatgtcaaaacttaccaaaatttagcattaaccaaaattgctaaggtcaatttaggtcacaaagcaaaccagccctaaaagccgtcgtttcccactgtcttcctcccttggcctccaagctccaccaccacctcttttgtcgccgtctctcctctatccgagccaccagcgccgccctgactcctcctcgttgcgccggcttttcaccccatccaccgtcaccgccgcccctcccctactcccagcaccactgctcatcctccccttcgcgccggcacgcctggttgccgtccacgacgcccgcgtctgcctcctcgtttccttacaccgcgccgacctctcccctccatccccgccactagcctccccctcccataccgccggcaacctccctcctctccatccccacagccagcatcctttccccgctaccgccggtccgcgaggctcctccggcccccttccttccctcctctgccgccgtcgcacgccgccgcaccaccatgcccagtcgtcgcccccatcgcactcgcgcgtgtggacctgagaggagtggaaggagagagagcagagaggagaaaccgatagaaagaagggagagagagaagaaaagaaaaggaagtgggacccactagtgggagccaccatctggactattcctccccgtgaccctttggccggctaaaaagtacatatgatctccctctactttattcaccaagctccgaacatcaatccttataaaagtctatgttacttcccttttctttcttggccgcgcctatcgtaagatgcaattttttttcacatattttgaaataaagtatggtatactgatttttgttttctccttgataatgatgtctctttattgaatagagtaataaagttccttccatttctcctgttcctacaaattattgtacaaattattacacccacgtaaatgtaaacacaacatatttcatgattagatcatatcggcaccattcccagtgtcacacatagtccctccttgggtcaccaccttctgctcattcctgtacacgtacctcctcgcgaagaatacgtaggacagcagtgccaccacctcgatgatgcagaggacgacgtagaacctctcgagcttgccattgttcaagttggccccatccaaccatcctccgctgccgccattgcctttaccgcctcttcgggtgacacggttggtgacctggatgagcaggctgccgagccacgccgacacgccaaggatgcagtagaagatggagctaccgatggacttcattcccatagacacctcgctgcagaagaactcgaggagccccacgaaggaggtgacgtcgaagatgccaatgaggaagaattgtggtgtcaaccaaaatacagataacgggatcccggcggtgccgtccgcgaggctgctctcatcggcggcagacttcctccttatctccaccaccgcagcgacggcggtggccatgatggtagcaatgaaaccgacgccaatccgctggaggtgggtgacaccaccgacatagccggtgagcctacggagaggtggcacgatgacgcggtcatagagaatgaggatgaccagctggaaaatgattgggatcaggaataatgtcgctggcgatatgtggacggatccgagcttggtgttcatagtgctgccttgctgcacggtgaaggtgaggatgagcggcatagggatgtagccgagaacggcagcggcgaagatgggtgccatgcgtagcaagatcttggtctcctccacctggttcacgctgcacagcgaccatgcaccagcatcattaccagtcctgactgctgctttctccaagcacctgcaagcaatgaaagattccaaccgttactcattataagttacatgtgccaactggtttgactttgtaacttatttacttacttcattttaaattacttatcctccatgtttgtcccaagttaaatttttgtatctttgaccattagtttttacaaattattgtagtctaacagcatgagcattgtatatcataaaagtactttctcttggtaaatctagaaatatatatcttatgatagtaaaatagatgagttcatagaaaatgatggtcaagcattaaaatgttttactgagaacaaaaccaataacatgtaatttgaaatcgagagaatacaaagataaactagataggcagtttatttataaaccactactgtccttacacggtgactcgctgcagctttagaaatggaatatagaaggttgtcacaagtttttattttactactggattccccgggcgttgcagaagagagtttaagaacttcaaaaaatctcgaagaaaacagttttctaaatcgtgatactcttaacgcttgaaagaacaatactttcgctctatagtagttgatttggaattgcaaacataaaatgacacatggatgcatgtataatgtatggtagggatccaatagctatttcttttctagcagatatggctcaacgtatattaacctttatttgcaactaggaaggtagcctgcgcatttgcgcgggcatgcatattattttttttttggaaatagttgtaacaaaagaagttgaaattaaagtaaggttagtttttcatttttaattgaattttcaatgtttactttttccttaagaagtctcgatcgagaaacttttattgctcataagtttatctttttaccatcttgctagccctctttttaattgatcaaatgtacatatcttatatagcgcttctttttaatatatgagaccctacatgatattttttaaaaaagacatagtcaacgtgaatcttaaaataataatttattaggaaaatataacttttaatcatattattataacaaaggctactaattttatattgccaccttagaggcctatacatacaggttgcagagaaacccatggagctactttaaaggatagaatttactgaactgatttagcattaccttcgcctcttggtgtgtttaatatgacttgtacaaagagaaatataaaaattttgaaagaataaaatattatcatgatgtaaagtgggctatgtttttctataacgaagggagtagattgattcaatactatcttacgggttaagtgctccataattagtttttatgtgtaaaagcttgaacgctacattgtgtttcaagcactccactaaaatagttatgtgcaaaaggattgcaaaaattattttcaaagaacacccatgagtctgaggcaagaggctcaccacataggaggctgcacatttgagccacatgtgaaaagaatgttcgcaaaaatcatttgtgtagttgtgatgaaaataattattcatacaattaaaaagttagaaatccctatgtgaaaataatggcacttgtgcctatattattgtttgccaacaatagttagaacttgatagttctttctggtatgtagtaaaattagctagatattttacaacttattattgtatcccgttgctaaaatgcaccagctaattattttctatatgctacatttttaatgggtaccttggtgcatgtcgccgaatcagccttcttggcgccttaacgtcgcccgcgcgcccccgcaccaccatctcccagcaccggagaggaaaggagagggaggcggtgggcggtgggcggtgggtggtgggttgtgggtggtgggcggtggggccgtgggggtttttaataacgcaattgttttctttttgcgagcggtgctctctatgtactttttgctagcaaccgccaacgaaaattcgatttaataactaaagaggtccgcttgcaaaaagacttctactttagcggtcctcttaaaccggccgctagcgaagacctatttttgctggcagtcctaagcacttcatccattgttaaaatttcgctggcggttttcacttatggccgttagagaaaaagaaagtttgacgccatgaaaaatcagttttgtagtagtgaaccgatttaagtaggaatcgatggtcgaatattttgtttttttattttctctaatttaagagtgctatgtagttaattagaaatattcgtatgatgtttagtgatctataaagagagtacggaggaagagcttgctatctagtaggttaatgtctatttatggatattttttggctcaaaaataaaaaacaataattttagttatcatggaaatataaaaaagaaaggaatagaggaagattaggttacgtacattcatgataatgccgcacataggcatggacagagggagatttttcttaagatagatctaacaatttaaaataatgggttcattatttaaatgaaaatcgatgagcgaatttctatattttattagagtgccacgtgacgactcgaaagtgtttataggataccatatggtaggttaggagcgtttgtaggaagtttaatggattataattacgctcatcggggtatctagaaacaatagtgtacatacataaatattgctaagataaatgtaatagtggaaaataattggtcgatcatatttaagttaaaatcaatgttttttttgtttttgtcttcataatttatatgattttctctaatttattaaattaaagtgtttcttggtgtcttaggagcttatttagttgtccgttattaaaacacaaagaaagtaattattaagactatagttctgcatgacaaatttctgtaattaaaatataggtaatatggatgttattttttttatagataagatacatcatatactttataaaattttaagtagtgaacaaccgaagaaaataaaggggtaacaattgatcgcttcttttccaaccgtgggtacaaatgtgcatacatgtatgttctttttttattttttctgatgaatagttttttattgttttcctttagcaaatagtgtgtaggtagattcttacgtacgtttgtatgtttgtacgtacgtgcagggatgcttgaatgtgggcctgtagggataggagagggaggtggaaaaaacaattctaatggtaattaaaaatagtgggtccagttgtttattaaagtgacacatggcgttttaggagtgtttgtaggactcccacgtggcggcttaggagcgtttgtaggaagtttcatggacttttagtatataataatagatagatagatagatagatagaagatagataactaaaataagcaagttgtaaatacacatgatattggatggttgagatcaaagcatgagaggatccaaaggctagattttttggttccaactatataggatataggatatatagattggataccatctgtctttttatggcatnnnnnnnnnnnnnnnnnnnnnnntttaacccgaaatattaagatggtgaaagaatgtgcctaattcacttatactatagcattactaacaaattaaaggaatactctgataaactagcaatgttcagagtttggccgacatacccaaatccatctgttctggggagaacttcgagggcattgttatcatcatcctggttgatttgtttcaattcgctggggtcctccggcaagcggacgtttcttttcctgaatgccgctacaaaaacctagagtacacagcttgatcgattaaataggaaaaagaacagctatgttatatagtgatatgcttcctgcttactctctgtcgtagtgtcatgcatggatgacagagtaagcaggaatcgtagtgtcatgcatggatgacagagtaagcaggaagcatatcagtattaggctttattaattgttctttttccaatttgtcatccgcattaggctttattaattgttattcaatcctctaaagttctacatacatatagcttaaatttatcacaagaatttagcgaagtttatagtttactacaacgactgaaaacttttagctcaaacgacgagaatacctgcaatattcttgtgatggggctccccgtcggcagccggttccggtagagcgggaaggcggcggcccagaccagcaacccgagcaagacgaaggcggcgcagatggcgaagccgatgccccagcccttgctgttctccacccacacgatgaagacgaggccgactaaaccgccggtggacgcggcgaaggtgtaccagttgtagaagctcacctcctgccgctgctcgtccgggtcggccgggtcgaactggtccccgcccagagccggcaggcacgccttcatcgcaccgtcgccgatcgggaccaggtacaggcccagcagcagcaggctcaggtttgcgccgcgcaccggctcgcaggtggtgctcgccgctgccgttgtggccgccgggttgcacggcggcgggtgcagcgagggggtgtacgcttgaagcgccagaacgatgtaaccctgcggcgacgaagtaaccagctatgtgtgagaactgagaagcttgttggattgtgcgtgttagtacttgattattgctgaacattcgagtgatacttgagaagctaacgggagagataagtgtttttctacaaaaatttggtacctcctcgatcgttaaaatattttttcccctaaaaagcaaggagcagttggtgcacttggttatttcgataaattatatattgttaaagaccgcatttgtatttttttcacatttctcttgtctagacaatcttgtgttaagttttgggtgcatatttgttgatacatgttacttgcaatgttctataaaacagtactctccctctttccgtagataattgttggacgtgtttaaaaaggaacttattaagacaagactttgcctattgatattgcgtataatttattgaatagtattaaaaaagctgccagaaatcttataatctaaaggagtcctaaaagttgacacatgacaaagcaaatcaaacttacaagccctaccacataacatcacatttgtgtcgccttattagtgtcggttgacaaaaactggcactgacaccggtttccagctccagtagacccgtgcagaaaacgggagaagaaaaaaccacatcagtgtcagtctttattacatgaatcggcactaaacgctaaagtgttagttatttaggtgagccgatacacaataataattattggtaccttttatactggaacaaaaaaagttgccagagccacaagagccgagacaagtttcatcttcgactagatgagaccacggtgagtcttaaaaaagaaaaatgaactccttgatgaaattataagtctcaatatcctctctatctttgtgctctcagtcgctttcctgggtcttctcccctcactgtctcctcaccagcacggtccactcacagcagtggcctcctccattgccatccgcatccatcgttcaatggcgcggcgtcctctcctcaccggtggcctgctccaccgtagagcagtgatggctatctcccaaccagtggtgagcgctctttccccactggtgagtggcagcagcaccctcttcctcttgcgcaaccattcccatggcccccgtcatcaagctcgggcagctggatccgactaacacgaacttgggtgggacgtatatatctagccaccacccgtccagaatgcaccagttccacgcttgacgatggtggcaacgacaacggtagccttgaccttcagcattgagcagtggtgttcttaattatgtgatgccttatttgatactgtagatgtggataatgatgtgttgttgattctgtggttgtcttttttgttggtttgttttgattcttctagatggggtatggatatgttattaacttgtgatgttcttgaatgttgatgtggttcttggggagagggaggggtggagttcgattgatcggctagattcgagctgatgcgtcgagccaacaatttcttttttttattacttccataaccctatcaatgccatctctcacatccggcatacactactacaaaaatggacacacaggtcagcactataggtgccggaaatgctaaaaccggcatctatggtacttttcccacctaaaatgtgcatccattggatacaatcggctagaaccagcacctttgtggagagataggtgtcggttctaaataaaaacggatacatatagtattagtgtcggttttttaagaataaccgatatcgttaatatccattagtgtcggatacatctagcaagaaaaccggatgaaaccaatggaaccgaattccacgagttctcattccgtctctctctctctccctttttattaccccctcactctctctctcccttatcctccgctctcttgttcactccgcctcctcccctctccccctctctcttcctctctcagctctctctctcgctccctctctctctccaccacaccacccgatggtgggaggggaggcggttgcgccatcccctccgccagatccaacggaagaggaggtgacggcggcctggtggctcggcggcggtggcggcaccctcctctctaccaaatatggcgggaggggaggaggtggaggtccggcgcccttccctccactagatttggtagaagtgtaggcagcctggtaccagcaccctcccctcccctctccttgcttgtctcattgatgttcttgtgttcttagagttcttccattttcttcgactaaatgtaattaagagtgtgataaaatctagttggggtgaagggctattgcttgatgcatgggctcgaatcgagctgaggcgttaagccagcctcttttttaattcctaggacctcaaaggtgtcacttcctaaaccggcacctttgagaaaactcgaaggtgccgcctactaggtgccggttgcgaaaccaggcatccatgtgggtttggcaactggcacctaaagacttttttatagtagtgatatatgaactcaactcatcagtgccagaatcccagtgccagttggggacctagcttggagagccactttgaaaaaaaaataaagacaagaacaagtgatttaatctgaagttctttacaaacttcctccgccaattttaagtgtaattgttggcttctgtgtcaaacatttgactattcatcttatttgaaattttttatgattagtatttttgttgttattagatgacaaaacatgaatagtactttatgagtggctttttttttaattttttcataaatttttcaaataagacggacggttaaagttagacacggaaactcacaactgctcctagaatgagagagagagagagagggagtgcatgcatattaaataaatagactatagtactcacacgacaaataattgattaataggcttgatgaatgactggtgttagattgacagatggtactacccgataccaatatggtcgattgcactaaatatttatagtacttccactactacaaagaggcacatacaaatctgcactataggtgccggaatagttaaaaccagcacctatagtgtttttcccatctccacggactgaaaacagaaaaaaaccaacacctttaagagactatagatgctggtttttgagaaaaacagtcacctatactaaaagtgtcggttcctataattcagtataggtgttggttttaaaaaaaccgacatcttataaaccgagccaagccacatggagatgcggaagatatttgtagccgtccacacacgctatctctcctcctccacaatgttatcttcccatctctttctgctccttctcctccccaaccttatcttcttcttccccctcctctctcatggctacggtgccctccttctcctcccctcctcctctcacacgctcggcggcgctctcctcacgtctctcggcggcagcctcctcctcgcaacgccatggcggtggcgccctcccggcgaggaggcggtggcggtcctccccgccactagatctgatggtccggcgagaggaggcggtggcccgacgacgacacaacggcgaactcccctccgccagatccggtgggtggggaggtggtgggtggcggcggcttaccgagagcggcctccccacctagcggtggcagccgacagtggaggcagcagcggagcctcccctccaccaaatctggccggacttggcgacggcctggtggaggcgaatgggagcgaaagcgacaacggtggcttggtagcggatgcagcggcggcggcacagcagtggatgttcatgcttgttcttgtgtgttcatcttgtgttcatgtgtgttcatcttgtgttcttaatgttgatgtgtgttcttagatgtttatgttgtgttcgtcagtgccgccttcgtggtgtcggttgggacctaagggggtttcccaaccggcatcaattaagatttctgttgtagtgttcacttgtcacagtcacctagggtggacatccttgattgacgtgataaatactatatctgagactaattttctaaagttttgcaagaaactgttcataatattataagagtagaacttgcaaaactacaaatattccagcaaactatcacaaaatatatatttaagagtatatatgtatcacaaaattacagaatttacattaaatatatcacaaaactatatatttgttgcatcgtatcataaatctatagatttactgacaatgttatcaaataactacaaattttagagtttagaattcatatcagtattgcttttccaaagttacaaaagatgttattttgtgacacaatgtcttaaatctgtagtttcatcaaataatttatgctaactctgttttgtgatagattgatcaaaatatatgtagttttgtgaaatttacgcacattataattgcgccttgagttaaaataatagacaatatcatcttaaaaaacatcaaacgtgatatatgcaaaaagagaaaaaacgaataattaacatactatgatctcgatgggagccaagaggatgacggtgtagaatcgtttgacgtatgagtcagctaggagggccgccgggatggagaacacctgcaacgcggcgaacaagttggtcaccgtcgtcgtcgcctccgcgacacccatgtgcatggtggcccggaggtagctcaccatgttcaagacgttggcgatgttgggcgcgttggtcaggagcaccatcgctgcatgcattaacatctgatcatatccatgattcgttatcaacttcagcatctgagagcgttctgatacatgagttgtattaagttttaattcggtccagaactgaattttgaattgtagcacagaggtttagatacgtcaaaattcgggattggaataaacttggcttgcttgtaagaaaaaaaagtttggttatcttgcaaattgagcatagcttaaccgattaatttccttatggtggaagcaactcatccgaatctgaattcaagttgcagacttcataatggcgctcgtatttatagttaattatgttttcagtcgtaggtgatgtacccgtcaacaactagttttgtacggaccgggtaatatcaatatataccggtctattttgtgcgcatgttgtgagcgcctaagtttatattgcgtttgttagaaaaagtttgattgtctttatcctatagcgagttaaaatttatactagcactatatttcaaggtagatgtggacccaaggtgaaaaaaacaagcttatctttgttgaccagtaaatgtgtgtattctacttcctttatcttaaaataagttaatccaaattcatattaaaaaataaacttattatagaacgtaatagtaggaaccaaggttaagggattctaaccaaatggtccaaaattcgtccatttcggtaaggatcgagactaaatttcgcccatactttatgtttgctgaattttggtttaaatttggtaataattaatttctcacatttttttaatttcattcattttggtcccaaaatttttatacaatcgaatctgagaacactggtagaagctagccatgaacagaagccatcaagccaacaactcagtgacgagcaaagctgcaaaggagagacatagtactaaaaaaacagtagtacataatcatgcttagctcaccatggatgaaaatggatgctcttacacctccatgcttccgggtgtccaccggcctccccctccaatccactagccctgatgagctgctcatcacctctgtctgtctctcttcctctatctgaaacctggaaatgttctacgtgatctgagctgactgactgtatttgcagttgcagccatatatataaatttctgtctggctagtggcgattgatggacgcttgtaatatataaagggtgggtgttgtagtagaacattctccatgtggtagaacattctgcatgtactctaaaccttatagttcgcaataaatgtagtccttacacaaggtagtacagtactacacctgccagcaataaataaaaatatcattgattattttaccctatcacatcgaatatttggacacatatataaaggattaaatatagaaaataactaattatacaaattgcgtgtaaattgcgagacgaatcttttaagtataattgctccatgatttgataatgtggtggtatagtaaatatttgctaataacggattaattagacttaataaattcgtctcgcagtttataggcagattctgtaatttgttttgttattagactatgtttaatacttcaaatgtatgtccgtatatccgatgtgatacggcataaattttcacccctggatttaaatacagccttagctatgtattcattctctcctctctacccaaactattgcatattatttggtttttatatgctcttaggatctacttattgtctcctacacattgtgaaattttaacaatagtagtatattgcgtgtgcgttgtaaagggattttagttaaataaaattatcacttcccactattgctattatttttcatacgtaatctgttatttatacatatatttattactgacatgtatggctgtatgccctggaccttcacaccatctttcttctcacaaaaccacatatcctttctctgcttgaaaaggaagtaagggagtgatagacgtactgaggaattctttatctcaccaacaccgctatttcttttcaaataagtatagaataatagaaatacctatatggcaccctttggtaaggattgctgatgccggtggtgatggcgtgatcaagccgctgaagaaaaatgaggaggctgtgtccaatggagaaatagggcaggtgagtaggtgaccaggacatatgcagagtgcgtgagaatgtgaaaggacattgaggtgacactaaataaaaattgaactgtcccgcgagataacaaatggcagtacgtttaattgttactgaggtgaagtacgatgatctctgtgcgtgatttgaaaggaaattttcgtttgacaaaaaaatgcttctatttgtacattactgtgtaataaatgagacgtaactgtccacaatttaattgtaagtaaaaaaaatttttcttgacggaaaaactgtacaggaggtcctgcaggggtctggatcccatggagttcactccaactccaccgggtggatttgatagaatctctacggtctcttttttttatcaacggttgagacgaagccattagttcccacttcctactagtctcttttgaaaaaaaaaagaattcctcctaatcttgtaacaataacaaatcaccgtctacaatatagttagacattagagaatatacaggctaattttacttgcataacccagaaattctttgattaatccatggtgtaaacaccgtactgagcatgtgcctctatttttgcatgtatatggtttatgtgtgtttgcatgtactatgtggttaacacttttttttacatgaacatagcttcctgtgtttgggaaagaagagaacatgtatactttgttaatttggtaggcagaaacttaaccattactaacataataaaaaaataaagtaattcccattcaaaccataggaagcagtagatgccatggatttgataaaattcatccggtggagttgtactcaactctatgggatctgtacccgtcatgcatatatatatatatatatatatatatatatatatatatatatatatatatatatatatatatatatatatatatatatatacataattcctctctataataaaatataactgcagttatatttataactagacgataacccgcgctttgctgcgggatataggttagatattggaaaaatgatgaaatgattgggattgaaatattatgaaaataatttgagaatgatgatttagcatgtgtatgtttaattttagaataaaataaaataaagtgtaaatataattactataggcttgcatgttgagttttatgtgcttaatgggttgacgtggcatacttgtttatatgttttaggagtgctaataaatactatgcttgcatgttgagctttagatgtttagtgggcattaggtttatagaaagaagagactcctctttataatataaactagtgcatgtctttctttccaatagctaaggggtacgaaaaagcttaactattatcgctctaggttctattggctgagtaatggtcaaaaacaaaagtattgcctcgccagatgggacattctttgccgctcaaaagaccatggggtttaggaattcatgatctggaacttaaaaatatagctttgtttagtaagtggctatataggttgcttactatggatggagtttggcaacagctaatacataataagtatttgggttcacaacctctttctcaagttcagtggaaaactaggaacttatgttttttgctagcctaataaaggtgaaaaaagactttttttttccgtttcgaatcctttacaattaaagatggctctcaaattagattctggaaagacaaatggtttggagatgcaactcttcaagaacagtacccgagccttacaatatttttagacataaataaagtactattctagaggtctttcaatctggcgctcgaatctttttatggtgaagggattcaattggttcagaattagtagcttggaataacttattacctcggattgctaattttgaactaagccaggcgcaacatgagttcctatggaatttaacccatagtgggaagtttacagtaaaaactcactacttggcataagttcctatggaatttaacccatagtgggaagtttacagtaaaaactcactacttggcatgagttcctatggaatttaacccatagtgggaagtttacagtaaaaactcactacttggcagtggtccatagtgatgtccagaatataaattgacacctctagaaattgaaggtgccactcaaagtcaagatttttgtttggtaccttcatcgtggagttatgctaaccaaggacaatctacctaaacgtaactggcaaagcaatcaaaaatgttattttgtcataacatggagacaattaaacacacatgctttgaatgtcattttgctaacttagtttggtcgatcacttatgttgcgtcaagaattactgcaccacataatatttcacacaggtttactaaatggctttcaggtgttcaaaaatatttacagccgtatgtttctctgttaggggcggctgctatttgttggtcgcactggttatgcataaatgatatggtttttgacaaaaaaaattatttcttctcctgtgcgggtagtctatttaattatctattggctgcgcacttgggttatactacaaaaaccgggttcgcaagatttggttactacggtgtgtctattcttagagcaggcagttacggaattttttacccaaggggatgggtagcgatctagttttaagattgatggccataatacttcctgtaatttattttcttataaatggtgtgtgtcctagttatgcaacatccaaaagtgtgcttagtgcttttgtattatcctggtgtattggctgagttcaataaaagctttcattatttaaaaatatatttataggaggaacaagaaagaaaatgtaattaagggttaacttgattaattgacactagttttattaaggttaatttttaaccgcttgtgcgttttctcagagaagtatatataaattcttaaaaatatgttataactgtttgtctttttacgttatgttataatataagtgaaatgtctatagacaacaatagtagctattagggaatcgatgtagtaatgagcttatctctactactataaaaatattgaagatgtttccgctataattttgacgtcatccatgtttcaattggttttagttttatgtttcggttttaattttagattatccatgaaaatatgtcgacaagaaactaccattagaatttgttgtcaatgatgccgccagtaatatcttctccacaaaatagtttttgtgcagtttttgtgcatcttctctcactccacaaaatcatatcactatcattgactcaaggttttggttttgttagatgacaccccgtgtgctgcagtgagaccttgtaagtttacaatcaaaattataaaccaagagaaggatacatatataaatgggaaagtcatgatttaaagcaaagcgaatagttacgtcacaaattttgacaatttgactctttctgaaaactaatttcggaaatgaaccgtggccaaaacttatttaaaaaataatccttttgttcagtgccaaatcgtatggcgttgaacttagacacctcagcgccacgtcaactagcactgaatgttgtgccaccgtggatgggaggttgagtcggcgtgccaacgtgcattcagcgtcgtgctatttggcgctgacatgtgtaagtttagcgccatacgatttggcgttgaacaaaaggatcatttttaaaataagtgttgtccacagtttatttgcgaaattagttttcgaaaagagtcaaattgttaaatttagtgatagttacggagcccgatgtctagcatgtgctatccgtgcaagagcctgtgggcttgtcctttctccatgcgatagatatgcacgctgcttttttcgtgtgcaatactgattccgtgtgcaatgcttttgtgcacatcccgtactgcaacgcgcacttgttggtctaggtggttaggatcagacctctaggtatggttgtaaaggttagactagcctatggataagatatgagagagcttccctcctaaccagacttctagcaggttaggttaatgtcaaagcaggatgctcttctagcaggaaagtacgacactcactcttgatagttcggctagggtgatggttccaacctcatgttccaatcacacaaatataatgtagacaggtggtttacataggtttgggtcattcggaagcgtaatacaatgtgtatgcatgttgggtggatgttattctagatgagtgatgatgaacccttgcttcttcgcagttttttttagatctaacttatgctaacaggactaaatgtaattagttgaatcaaaccctctttttagtggcattggtcttccttctatatgccaacgtgataacacagtgcatacaagtgtatatgtgatattcagtcttgtcattgtccttctatggggaccggctggatgtgacgggttcactaatgggctgacatgtagaatacggtggctgaagtcttcgttccaactgttaatgggcccaccgggctgtcaccgatgctagggggagtgtaacgtgttagaataaatgggctaggcccgatttttctattaaaatcttaagggcccataataaatgtgaaggatagtaataccacccaaggaattaaaagtggagtacctcaacttaaatagggagttattggaggctccctattgaccggttaaggtggggatcgaaaagccacatgcgtgcgcgagcgcgccgagccgagccggcgggccgaggcgagggcgtgggcaaggcgtgccgtgccgtgcgttgcgttctctacatgatgatgatgcttattctattttaagcatgctcctggttatgtttaattttatcactagatcacctaacattgttcatgtcatgattattgtcttaatattttagattataatatgtcgatatatgactatatttctaacataacgccccgatttttgcctggtcgaaaaatctattttattaaataaccatgttcaaaagttttgttctttgagtgtatataggtttgtgtgtcaaagatatcaagtatttcattccttgtaaactcaaagtcttagccaaatcttttccttctaaattaaactctcaggattcgtattttgaggttcaagctctcctctcaatccttctcaaaaatatattcaaaccctcgtctttggttgtccggtctactctttacaatttcatacatctcaaatatcaagacctcagtcaaatacttgtgaattgaaattccaaatttgaattcaaatattgtccaaagcctcaaaatatctctccaataatttcccttccaatccagagattcgaacaatatttgtttttggaatcctaccgctgacaaatatttcctatgcagttgcatatcaaaaccgacagtcgtttctcccgtcgaatttaatcgggcacaatggaaccagcaaaaggcgagtttttcctccaatcatcctctcccaaacaaaatccccatgttcgaattctggaatccgaatcgcgtcctaaatcatccctcattttttctttcctttgtaactctttttcttcaagctgtactcgttcaaaaattccaaacaaatagccaaagttcatagtgcagtgacagtccttttgcaagctcaaaattgtctacaaccctcgggcaaaatgacaacagacaggcataagtgcccgcttttattttccacaatgcagcaagcaaagccaaaatatgcacacatagagtttttttccttttcttgtccctaggtattattctgctgctatatttaatgaaaagtcacagtctcgtgctgcttccccttaaaaaaatgcacgcttactccactgctcattttgtttgatgcctggaccgaaccttgctgctttcgtctctcagcaaagctcggcgtccacgccaagcaaccgatgttgtccactgaatgcgctccagtgcgccatggcacagcgacgagttcgtctgtgtcacttgtgcacaccgaaaggtgtaagccgagctcacccatgccgcaccgaccctaccactcgtgtgccaatctgcccatggcatcagccgaacagggcagctggcctcacttggccgagctcgctacaaaagcgcctgttcccaccatcttcctcccttagaatacaagctgtaccaccatgcctactatcgccacctcttcttggccttagccgcccgatgcttgccagccatgagcagagcgctgcccatttgagcccccgaactgcacccatccgcctccctagccgaagcgccgtgccgacctcctcttggcgccgcaacccggccagagccaccggcgcacccaacctcctcttgctcccccggcaatgctcccttcctcccctcctcttcccaaagctgtcatgactcctgccctctacactgctcagttcgtgcagccactggcaccttcccctctctcgggcacgcgtgcaaaagaagcagaggagagaagaaaagagaaggaagaagcagagaaaagataaggaagaaggaaaataaaagaaaaagggaaagaaagataaggggtggaacccagcagtggggccaagtctcttgactcctctccgtgggcccacttggcttgaaaactttgcaaaagtccatatctctttgttcctcgggcgaagcccaagaaattgatttccgtataaaagtctgtactatctccttcactcaaaacttttggctgaagcccaccagcctagcctcatctccaccaagtccactttcctccctctgagcctcacaaccaaggaatattttcatggaaatatttctttccaatttaataaatccttttccaaattctagaaaatccattaaccttccaaaattcatatctcttcaaccgattttggatggctttcactttttttaatcacgtgtcggacgtttaggagatgcatggacgctggtttttctcgaaggtttgaagaccaatagctaatgcaatccactcttcgatcatattactcctactttataaatgtattgtttgcaagattgcatgcctagtgtacaccgttaatttgatcggccatcaatctactagcatatgatggatggaccaacctaaataactactacagaaaaggtaaaaggtgccggtccagaaaccctaataagtgccagttttctgaaccggcacaacggagacagcacggatgatacttgtcatcggtgccagttctagaactggtgccggttttgaggtcaaaaccggcacctatatggtcctaataggtgccggttggcaataaaaaaccgacacctatattttgggtaaaaaaaaattacagaaaattcatccatacaacccgaattccatacaaacccaaattcatccctacagccctacatccatattcacaatcctccttcattcacattcatattcacattcacattcaaaacaaataaaaccctataaacctaagtctaaaaattcgtaagaccaaaatttcctatctttaaatcctaaacattggcatatatatcttaactcaaaatatgctaagtttaaaatacctaaatcgaaagattgtaagtctaaaaattattgcactcctagtgctgcaatcagtatacttgtgtaccgcattttgttctattgcactcgtagcatgtccactttgtcagctgtgtgcttcaaaatcttaggtgatggcatttgcagaaaataaacatgaagcagcatggccatgtgtagatataagtaaaataagggcaacagatgatatactatacagcaaatgaaagcacacactatcagcaataatttgcttctgtagaacagaaataacatatttcagaaaaatataggtattgtagtgccagctaattaagatgagttaattaggatgttgatggtactaataatgacatacatggtaatgtctaagttgattctcaaatgttttcatgaccaaaggctgacagtgttgtattggcacccaaagttcttactcttagttttagttttgtaccatccttaggcatttcaatatcttgccagtaatttatctgcacaaaattggaaagcataaaagaaaatgcaaacaaagagcatcaaatagtacactcaattatcacataacctcatctactcacagaattagttccacattcagcctataaaagctcgccctatgtttttttcccaaagacatggtcttctaattatatcctctggccatccataagaatctacaaacgacataatacttttcatgcataaacattcatgattagtgttcaacagttcagtagccaccaaatcccagtgtactactgaatccagattcagtttccttttaaataaactgatgatatctatgtgcacgaaggtaatcaagaggtctgatgacaaacaaaacagcaacatctactgctagcctatctaaactacaggagaacacattgccaaatactttttgtacataaacacattcatgtcgagtattcacctatttggaagtcaactgtagatggtcgaccacctaaaagaatgaagcaaacaaatttatggatctcaataactaaagatgcataattaaagatcaaatctgaataatccaataaatcagcaaatgaacgcaggcactacttaatacttgtcagaggatgcttcaaatgtaacagaaagagcagtaattagtttagcatgaatatgtaatcaacaattaagcaaaaaaaggcatataattaatttaggtcattcaccagaaaaatattttctgcagaaaaactgaattcagttgagtattaagcttaatatttctagtttaatcctataaaaatatttctagtttctaacaatttctcagagcttagcacctgtcaatatcacttagcacacaaaaacaacatctgcctgcgagtattaagtcaacataatagaaataagcttgcaacctttctggaatgtcaactgataccaaaacgataccaacaatatcaccgttttttcaatcagcaattcagcaccataacaccaggcctaatcaagcatttctcatgtgcatcttcaattaatctacagataaaaatctgcagatcaccattgttcatttttccctaggctgctctttgtcctaagatgcaatacaacaaacaggtggagtgcagcgtaggtgatagggaaatgatttactgccaagagatgggagaagaatgcatacctgtataccgcttgtcatcagccatgtccaaatccgctagcttggcgatttgtccctgcagctcttcaagcaagaaccactcctttccatctatggagtatgataggtgatcaaaatccaaagctcccaaactagccgccatgaacaatcgagaaatggaactgggaaacgaatggtggagctccgcctcagccaacaacgacctagagggcgctacgccgccgagggtgaggagggggagggtgcgagggtgagattcgttgccaccgccgtcgccgctgccgccgcacagagagagaaggagagagtgaatggataagggagagagagtgaagggataagtgagggtatttaagtaaaggacataggtgccggttctaacactttgtgtggcatgaaaagctctattggaacaaatgtgccagttctagacaaaaaccagcaccttcgttttgtcatacaataaccgacacctatgtgtggggcccaccaatggctagtatgggagggagaatattaaaggtgccggttttgggtcgagaaccaacacctttatcttgtcgaaccaagaactagtacctttatgtaggacccaccgttggatataaaaagcactattgaaacaaaggtgccggttttgggttgagaatcggcacctttgtcttaaaaccggcacctatgtgtggggagaagattaaaggttccggttttgggtctagaacaggcacctttatctgacacaggttttaggcgtaggttttatttaaaaaccggcacctatttagatataaaggtgtcggttttttaatatgtggcgcgtgggggtgggtgcatgggcggggatggcattatatgtgtcggtttttgttgtgttggcacctatttgccttttttagtagtagttgcattactttctataggatattatcaaacttgaccttgtcactccaccatagcagtaccccgacgcaagtgtctccatttaacacatgattatgcttgattatcaagttggaaaaacttgggttgtgaaaggtttctaaaacctgactcggtgcttttgaaaataaaaagtcttatggataaaacttgtggtgcgaatcctctcctgtgtggtttggtttcgtagctatgcacaagggctgattcttttgtgttttacatccgggcatggtacaatatgatgaggacacaactagctcggatataaccatgactatcttatgtattaatcaaccaatggtgcatatattctacattagatttacatgttatgtatttgaacaaacgttgctacacaatgagttttctgtgtttttatttgcagaggtacttgcttgggcgaaggaaaacagactgagcgtaacgaattcatggatgatcaaagaagttgattggggaccatatcaagaccttctccaagtccactttcatttcatcacatcacttttagtgcatagaagacaagagataaagttctacacattttagattcggattcgggcctcctgacagcatcaatttcaaacggacctaaccgcagatctagaaggaatttcggggcccatgattacttgttggaaagcttatggagtctactttcatatggttttggtcccacgtcaaaattcctaccgagctgccgggaatctgcaaaacaagacacgtatctcatccagtccgaatctgactcgggttttgggccttaaaattgtgtcgtgagcttagcccaagggggtgtgcaccctagggcaaccctaggacgtccctaatcatactaattcagtagccgtcatcgtttagagttcggttttgcttagattattctgtcaagaacagtttcgccgctagatcggtttgtggaaccccaaattcgagtgcttaatcattcatatgcaatttggttgcaatatatcttgttcttgcttgtgttcttcgattcgcatgcagggattagccttctcggcgaggttaaccgggtttcggcacggttgataactagaggagacgtggtgctgcgattgcggggcgcagtagcgtgttcgtccagaagccggatcgagttgtgtcgcaactccgcccaaatcgaccgtttatcaatacctatcggaagttcgggactacatccctcattagttggtatcagagcgtggttgcccgttaggtagttttcttcccatgactagaaaattgccacacaaaaatgtttattctttacctagacaatttgagcagttgcattgttctattagattttgctttgttgaattctaaattgcatcgtcgtgtcaagtgttggtttagttttagatttaattttttagttttgagtattgcatatgttcattactttgggtctagggtatatcaagttgtgagttgtacgtcagttttggatctagttttgcatcttgacggttgttgccgggaccttgaaaaatcgattctactcatcacagagtttccgtttttatagttttcacaaattttcgttggtcagttgcgaagttgcacaaagtcgcatttagggtttgagtgtcggcctttgatgttgccgtgaagaaaaaaaaatagtaacagatcggtttccatgtaatagaccgacctgagtccttttccgggtccacctcaagatcgagtcccacactgttgctactgcgagaaatcaagtaatatctccacatcagaagccctgccgagacaccttagtggaaaagaaaaagaaaattcctttagtggatttgagatatttttataaaaacggaacgtacgtgatgtgagcattccatttttgaggtgatctaattttagttttgcactttgcatttgagtccctgttcaaggtaagtggtcagttcttgttgaaaaaaaatagtaaaaaaataataaaaaagaaaaggtagaaaggtgcaaagaaaaagaaagaaaaagccgcacaaaaaaaagaaaaaaaagacagaaaggtgcttaaaaaaagccgcaccaagaaataaaaaaaatcattcatcctttgagtatgttttcagagtgcagagttgtgcattgattcatatatagtccttagtgttgtcagttgcttgcttgagctagagttgagtctaggctaggccagcacattgactagtactttgaactattattcaacttttcattttctcattagcacaattgcgtctctttgctactatatattgtgcctcccaagctacacatatatacttctggtcagcaccgctttgatccttgcaatcgccacatcacgtccttcaaggtgtcatgaacccgccaccagttgtaccgtccttagcattgctggtaagacacttgtaagagcttggtaaggtgcttcatttggctgagttgttgaggggcaccactacatcgcgtagtagattattagggataaccttcattgtttgttgttatttttatgtttgcaatgacaggtatgagtggcgctcgaaatcagcgataccaacaaggtgcacgtgatgacagtactttggtgcaacaagtgctaagttctcaaatggagaaagcagagcaatggcagtatcacgaattatttaaaacaaagtttgtggttaaagatagagcatgtcgtactataatcgatagtgagagttgcaataacttggtgagttcagatttggttgagaaacttgagttgcctacacaaccgcatcctcatccatattacatggaatggttcaactcttgtggtaagttcaaagtaaatagaattgtgaagctaaacttttcgattggaaattaccatgatactgccaattttgatcttgtccctatgcaagcatgttctttgttgtttggtcaaccatgggtatatgataataatggatcgcataattttgttgctaatacatacacatttagacataatggtcagaaaataaaattggtacccatgagttttactgaaattttcgaagataatcttgaaaggatgaagaatggaatcgaggaaattttcaaagatagtattgaaaggacgaaaaatagaatcgttgagattttcagagataccaggaaagatactaatattacgatgccttcaacatagtctgagttattacaaaatgaacgtattgttgtgcctattgctttggatactaatattttgcaggcatttgagaacaaccaaggtaatgaggaagagaagaaagacgaagaggaagatgagaaagaaggtaatgataatggtgctatagctattcaaggtatccatatttatgatgtgccaactatgtccactacttatgctacgttagagcaacccatagtgaaaacaattgttgaaatacctttgtcacaaaacaatttgcttgatgtttctagtgataaagaagagttgtgcgatgtttcacttatatccatgccataactagtgaatgaacatgttaattctatactagaaccactatgtgttgagtttcaacatgttattcacattgctagcgagaatgaagagcttaaattgctatcttctttaaatacttggggtcatattcaatttgatgatctttgtccactcaactatttagagaagaaattatttgctagatttgaattgccatgcccttctgatgtgatttttcatattattggcaattatgatagtaaagaagaatataatgtgtatcgagtatatatttgtttgaatttgactatacctccttttcatgatgaaatgtattatctagaggaccccatgcatttaagtaattatctatctagttcctctagttgtttaaatgagttacaggttggtttgcaagaaggggagtgttgtggtttttcgactacaaagatttcaggatccaactacatggccatcaagaaatgtttctcaccggatgttgtgatacataaatataagttcaatacgctctatgacaaggtgaaaccgaggacggtttccaatcaagaaggagaggatgatgaggacacaactagctcggatataaccatgactaccttatgtattaatcaaccaaaggtgcatatgttctacattagatttacatgttatatatttgaacaaacgttgctacacaatgagtttcctgtgtttttgtttgcagaggtacttgctagggtgaaggaaaagagaccgagcgtaacgaattcatggatgatcaaagaagttgattggggaccatatcaagaccttctccatgtccatttccatctcatcatgtcacttttggtccatagaagacaagagataaagttctatacgttttggattcggattcgggcctcctgacagcatcaacttcaaacggacctagccgctgatctagaaagaatttcggggcccatgagtactttttggaaagcttatggagtctactttcatatggttttggtcccacgtcaaaattcctatcgagctgccgggaatctgcaaaacaagccatgtatctcatccagtccgaatctgactcgggttttgggccttgtaattgtgtcgtgggcttagcccaatgggatgtgcgccctagggcaaccctaggacgtccctaatcatattaattcagtagccgtcatcgtttagagttcggttttgcttagattattctgtcaagaacagtttcgccgctagatcggtttgtggaaccccaaatttgagtgcttaatcatccaaatgcaatttggttgcaatctatcttgttcttgcatgtgttcttcaatttgcatgcagggattagccttcttggcgaggtcaaccgggttttggcacggttgataactagacgagactaggtgctgcgattgcggggctcagtagcatgttcgttcagaagccgtatcgagttgtgtcgcgactccgcccaaatcgattgtttatcaatacctatcagaagatcgggacctacatccttcatcacaatacgaccacacagacgtactgggaatcccctggatgagtaactagctaaaacgtaggtgtccaaaggtatggtggagtatatggcaatcacctgcagtgggaatgtgttggagtccatacggtggggctcgggtagatgaggacctgtgcctggcgtgatgcttggtggagagattccacccaactgtgggagatgggatatttatggattggctagggaaaggcttccgtactgggcagtattggtgtcttgtgggaaaagcgtatagtctaacagaggtttaactgaactattcaaacagccgtgctcacggtcaagggtgaaaaaaaaggtggcactagaaaaaaatgaccaagcacagggagtcaatgcaggtgcttacccacagcgacggggcttatcagcagtgaaagaggctgccacaagattttgtcgacgagcaggaggaaaatggcatcgactggagctccaatgatgttggtgatgctagaaacgaaacgatgatgaagccggcttgatctcacagattggcagctcgtgctcgcgtcgatgatagtagcacttttgctggagcttcccgtggcaacagaagtcatcgtcaattgctttttgcgccggcgaagaatggtgacaaggaaactgtagtgctcaccagtggctgtggtgataaaggtggcagaggagtttttttaaaaaaaatcataaactctttactcaactcaaaagcatagtacatactggattgcaaagttgcatgattagcataacatctcttgttgtgacaggcaatatgggatatattttgacaattgtaaattggatttaggcattatgtgagatttggcttcttttgctaacttatctgttggatagtataggtagaggaatactgtgtaactggaccaattgtattgaacctcagggagccgatatatataagagtacatggggaggagataaggaaggattacagatatggaaggaacccacacaaatcaatcctaccataatatgactctaactaccatatactctaacatcctcccacagtccaagcgtgagcagcgtggacacttggactggagaaaaaaccttcaagagtactcaacacgatgatagccctctgtgtcgtagtcgatgtagccaaagcaaagggtgcgagggagccatggtcaatgaagccgtgcgtagagtagccgtggtcgatatagccgaagtcgggaagctgatgttgaggtagccgagccgtagggcgcgcatggggcgccgtagagtggtcgtggacgcacgggagggtgtcgtggaccaaggtaagcgaggacgcgctggagacgatgacagtgacgcgatcctggcagtcgttgaggtagatgacgccgaagagccaatgtagtcgaaccgtgaaggacgagacgtgacacagggtttgccagaccccgggacaactcgggacgaacgcgtgtgctggtgttgccaataccgcgcgggcgaggcaggggtccaccatgaatcatacaccaatgtcagaagagactagcaaagaagtcctacgggacgagaattgccggagtagcacgcagttgctggagaagagcgaagtgtagtcaaggaagatacagcgacgcttgcgatgagacgtgctggatgaagaagaaggcggagtagcgggaccaatggcttggacggcgatatcggtagccatgtagaggtagctggaccatagtctagagcggcgacagtggcagcttggaatcgcggcggcaatgctcgaagtagatgcagaagaacccgacggctgaagatgaccagtgcagacaacgaggttgtcgatgtgcgaacggcaaggaagacgacgagaggggcgacacatggtgcggctcaatgtcgatgcagtggcgagaactctaccggtagtgaggccatcctgaggagggtgtctgttagctttccaacaaccagtgtatgtggaccacgggcggcagcactgcagcccaagggggcgatgcgtgctcaatgacgatcggttgcagaagtcatcgtagctgggcagctgaacgggtgatcaagccgaagatgcgcggggctgaatgatgaagtcgaagcagagtcaataccgatgtcagagacgcgtagatgtcgatgaggcagtgggcgacgcaaaccgatctctgatcagaaaaaaaacagatacatgcagcagcagcagtagcaatccagaatcctccagtgccacataatagtagtagcatgacccggtcaatatgttgaatgactctgcacccatcttgtctctatctgctcacttgctagccacgtgcaagatcataacagagggagacaaacagattagagcgggcagcttgatgacagatcacggcaatcacgcgcaagtgctccacgcatagaggccgggtagtcggaagttccgacgatgagggccatgtacgagcacagagagggcagaagctagagaccgatgagtggcggcgtcctcaggagtcacaggctcgcagggggcagcgcgtccggggccgacggtggctgacgcggaggcttgtgcagcagcccccatgctccgccgccgaggacaccgatgctcagcaggccaggaaggacagggctgaccaggcgaacggaggtggtcgttgcggcatgcggcatggaggtacagccagtgatgacgaccccagatccgatctacgtggaggtagccgatggtttgctagctgctgatgtgtggagattatgggtaccccatacccacacggcatggttatctgactggttataggggataacttatatctatgagatatgtaacggatcatgacttgggtattacgtttccttgtatattatggaacggcctaaagttctggtttggtaatattgtaaagtagattttggaaaccaataccgtattggttaatgtttctatctggtaatcctactcccatcctatataaggtgggcaggaagccctatagggggcatgaacacacctggtcgtcaaatcaatactacacccggcggattcaaatccccaaacaggagtagggcagtacctctcattgagatggtctgaacctgtctaaatccttgtctccgcatccatccacttttagatctcatgcgctacccccttttattattgccgaattcatgtttcgactgttggcgcgccaggtagaggtgcgtcgaattacccatcaaaaagtgcgatggaatcaacctagatcaaccccaccaagttcgaagacttcaatctttgacatagaccagtttgccatttcaatacagtattattagatggatttgtaatctagattgatctgttgttcgatttttgtttgcatgcatgaactggtgtttgatgagctctgccggctacttccaatgacggcatcaggagggccatccagggacatgcacacgcatgcatcatgcaacacagagaccaatatctagtatatatgtatgcatggatcggaactaatcatttgatttactaatgattttgctggttgtttgcatgtactcctggacggagctggctaagtttttgaatcattcacgatccaagtcctgcttagagaccgggtcatgggctggccgcacccacgtcaggaaccatgcgacgtgttgatccgatcgacctgctgtgcatcattgatccatatatggaacatttattttttttcctactaacagattgatcaaactttgctgtttgtcttttatgcatgctggagcgatggttgttctcatgcacaagatggcaatagagatctatgttcgctgctgggcgatgggatttggctgtgctgccgttcctagcttcctcgcaatttttgtttgtgtttagattattccctaacatatatttaccttttctgattttttggttgcatatacgggtgtcagcatgtttttccctatcgccaccacgtctctatgagagcccatctgaccaaccagttcagagatagtcacgtttacatgaaaatatgcacgcttctttccacatacttgttatcactaaccaaattggtttgttgtgttgtcctgtatgcatgccgagttgcagattgctcgattatgtgtgcacagtacaaaaccaattgccaattttctccgtctctgagtcagtccagataaggagatcaatctcggcgagctcaacaattgaatttccgacttcgccattagtaacttattgttgtttattggattgatctctaaatatcagattaatctcttggtactttttgctatttacatgtaatgctgcggtgccaactggtcccttcctcatggttggcctgcgacgccgttactgatggcgacatcatcttcaccgatcggcatgccttcgccgccgccgactggtgtctccgccttcacggttggcctattatgccgccattgttgggcgtctacgacttcaccgccggcctgcctccgtcaccgccgactggtgtcctcacctatacggttggttggtcacaccaccgttcatgggcatccacgtcttcaccgaccggcttaccttcaccgccgccgattggtgtctctgcctacacggccggcctattatgccgccgtcgttgggcgtctacgacttcaccgccggtcttcctccgtcgccgccgactggtgtcctcgcctatacggttggttggtcacaccaccgttcttgagcgtccacgtcttcactgccggcttgccttcgccgccgccgactggtgtctccgcctacacggctggcctattatgccgccgttgttgggcgtctacgacttcatcgccggcttgcctccgtcaccgccgattggtgtcctcacctaaaccgttggttggtcacaccaccgttcatgggcgtccacatcttcaccgacttgcttgccttcgccgccgccgactggtgtccactcctccacggttagtgtgcgccgctgccgttaatgatggcgataatgtcttcaccgaccggccgcctcgttcgccgccaactggtgtttccgcctgcacggttggcctattacgccgccgttgttgggcgtctacgtcttcaccgctagcctgcctccgtcgccgccgactggtgtctccacctacacggctggcctattatgccgccgttgtaggacgtctatgacttcaccgacctgcttgccttcgccgccgccgactggtgcttccgcctccacggctggcctattatgccgctgttgttacgcgtctacgacttcaacgaccggcttgcctttgccgccgccgactggtgtctccgcctccacggttggcctattatgccgccgttgtggggcttctacgacctcaccactggcctgccttcgtcaccgccaattggtgtcttcgcttacacagttggttggtcacaccaccgttgataggcatttatttacctacaccgccggtagcctcagctgcttgcacggttggtgcttttattgccattgatggatgactttgttcctacatccgctacctctgctgtcatcaacgggaatactaaaagctaagtcatcatttattttattctttatatgatattttccttttactctgcctcactacatcaactggttcgccgttgactagtgagtcggggggctacagatgttatatcatatttttttcaacaattttcataatatttatcttgattgcttgcgatataatctgagtacaaaagtgcctatcaagttatggagttctatcttcctatgctttttgtttggtttgtcgatggatagatgcctttgggccgattcctaccacccgggggctcgttggatggaccgagtaacgcaaggtgctaagtattactcggaagaaacaaaagcatagagataagataatttattttctgctcttaacaattgcaaaagtacccgagtagtatactctgatccgtgaaactttgttccattaatgacgaactcatgtcactcgtatgcatgtttgggaagtgcctaggtcgactcccggtgcgcaggggctatgactagtcgggcagagtgtttgaatgtaaggagtcatccgctcggggacataaaattgacaaaagcagaaatacatatttataaacattttgaaatacttgaatttttctcaagtactgtatttacatcagatactactcatcctatatgttttgttctgcaggatccagatccagatatgcataaaaggaattcatagctttatgcttatctcctatgctccaggaatggatcagtcagaacatcaccaccggcttgccgtcgtcgccgccgactgttgtcttcgcctatatggttggttggtcacaccaccgttgttaggcgtctacgtcttcaccgccagcttgccttcgcccccgccgactggtgtctctgcctgcacggctagcctattataccgccgttgttaggcatctacgtcttcaccaccggcttgccttcgccgcagccgagtggtgtctccgcctgcacggctgcctattatgccgctgttgttgggcgtctacgtcttcatcgccggcttgcattcattgccgccgactggtgtctccgcctacacggctggcctattatgccgccgttgttgggtgtctatgtcttcactgccagcttgcatttgcttccgccgactggtgtctccgcctgcacggctgacctattatgctgccgttgttgggcgtctacgcttccaccgaccggacgccttgtctgccaccgactggtgttttcacctatacggttggttggtcacaccaccgttgttaggcgtctacgtcttcatcaccggccacctcgtcactgccgactggtgtttccacctacacggttggatggttaccccactgttattgggtgtctacttcttcaccgaccggcagcctcatcgcctctgactggtgtttccgcttacacggttggttggtcacaccaccgttattaggcatctacgtcttcaccgaccggccgcctcgtccgtccccgacccctcacctctatggctggtttatgcagctgccactactgatggatgtcatcgtcttcattgctggccgccttgtttgaccccgactggcttgttcacctccacggctacgcgtcatcatcatcgtcggtttaccttcgccgccgcccatggtgtcttcactttcacgtctggcctattttgccgtcgatccaggacgtcttcgttttcgtcatcattctacttcttccatcactgactggtgtttttatcttcacaactacgcgtcttcgctaccggtttgcttctgttgctgccgacttatcttcacgtcatcatggttgtgcaactttatcaccattatggggcgacttcatcttcattatcttcggcaccggcaaattctattgcctctacttcgcaagctatttcaccaaccacgacatctccaagggcctcgacatctcggcatgcaccaccagattcgacaccgtgctattctactacaacaagtggttctgcaattttcaagaattctactcggatatcttcaacacgtatcttcactcaagcaatggctactagacgacaagctacagttctcgactctatgttcagttatttctcaactaaccaaagagtcgggggctacacaaatacaagactcaaaattcgacagatgttatgtcaacatgaagcaatcaattaaccagccaatgagtcattatcttcgtcttcgcttccgagcaagctttctacttcatcaactccaattatttcaccggcaattttcgcttctccgtcgtcgccacggtctacttcaaatttctcaagtatcaagtttgaaatttaatttacatgtccggtagttcaaagttatcaaccaatcagctcaatttcgacgagttgaacaacagcatctactttcctccaagtggagcatctgcaacggctataacaacaagttctactgctattgtcataaatcaagaggcgttgcatcaatctcagttatgcacgcgctatcgtccagaaaactattcgagcttcgacatcttctcaacaatttgaaggattattgtcactgacatcatcactagcacctctacttcatcagccctgacatctccgtcgttgctaagggctgactacgtcttcgccttcggttgcttatgccatcaccgactttcattgccgacttgttctttcgacttcacggttggcctactacgcaactaataatgggagacctcatcgctatcattgactggatcaacgatatcatcatgatcaacatcctgccatgcctcatcggcttcgcgtctacgccgactgcatcacctttagcattaatcttcgacattggcatacatgaggatttacacgcctacaccaccatgaatgctgcttatatttcatcaactacgagctgttgtgggtcaatctcaatgtgtcctttatatggttgaaaacccgaccgacctcatacaaggagtgcgattacgactggcccggctgagtgttcacttggcacccatgctgtcatctgcacatcatctgtctcaatttactcacatcgcacgtaatgtgctgccttggcatcaggatagtcaagcattttctgcatgcaatgacaacctggccgaccaatcaaaaggagccatcctcctacaagcatatgaggttttatgcaaccaattaaaaacaagttgatcaagtcctagcatcgttcttgcatgttggcatgcattatagctgacacgtgtcagtgcttggattacataagcagactagatggaccagcatgagtactaatgctgtggttctattgacaatcgcctacttgggtctgataatcatgatggcaatcctattcataacttggaaaataccaaacagatatgcataagagaaatttatggccatgaccttatttcctatgctcaacgactggactatttattatttcccacgaggaccatcagctgagtatttgcgccagtcggaaccaaattttcatatctactttggtacaaccagcgagggataattactctgatcagaagccgctcatatgagctacacttgatctacatcacccgggatatttgtcactcgggagcatattcataggcgtgctatacacgtcatattttcagggtatcggttgacatattttaggcctaggcctaatatgtctacagcccatattttcaagtgtggcctgtcacgttcttttagggacttaggcagtttttgcataggcaaaagtgcgcgtgatcaagtacccaataccttaaaatccttttataccgctgttactcaactttttaggagttggtacaatgcattttaaaaggtgccaaacagtaaagctttatatagctgccttactgacttttttataagtcaggacgctgtttggatttataaagcaattgattggatacaatatcgttgctttttgccacgtaagtgtgcattcttattgaccaatattatggcttaggctgattatatattttggtcgttttccaggcggttggtaaatcctttatgagtttatttactcggattttacaccacatatgccatatatttctaagtgtggtgaaactatgtgtcttttagggacttaagcacatttgttaaagcagtgtgtgcatggtgtgtgcccaatacatgcttttttatagttgttttttgctatgtaaattttcaaagatgtagacaactttaggttgctcgcatcatattttacaaagcagtcggtatatcactcggatcatgttattcggggattcacaccgcatatgctatatattaatatcaagtcacttggttgactataattatcgaaaaccactcagttggttggattatttattccttgactatatgcttgctttgttcaactagccatatagtcgggggctacacctattaggttaatctagtcgatgtacctaagtttacatttaattattttttagccctccatagtcttttgatttggtaaatgtactcgggagaccatggcaaagatgattgaagcacacggctttggagtaatctggttcgagagaagattatcttttcgactgtgaaggtctcagggctactgtggagattatgggtaccccatacccacacggtatggttatctgactggttataggggataacttatatctatgaaatatgtaacggatcatgacttgggtattacgtttcctatccagaatcctccagtgccacgtaacagtagtagcataacccggtcaagatgctgaatgactctgcacccatcttgtctctatctgctcacttgctagccatgtgcaagatcataacagagggagacaaacagattagagcgggcagcttgatgacagatcacggcaagtgctccacgcatagaggccgggtagtcaggagttccggcgatgagggccatgtacgagcgtagagagggcagaagctagagaccgacgagtggcggcgtcctcaggagtcgcaggctcgcagggggcagcgcgtccggggccgacggtggctgacgcggaggcttgtgcagcagcccccatgctctgccgccgaggatgccgatgctcagcaggccaggaacaacagggccgaccgggcgaacggaggtagtcgtggtggcatgcagcatggaggtacagccagtgatgacgaccccacatccgatctgcgtgaaggtagccgatggtttgctagctgctgatgcttgactcgaatgacgacgaacacaccgcgcagcagcccggagattgcactacttgaggatgcaggctacgaagactcgacgaataggaaagaaaaaaaaaacggtagccgtccccgagagatcagaaccctcccgggggcgatggcagcggaagcgatcagcggcggccctaggtcgcccactctgataagatgttgggtagtatacggataggaatactgtgtaacgtggatcaattgtattgaggctcagggggccagtatatttaggagtacatggggagtagataaggaaggagtacagatatggaagaagtccacacaaatcaatcttatcaaaatatgactctaactaccatgtactctaacattatcagctaatttgttcagctcccttaggatccaattggctccaaattagccttaagctccaatgcctttcttcttgaaagtttcgcgatgatggcactatctgtaagaaagtgaactccctgtaagtccaataatctggcagtctacatcgccagttcaaatgctagaagctcccccagcaaaggtgattgagccattgtggttgtagctctaataaaaatggcattatgagaggaaaggtgtgtgaaagaaaacgccaattcctgttttattatcactccaggcagtgttagcatctaattccattaggcaaattcactattcttgtgtttgtatcttcctcataaagatcctcctgcatcaaatcatttgaaaggaagtttgtataagttttaatcattgcttatgcttccatgcaaacttgagttggctccttgacatttccctgaaacataagatcatttctagctttccaaagctgccacatgatatccaaagtgttagaatatgtgtcgaatatactagtcctatttggttacagttggacttagagttataataggtgttaggggctggagttagagtcggactctgcaacctgacaactctcttaaatagagaggggggcaccacaatgtaaccatggcgactacaatgtctcgtagatacgcagggagatgatgacggcgtggccatagactcgtagcggctaagagctatattgattggggaggagcgcccataattagagccccggggatgtaggcttcggctgaacctcgttaacaaatatcgtgtgttcctgtgtcgtcatctggcgtgtcttcggtgatcaatgactgaagtgatcgggaaggttactcgtcgttccgctatatcgactagcttttataataagtggtatcagagcggaaggtttcagcattggatcaagaagacatgtagaggaggaaacacgaggtgaggatcgtgcatcgacaggagatcgtcagtcgtggcgatgagatcgttggcgacaacgaggatgttgtgggggcaacgacgtcgctcgcgatcagaccggcgatagcggaacgtgaacggaagacgaggccgggcgtggccgaaggcgaccggagagatcgaaggggtagcgccatggacggcgcacccgacgcacgcagcgaacgcggatccgcggcggcaggtatgccagtgacggaagggcgaagccggcgagcgtggcgcggcccagcagacgtgcagggctaggacgacgaggtcgtggacggtgaacacgagggctgcgactatggtgcgtgcggaggcacggacggatagcactggaggttgctatggatcggacgtccgatctgtagcaaatcgtcggacggtgttgcactgtattattgaagaatgaatgtttcactcctcggtaaaaattgtttcaatgaaaatgtttcagatgtttcactatcagataaaaatatttcaacccttaagcaaaattgtttcaatcaaatacaatattcaaacaatactaattgcaacaccaagaaatcaattcatgcaacatcaagtcaaaacgaaatgaaacaccttagtaaaataaagtgcaacaaaaaaaataaataagctgcaacatcactaaaaattcctaaaaaaaaacatacatctatcttcttctattccggccaccggaaacaagtgaccggcatgggagagacaaataaggtgacggtgttagacgcggacgagggcaaatacaacattcaaacacataccaatggcaaacacgaagaatcaatacatgcaacattgaatcaaaatagaatgaaacaccatgatgcaataaagtgcaacagaaaaaacaataggatgcaacctcgctaaaaaactgtgacaaaattaaccgacctctatcttcttctactccggccaccacaaccaccaacacggcagagggaggtgaaagcgcgaggtgggcggactccggccagggcctgggccaaccacatcagatccaacacctcctccccatcccacgtcgccgtcgccgccgccgccgccgccggcgaggtccactgcctccaccctatcccacgtcagcctatgcccctaccatgccgcctctgccactgccgagtggctgtcgtcgagatccagcgcctcctcccaaccacgcgccgccatgcccggccgccgatgccgcgtgtggccgccggcgacgcgtcgccttttctcgcgactcccctggcgtccatgccccgactcttactccgtcgctcatcttcctgccgtctcatagtattttcatttgataaaaatggcgcagtgttggtagttgaagcagagagaaaaaggagaatacgagaaggctagaggagagatgagttattagctggatggataagtctggatggatggatgccgatatgtttcagcgttgactgtttctgcgcggtaggatggaagcgtccgatatttttcgttccgtcggacggcagatgcaaagcattttcggatggcactgggtgctgttctatgcgcacatatatgcacgagaaaccaacgcacagatgcctaatgcatgcaggtggcaaatacatgtacatgggctcgtgaaaagggcatggatgtcacgtgaaatcaatgcattcacactttgtgtgttgctctgattggaaacatcaacatgcaaagggcaggtggcggtacatggaggtctggtgcatgtaaaagaggtcgactcggagacgcaggagttgcaccgtggaaccaagttgcagtaggatggaaattggagatcaacattgggtctgactcggaagaaaattggataggttggatgatttcctgtccgactcgtctagcaaggatctttgagactttcacaagttgaagactgacaagtaccatcaccagcaaagagggtgcacggaggcagcaggcggtctcgcacgtcgacgggcagttcggtggtaggagttcgtgcatgaaaagtgtgtggttttcgatccgacgaggatggccgtacggtcggaccggaaatggctggttagacctaggggcaaagccagtcggattgaggtgaacgtcatatctggcgaagaaatgatatatctaggactcgatgaggtgttgagatatatggagtgaggctagaactgaagaaaatcccgggcaacagcgagtcaaatatcgttgatggggtcaacgatactgtttagcagtacaggatatatccaagatatgcagatcgacatgatgggaatatatgaaaatctgcgtcactgaagaggaatttcttcgggtgattcaagacaacggtgaattttctcaaattattaggaatttagtctacggatacgaaaagcgtgaatgttggatttgttagctcagttcataagatgacaaggaagaaagggttctcttcgtgtctaatgagtttgatttatctatttggtgatgacatcggttatctggccatggattagatcaagtcaaattttaagacggaaggtggatgtgaacatggtattcggggagtctattatgtgatagttaggaagaaattcaattcgcttggcaagacgactatggtgatatgagagaaggtggagtactgttgcaggtggaatcaagtggaagaaattacagggatagcggagtctcttgaaagcggtgtgtctggcgcagactcatcgagcggctcctggtgaagctgcaaaagaaaacaacccaagtctggaggacaggtagatcagcatggtgattctacgacttctgggtggcgtatattcgccaaggtggagtttgttagaatatgtgtcgaatatactagtcctatttggttacagttggacttggagttataataggtgttaggagctggagttagagtcggactctgcaacctagcatctctgttaaatagagaggggagcaccacaatgtaactatggcgactacaatgtagcgcagacacgcagggagatgatggcggcgtggccatattctcgtagcggctaggagctatatttattggggaggagcgcctataatcagagccccggggatgtaggtttcggctgaacctcattaacaaatatcgtgtgttcctgtgtcgtcatctggcatatcttgggtgatcaatgactgaagcgatcgggaaggttagtcgtcgttccgctatatcgactaacttttataacacaaagttcgaattaaggtggaattggaagagccattgttaatgatgtaagcaataagaagagccataggaacattaggtggaaaaatatcagtattgagctttgcttctgagattatccaagttaatttactaatataaaaagaaaaaaggaggtggaaatctgtttctatttgacaacatcagcagcaggctgctgaaatgttttgaatcctctgatttagcctttgggaagaaggaaagggcgtccatgttgagtctccaagcaaaagttttaactttgggagggacgtacctgttcttccagatttgtttcaagatagaaagtgattgagagttaacctaatgagcatttgaattttcttttttgtaaacctccttataagcactctttgtactgcagataccattgtttgtgaatttccaacatagtttatcttctgttacctgctgaatcatttgaacctgcaaaatctatctatctttatatactaaaagtccattaaactttctaaaaatgctctcaagccgccacgtggcttcctccaaacgctcttaaattgacaagtggcaatctaataaaccggtggacccactatttttaatatattagatttaatttacctttaaaaaaaagagactccacgattctcctcattttcctgttccacaccggcccacctaattaaatatgtactctcttcctctacttctccggatatattggaccaaatgaatatatttccaaacaaaacaaaagcacacgacgtatcctcctgccgcacatacacacatgtgcgtttctcctctctgtctctgtgtagtgtaggtacttcccccggccctctctggaatgtactagctaacaacctcatactgtcatacataaacttaagtagtgctcataatttttacgaagtaatacgataactccacaacgatgtgccgacaaatcaaaacattaaatagctaggctttcaacatgcgtgctgcttgctttaggctgtgttcgggaagaggggttgggaacccctcctctccggcacataaaacgatgtgtgcattagcgcatgattaattaactattagtttttttaaaaaaatagactaatatgatattttaaagtaactttcgtatagaaaatttttataaaaaaaagcacaccgtttattatatagtttgaaaagtgtgaacacggaaaacaagagataagttaggattgtgaggtaaagaactcagcctaatttggttatccaaataggctaacctgtaatcaactagggattaatgcaattagcattaggtcttcaacaaatgcgggtgtgcactattttcttttactcgctaaacaacaagcatcctaaataatcaacaattttgcggacccattaaaattagatcgatggtgtctttaaaaaactatagattcaaccatggtaaataataatttttaggtactagacttctacactttgtatgtttttttaattaccatttaaaaaaatctatagtaaaagtccattaacctacaaaggcacctatactatcacgttatatacctataaacactcctaaattaccacgtggtattatagtaaatcggtggacctctattttcaactattggattttatttttttgaataacaaaaactacaacccacattcctctcctctcttccatcggcccaactctcctctcaccactggcccacccttctcaccaccccacgcacatacgtacgtacacctcctctgtctccaataattaatcctttctctcaccttcatatttcctaactaacaattttaattctaaaagttattataaagaagaaatattaaaccaacaattttcaattaaattggtgacctgtaatttaacaattggattgtcacatatagataattaaaaccgatgaactcattaaatctacctctataaaaatcaaaatctcctcactcaataacaataaaacattaaaaaaactgaaattctatattacgtagtcttagaatcgttttacataataaaaatcaacttagcgtgctctataacgctattaagtcataatgtatcacattttaaaagttagataaaatataattcaacgaaaaaataaaacatctatctgtcggttttcacttaaatcaatgacccattatttttaactattagatcttctttctctataaaaaaaatcttaatccaccacatatatatcatctgttaaagatttttagaatgagaaaacaacaaattctcacctacattatttagaaacattagaaaaacaatgtcccctccacctccctctccaaccatatgtgcacaacactattacactgccaacccatctctagctcgagttctatgttattcgttcctctccaatctcctctctattttcagctactaaaataaagagataaacaaatattgaaaataccataattttaaactacgcatataagtttctaatataattgttgctttatttataattaaagcacaattcaagatccatgtgcctatattttgttatataaaaatatgacatttgggcacattccaccgtgcactttgcaggttatccaaatagtgatggaatataaaaaacattatcgacatatatttcgtaattatacatcaatcttttttaatgatgcacaacatcccttcctttttacattttattcaaatttccattaaaaactatgaaataactcaacaacataagttgcaccatcatatattattttgcaaccctacatgactaaattagacattcagttcgcaaaaaatagcccaaacacgaatatttcaagcgagtacatagaaaacagttcatagggataatcatccaaattgccataaaagaataaaaaaaatcaaaaaacactgattgtatgtgcattgttttttcaaatagagttaaactagatatacatatataagaaatataactatctcaaatctaattgtctaaaaattggtgcttttacttagataaaagaatccgattaattcatgatactttttgcaattaatatgctcaaataatccaaacaagccaaccgatcttctgccaaagtgtcctaaactttatttaagtcgattagatgattgcttttttttatataaaggcgccatatattaccccgcacttactcctaggccttttaaaccgatgaacacattattttcatccgttagatctatctcatcttaaaaaacaagtgtgtattcatgatgcatcacattcaaaaaaatatatatagcgcaactatatttcttcatccaactgtattcactctaggttgcctggagcctcccacatactctacacataacattcgcatatggattgtctcttaaactatataattatattagactatataaacacgtgcatttagggaagcctcatatcagaccaattcacccgtcgataaacaatgataacctatattcaattaaaaaacgccttacttttgacatgacactttatttgatatacatgtttctaacataaaataagtctaccttctttttagatgatgaagaagattaattataaataattatttgtagggattaattaaatattatttgctataaagctaactaatagctaggttagaaaattataaaagcaatgctgatggaaacaatttatggagaaattgtatatagcatatgttcaaattaacatagcctacgacacatatccgcgcgaatgcgcgggctacctttctagttttgttaacagcatgaccattaaaaatggagttgagcttgtggatgtcccagcttttatcgcggcatagattcgtaattcagtgaaaagagagaatgaggagagtactactgacgcttttcataggggaggacagggagctgagcagcgaggagttggaggagcagtagtgataggaaaaacggatcaaactcatcaaagtgattcaatttttgcattggagatcaagaaagagattagctagtagattagaagtggcgatctggccttcactgaagcagagttgtgcgaacagactgtcattgctgagggaggaggaggagggagattgagaggtaactgggagttggaaaaacggatacaagctacaactcttgacggagacttaatttttgttgtttgtggcaaaaattgatggggaatatgaagggatcagtgagaatagatggaagggacttcatggccttcccttcatggcgatttgtggcaaaaaaacagatgaagaaagcgcggtggttcaagttatgacgatgccgcacgcgcggaggactgaaaattggttgcagggtggtatcggcccaagctaggctggtgcacatactccgtccgtcccataaaaaatcaacttagtataggatgtgacacattttagtgctatgaatatgaatatatctttttacagatttattgtagtagactatgtcatattcatattcagtattagattcattttttttcggaacagatagagtatatgtgtggtgtgaggacatgggctgtgttactttgactgatgcaccctgagaaaggacagatggagagagagagagagaagagatcaggaggaggcaacaagaggaatccggaaggaaaagaaaaaaaaaacaaaggaagagaggaaataggaaaagataaaggaagaaaagaaaaggataggattttttttgggaaactttctggatttgggatttgtaggatttggcagaattcatgaatttgagctctacttccaaatctcaaataaaaaccaaataactccaattaacaaacgataaaaaaaaataaatggatggcataattgatttatttagtcaatttaaactttgtttgatttatgaacttttcattaacctatttgagacgaataaatccgaatgtaaattttcgaaattaggcaaattcaaaaacacaaaaaacaggacatgataatttttcttgtcatataaaaacaatcgtgttcgaatgaacgaatagttaaaccgatcaccttaagaaagatattaataataaaaagaagagatttggtaaaccgttttggacctccttgtgcgacccacaccatgctctatctttagcacggcacgtctgcattccttttttttccaccgtctctggaaatctacattgattttctttctcctggatagtgtcttattaaatttcacaatgaagttcctccatttctcctcgtaccaccaaattatttactattactaccatatatatcgttacatccatgtaaatataaacacgactcatttcatttcaagtttagatcacagccataccattccccgtgtcacccttcctctgctcttgggccacaaccctctggtcattcctatatacatacctcctcgcgaagaacacgtagatcaccagcgccaccacctcgatgatgcagaggacgacatagaaccggtcgagcttgcccttgttcaaattggccccatccagccaccctccgccgttggttcgctgggtgacacggttcgtgacctggatgagaaggctgccgagccatgctgatacaccgaggatacagtagaagatggagctgccgatggacttcatccccatggacgcctcgctgcagaagaactcgaggagcccgacgaaggaggtgacgtcgacaatgccaatgaggaagaactgcggcgtcagccagaacacggacagcgggatcccagtggtggcgtcctctagcccgctctcctcggcggtcatcttcctcctcgtctccaccaccgcggcgattgcggtggcaacgatagtagcgacgaacccgatgccgatccgctggaggtgggtgactccaccgacgtagcccgtgagcctgcgcagcggcggcacgatggcgcggtcgtagatgatgaggatgaccatctggaagacggtcgggatgaggaacagcgtcgccggcgagatgtggactgcgccgagcctggtgtccatggtgttgccctgctgcacggtgaggctgaggagcagcggcaccgggatgtagctgagaacagcggccacgaagatgggcgccatgcgcagcacgatcttggtctcctccacctgggtcacgctgcacagagaccatggcccagcgtcattgccagtttccactgccgctttctccaagcacctgcaagccaatgaaaatcttgatgctacttattaagttgaatggacaaacttatttaacctataaacttcaactgttgagagaaagaatgcaatttacttataatccaacgctatcgacacaaaaagtctgtttcatgccttgtaaatggaatattatagaagtgggttgccatattttatttaattgaatgtctatcatgttttcatcctgagacatctggctttgtgccattatgtcgatatagaagatacatttaccatttgaacccgaaatcttaatctggtgagagaagatgcaccatcataattatacacctctgcaccaacattaccgacagacaaagtctaaatcttgccaatgttcagagtttggacaacataccgaaatccatctgttttggggagaacttcgtgggcattggcatcgtcatcttggttaatttgcttcaattcgctgggattctccggcaaccggacgtttcttttcttgaatgccgctacaaaaacctgagatacatagctttattatagtgtcatggacacagctccaatcgaaaaagaattaaaccaaaagaacagttttgctattcgtcatccgctttaaactattttatttatgggttcttcttaacttacacatatattttgtttgaaacaaactaaacttacaaaaatatagcttcaatttacactgcaatctattttttggggggaatacacagaagacttcaacatgtttgtattaacattggggaatttgcagtgcaatcttagacgaaatttagctctgcctatacaattttagcaaaattttgtagccttaatcaaggaccctgtttgtcagtctcgtatcatctaaacatccacaaatataacttcacacaaccttcaatacaaattacacaaaacatttaattactgcaacattcagaaatctcaaaagaggttatatcaaacacaaccatcgataattcgatttcatatacacacctgcaatactcttgtgatggggctccccatcggcagctggttccggtagagcgggaaggcggcggcccagacgagcaagccgagcgcgacgaaggcggcggagacggcgaagccgacgccccaccccttgctgttctgcacccacacgatgaagacgaggccgacgaagccgccggtggagacggcgaaggtgtaccagttgtagaagctcgtctcctgccgctgctcgtccgggtcgcccaggtcgaactggtccccgcccagcgccggcaggcacgccctcgccgcgccgtcgccgatcgggatcaggtacagccccagcagcagcaggctcaggttcgcgccgcgcaccggctcgcaggtggtggtggcgctcgccgccgtggccgccgggctgcacggcggcgggtgcagcgaggtggtgtacgcttgaactgctagaaggatgtagccctgccatggagtaaccatgcatccatttgtcagaactgataagcttgtttggatggttattttcttattcatgatcttgtgctaaacaaatttgtcctttgttttaattttgagaaattttacaattcttaagaagtcaaatactaaaatttcacattacgaattttgatacctttagagatatagtatgtgaagatttcaagttttacacttaaaactatggtatctcctgatactttagtaagaaatgataaatttaccctgtgaagatatttaccggttggaaggcagaattaatacttataatttaaatttcaaatactaggttttctgctggtctaaaatttaattttcaatttgaatttggtttccgaaattgggtaatcctgtcatcaaccaattttagcactgccagctagtgcagtttctattagaaaaccgcatcaatactgattacggacctgcagtattaggccttactttcaattctatataaccaattttgccctgttaatttatttcccaggggattcaagagaattttgagaataattcctcaattccctcctaagaattagctgaaaaagctcttatggtttggtttagataataagaaatcataggtgaaattgggacgtggaaatgaataaagtattaggataagaaaatgtgagagaaaatggatatctagtatttaaagttactccttaataggttgaaattcatttctctttcccattatccaaacatactcttagatttttttagtcgtcgaaagttactccttaataggttgaaattcatttctcttttctacttaacttgatgtcgcttatcaatcaattatttggttgtggacatccttttcctaattaaaaatctggccattaatcagcactcggcagtctgattgccaatcacatcggtataatcatacctattgtagttgagagagcagttccaaagttgacagcttctagaaaggttgtcgaagaaaagatcgagtaggtgctatgtagtaagaaaaagtgactaatggcgagttagtaaataatataaaatatattatatgtcgtttcttggatgataatgctccaataatcatgtgagatcatgataacatgtgtttattaaaacccttaggtctttttattttgagagcgctattcctcaagtatttcactattactcacaccctaccaacttcatctgcaccatatcacaaaaaaaaaaatcgtttcgtcccaataatgctcaactctgtctcccatccccccccccaaaaaaaaaaaaaatctgtctcccatgataggctgcatgactgcatctttcgttgcctaatgcctatcatcattatctatgccccatatacatatatggtgatgtgtttccttctcctaccatgcataaaaccacagtgggtggtctgttgttggggacacctagcttctttgttactctctttagataaatcgaatgcctgcagtctaattaattattcaattttgaaatttggggtaaaacctgttactatcggattgaaatagagcacataagtgagagaacgtcaggcgataccctatagcatttagatttgaaaatgagttgaaatttacatcatggtgctatatgtcaccatggaaaattttatttaaaaatcgattatgcatcaaggaaattaaaggaaaagataagtttatgctttgcagactgacagaacagtaagttcactgtccatggaattttgcattttgtcaggggccgatccactgccctgttgttgtgttgaacagcttcaattttgcacatattttctgccaacatttacatgtatttttccgctacctccagagctgcaatgtcgttctaggctatcaacgtggtgggttgcttagttgcttgcttatatctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcagatcgctcgcctcgcctggcagggcagatcagggtcactctgtggctgacagctatgaaatgcttctggcaaacctgagaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatggttgtaaacctgtggggtgcaagtgggtgttcaagaagaagcttaggcctgacggtactattgaaaaatacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaacattgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgatcctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaataattctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctggcctggcctggcctggcctgggcagggcagggcaggcggcgcgcgtgcacgacgtacgcgtcgaatggtctcgaatcgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatacgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacaaaaacatgctaagattattcgatgtttacagtagcagtatagtcgccgaagcaaatacagatcaaatgcttcgaacaatcacttgatgggctgactcggtgagcatcccgctccaccatagtagaactgcaagccatcgtccgtggtgtaaggacgcccaacatcgtagcagtttggctcagttgcaaccgtgttgattgttttgagagcaggagttgcaaagcttcccgacgcgtcgatcaccttcgcatcggcgaagaaagcggcctttgtctctccttcatcagcaggctggccactgcccatgggaggaaaaggttcccctggagcagcttctactacacccatccaactgatcacgtctgcagcttcagacatgtgagtcaagagctttgatggccagtaccccactatttcttctccaactttcagcacccagtctcccatgaactattcattccagagaaaaaaaatcagatatacaaagtgtcccagttaaataatgcaaggttattggcacagtaaaggattatttaccttaataatcttaactctaatgatgtattgttttccattgacagtggaaactggcctgattattattccagggattgcctttttgctcatctgaacaaaccccgcacaacgaaggttgatacatgacttatcattatcaacctgttgcatgtaaagcaggaaacagttatttctcatgtttcctcctttggttaatacaaattgacagatggcatttttggcacacattcttacccacgcgatctcgaaatgaacaagattgtctccgtacagatgtggatcaacctgcgatcgaagcaccataggtttttacattagtatttgactgcaaagtatgtcaaaatgttcaacatttcatatgtactattgagggttagtacaagtttattgtttcaataaatgtaccatttctgatatgacaaaaagtcttcttctgatgtaaatagatttaactgtcaaaatgagattctttgagattattaagaacttacagaccatcctacagctacacgacttcctccattttttagaacaacaattgccccactaaaccttggtggacgtcctgtaccaagatctgtttcccatattgaaattgatgtttgtagtccgtaaaaagtagatggcactataacaactgcagccatctagaacaaaacagagaaggggagtcaatattaatgtacgattaataaaaacaattctaagcataggaaagaaaacatgggagataatgcaactacagaactataattcttacttgtctatttcctttgtcatttctgttctcactgtatataatcttatcgaatgatcttgtactcatggatccattgtagcttgttaggattggcaccgtccctgggggacactcaatttcgctcatctcaacattagagatgccaaatttagatccttcatcatcatcggtactgtgaggaaaggaaattggtggcatctgcattaagagtaagattcaagatgtatctaataaaaagttattgatgtttcttgggaaaaccatgcatgactaatatgaaatataagaaaataataacctaccaactgagtggtatgattcatcagcaaaggatgcctcaaggatggttgcgatttgaaactaacacaggcaaaggtttgcccatctgcggtctgaaattcgagcaacacaacagctttggatcagaacagatactgtaatcgtgcgttgttaaaatgcaatgtatacctgaatcgtcttgatgattaaattgttgtcaacctcttcttttgtcggatctacactgaatattagcaaatgaagtagaagaaatgtttttatggtccatcctttgtatcccatggtcagagactttgcatagatatgtatggtaaaatctatgcgaaataatgtacttatatcaatatgaataagcacataaatctaaatcttaaccaccatatttattgctttcataaatatacatctaaaccaacatatttattgctagcatcataatagcaaatgaatcgtcttcctttatttagcatttatatcttctttagtattttccattttcacttgtagacagaaatgcactagtttcaggggatgcacatttatgttgtcagactttcataaatggtgctgactgatttcaccaataaactataaactgaaacaaatgtttggattgccttccgcatttttgaaaatcaattgattgaacctatctttcttctttgtgtaactattaaaatatatatcttaggatggcgtagacaagcatggacatttagctattggacgcctagcacaaggattgaattcagcaaggtccttaaatgaactttaagggattcttacaacaatgaaaattctagacaaatacgtaaaattttgtgcatcattccattttgtgaagtagctgtttacacccaaatttagcacctagagtcgaaatagggaaatatttccaaaatttggaatgcgtcgggtttccttcatggggtcggtctaactaccgcctatgggcgggtctgaccgacatgtagcgctagtctgaccgccagcatgtggttggtcagaccggcagagtccgattctgtcaggtctcgggtttccttgcttcggaaggtattttttgagtttcaattagtttctacccagagttagacatggaggagaacttatagaaggcaataccaacccctttataagggctaaggctggttcgattctagcccccaatatctcaatccctacacaattgaatcattcttttccctttactttttagccatgtcttttacgttaccctagtttcatccatatttgtcgatttgcgttgtaaaacgtccacctttgccgtgagagtgcgatcatccctttgtaggtttgccctgtaaaccttccgttcaaccacgagatgggtggttatattcaaatcgatctaaattgtcctcgtggctagttttgatctctaaatcagctccagtagccggttcaatcttcaaaacccatattgatttagagttatctagatcgaggtggttggtgactccattaacaccgccaaccttttaggtgagtctcgtgttgggatcgaaaaagacgccaatagcagccttggatgcaaatctttaatacatataaatggcaaattgtcctaagtttctcaaaaaaaaaaataagacttcatatgcagacctgaactaaatttaaaataatagatgtgtttgaaaatcgaagtaatgttgttttgttgtcaatgtggccttttcgtgtggtcagtgatgtatgagagagctttctcaacctaaatccatcgttgtccgatctgttggatttgtagttaaagctaacatgtatgaaatattctatccctcttggctcaagctatagaggcaatgttgagccgggagggatcacacttttttttgctagtgtacctttctttaaatgtttaacaaaagggacaagccttgccgctaatcagctgtgaaggcctgccttgctagcccacaacccagtgctggcgaacagcgatcactactacaaaatcggtttttcatggcggaaccatatttttttcgctgacggccctgtgcataatccgcctgcgaaattgaaacgatgagtgaggggataaaaaccgccagcgaaaatagattttctctgacggttgagttatgtagcatgctagtgaagatatatatagctattttcgctggtggctcacttaaccaaccgccagcgaaaatcgattctcgctggcgatagctaaagaggtccgcttgcataatattatcaccaaatataaattgaccacgtggctcaccacctagtgccacccaccccttcctctctctctctccaccaccaccacccaggctggcagtaccctctctttcctcctcctctcccctctcatccctctcctcttggcgcggcaatgacggcgaggaggggaggagaccgcctgcagcacggcaacagtagaggggagagtgtatgtggctctcccaatccactcccctcccagatctggttaaatatacgggagctcgagaagggcgcggcgcggcaaaggggtaggtggcgttggcagcaggtgcgagtgctcggctacggctccctcctcactcacccttcttcgcgcggcatcagcggcggcaacctcctccctcgatcctctcccctctgaaacctctcttggcgcagcatcgacgaccagaggcgtcctagtggcggtgggattcggatccggttgcaggaggggaggaggctggtggcggtgccggcggtagcgccccactctcctcccctctcagatctggccgaaggaaaggaggccatcaacggcgtgacaacagtagaggggagagtggcggtggctcccctactcccctcccgtcctatatttggccttatgagagctcgagaagggggcggcgtggcaaagggggaggtggcggtggtggccggtgacgacaaagggcaggggctgcataggtggatgtggctgatctggccgtggaggcgatggatccagccatggaggcagcggcgagtagatccagtcggcgacccgtctcccagatctgggtatgtatcctctccctgcagtctctctgtttcccatccatggatgttcatggatgcattggttagtgatctgtctcacaggacatgacaagatcgctggtgctgtggttgagggagcttgcagatcgttgtttactgtttaatgtagattgaaaattcgtgaatgttgtaaatctgtctttagtttttctgttattcatttgtagatttgtgaaacgagtaaatgctataaattgtggtgctctatggatctggcaatttgggattcacttttgtgatttgggaataattgttctggattggtgatctggtatgcatgagggtattttttttcccaaaatcatctacgctggcggtcgtcctgaccagccaccagtgaaaataacctcatcgcagatggttagcttaacctagccgccagcaaaaaccattttcgctagcggctggcttaggtcaccgtcaatgaaaataatttttcgctagcggctattggccgtcagcgaaaatggtgtgtttttactagccattagtcactggcggtagcgttggccgcatgagaaaactcaaaacggtcacgaaaaatccattttgtagtagtggaggcgaactggttcatcactgcaggtttgaattgcttaatggtaaatgtgtgtgtcgttctctgggaagaataaacactgaaggtttggtttaatacccttttgctcttaccaactagaagttattccgaaagttgatggcttgaaaaacatgtgaattagtttttttttagataatggaatttaacatcccagcctttgctcaaaaagagctacagccaattattacattgtatcaatccagaaaagaacgtagttcagctaaataggacaccaaacaaaaacagaggaaactaagccaaaataaggagaacacatttattgaagtctatttgtgaacctccatctataattggcaaataattgcataaccatggactccaacttgcggtatgcaacctttagaaactccctatcatcctcacacctttgtagctgtgcccaaaaccggagccagtgcgttgccctgaaaattacctgcatatatgaaatagatggtgatttattaaaaaccaaatcatttctactcaaccatagagcccaacaaatggcagaagctccaaccagtattagtttaatctttttcttgtcaatccccaaaagccatccatcaaatatatgagatatactagttggaagattaaaaccaaaagaaaactgaactgctctccatatgaattttgcataatgacaatccatgaagagatgttgaatagtttcatttttcatacaaaagcaacaccttaagctaccattccaattctgtctcgccaaattatccttggtcaacacaacccccttaagcaaataccacataaagattttaattttaagcggcatcttaagtttccatatatatttgttcctctcaacataaccattgttaattaaacctagatacattgaccttactgagaacctaccattctgatgataattatatctaaaacagtcagaagaaggatttaattgaatatgtacaatagaagcacataactcatgccaatatacaagattctgaccaactaaagctcttctaaaagaaacattaagcggaacagatcccataacagtggcaatagtggatgatttccttcggactatagcatataaagatggaaatttatccttgaaagccaagttacctagccatttatcttcccaaaatcttatttgttccccatcattcacaatccaagagcccatatctaaaaaagtacttttgactttcataagtcctgacaaaaaatgggaatcaccttgtttcttgtccacttaggttatagacttgttataaagatatttccttttcaataagttctgccaaaccccttcctcatttattagcttgtacaaccacttactcaaaagacatttattttgtaattccaaattatgaatcccaaggcctccctgatccttaggttggcaaataatatcccatctagtgagtctgtactttttcttatgatcatcaccttgccaaaagaaccgtgatctataataatcaatcttttgaagaacccctttgggtatctcgaacaaagatatcataaacatagctaaacttgaaagtacagaattaatcaagaccaaccttccctcgacagataaatgtttacctttccaactactaagctttttctcaattctttcttcaatcactttccaatctttattagatagtttcctaaaatgcattggaattcctaaatatttaacagggaaagaaccttacaaccaaagatattggaatattgatcataacactcctttgcctgaccaaaacaaaataattcacttttgtgaaaatttatttttaagccaaatagcttttcaaaaacagttaaaatcaatttaag

SEQ ID NO: 70185 - DNA, 742 bp, Oryza sativa
  unsure (1)..(742): unsure at all n locations
gaggtgaggcggtggcacatggggtagcacatagccgttttgaaataaaagcaagaagggtattcatgacgcagtaggttagagggtgacgagtaaagcaagtagtgtgagaggaagggtaagaagtagcaattggagattggggtgggggaagaagttaacgtggagaagagagtaaggagaaagtaaggctgtggaaaggacgagaagggcgaagtagggaggagatttagagtagcagtatggttggcgcgttcgggacggatgagagtaagagagggtaagccgctccgattanaagcgggggtggggngagagangcgggaaccggggcggggggggngtgggggggggnnnnggnnaagnnnnngnntccccccccccccccccccccccgcgacgagcgtcggcgacggcggcggctggctggctggctgcctcactcctctcatcgaagatcgatttctctcctcctcaacccgctacctcgcctcgcttggatcgaagaaggtacccttctctcattctcctctcggcggctaccgaaccgggcagcccgccctgggtgggattggttcctttatttggcgatgaactactacacgcacctccttccacgtggcaccaagccttctcctccaagtcacctcgctcgnnnnnnnnnnnnnnnnnnnnnnnnnnnnnnnnnnnnnnnnnnnnnnnnnnnnnnnnnnnnncattgctatcaaannnnannccgcgg

SEQ ID NO: 70186 - DNA, 707 bp, Oryza sativa
  unsure (1)..(707): unsure at all n locations
ttgcttactcgaaccgccgaaggggatgggtcgagggttaagcccgacggcgatgctcggcggcggctggacgtgaagctcgacgagcgcgccgtcaggccgaagccggaggttgtcggccgaaggtcctcgccgctcgtgttgacgccggcttgcatctgcgtcagcggcgaaggcggagccgcccccgcaacgtggactggttcgttgaactccatgcggatccacggcatggtgaagctgaaggagccggttggaccaaggttgaggaacagcgcaccgacgacgaggatcaggacgacgacgaccgggccgaggcgacggcggcgcggtgccccagctgggcggcggcctgaccgcctgagggagaagaggggaatcgagggagaagactgagtgaaagggcaagagcgacattttttctacccgggcccatatgtcagagctgccaaatagttaaatctaaacggaatagcaacggaacggtgtggagggcgcgataaaattcgacaatggtataaagggagggctcaaatattttagtggcacagggacatatagggccattttggtttgatgccaattcttgcccaaccaattctttggtagttttgaatagtacatnnnnnnnnnnnnnnnnnnnnnnnnnnnnnnnnnnnnnnnnnnnnnnnnnnnnnnnnnaaagagagattctaatggggggcagc

SEQ ID NO: 70187 - DNA, 533 bp, Oryza sativa
tttttttttcatgtatcaaggattgctgacgctgaagagaatttgggtgggattgaagtgcgtgaggcccatctagctgaatccttgtacttcataagtgtcaggcagaaggtataaatctgtatttttctatactttaccctgtggtctggttgacatagtacatgctcgaaatttagctacttcagggacaggggacctcctgtcctgttgcaggtccttggagggaagtcttagaatcaggacacttctgaattgttcacactggtatgaaagaggaggttccatctagatcatgtcaagttaaatacttaaatcaggaaaatctcgtaaatggggtcttggaaaagctaaagatttgcagtcggagtggtcaaaaaatagatttcctttgtatgcttttggtttatgctgctgcttttatgctcccactcatgcaatgatatgataaaagatcacatggtaatatggtatcgatttgctcagtcgctactttgttgtcctaggtaaattgtatgcatgcttggcgtctg

SEQ ID NO: 70188 - DNA, 736 bp, Oryza sativa
  unsure (1)..(736): unsure at all n locations
ccaaccatttatatataaaagcatgataatgcaggtaaagaacccccatggtatgtagcacaactacgacatagtagcttgttccaagggcacacggactataggatgcagataaagagcattcttcctacccacagtgatgcccatctcatctgtcatgtctagttcgttcggtgcaactcctttagggagctcccagtcgaagtggtacagaagcattgcaagcatgagctccacggtagcatgtccgaatgtcatgccagggcaaatcctcctacccgcaccaaacggtatatactcgaaatttgcacctttaaagtcgatctttccactgtgaaaccgttccggcttgaacacctcaggctcatcccagtgcgtagggtctctgttaatcgcccatacgttaacgaacacggtgggttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatactaaaaacgtttcacaatgtaagtcattatagcatttctctcacatttatatnnnnnnnnnnnnnnnnnnnnnnnnnnnnnngtgcnttgtgcacgcacactgaagacatt

SEQ ID NO: 70189 - DNA, 680 bp, Oryza sativa
  unsure (1)..(680): unsure at all n locations
gcgtggcattatatatcctatnnnnnnnnnnnnnnnnnnnnnnnnnnnnnnnnnnnnnnnnnnnnnnnnnnnnnnnnntttgtgacttaaaagcccatgttgaaaaagaaactacgttgaaaatatctcaaaatcaatctcaaaattaagcttgaaaattcaaattttggctttttctttggcttattaggccatctgatgggagccttacagaaactggaatatccagaaaatcatacaaatattaaaaaaataacaaaattacaaagccaacaggttatcttcagagtaatgtgagtatagtgcacaaaaaaacagtttaacatgaatattggatcaagactcttcagacagcaccctagattctgtttggtaaatcaagaataatataaaatcacctcctgtctcgttcttacaccacaggatggcaaagtggaaacacaaactaaaacaatgtttctgagatgtgtcgcccataaatatgatgccgatttcagtacataaaagctcctaattccaagaaaatatactacagatcgatccgcccttgaccctaggtcaaaatggcaaccttagtatggttatagtaccatctcaaatcctaaacaagatgttgtggtacatgcaagcaactgtattgattaaagacaagtatcgctataactcaagattggtacctt

SEQ ID NO: 70190 - DNA, 884 bp, Oryza sativa
  unsure (1)..(884): unsure at all n locations
aaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttgatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaacttgtcagaggtgaaaatgagtcagatnnnnnnnnnnnnnnnnnnnnnnnnnnnnnnnnnnnnnnnnnnnnnnnnnnnnnnnnnnnnnnnnnnnnnnnnnnnnnnnnnnnnnaagacacagcccacgaagccagttgcacggcccaccatttgctacgtatgcaggttatacagagaccatataacagatggtctgcaattatacgtggaattcaaagtatttcttttaccagcatgtatctatttgtcgggtgatttctaataaaaaaaatcacccaattttttttaccctttatttatatccaacggactacaaaagaaaaataacaaatacatattaacttacacattatttttatcaaaattacagtacacttacatgtcaaatcaactaaatttacaaatgtaattttagttatataggactgtaattttaaaatataattttatattttaaagaaaataataagtacatatttacttacacattatttttatcaaaaattacagtgcacttatatgtcaaatcaattaaaattaca

SEQ ID NO: 70191 - DNA, 750 bp, Oryza sativa
  unsure (1)..(750): unsure at all n locations
gcgtgcattaggatcaccctnnnnnnnnnnnnnnnnnnnnnnnnnnnnnnnnnnnnnnnnnnnnattcatgaatcggggagtcaatccaaagaacgataagggagcagataagatttcggaagcacccaaatcctatacctatgtttatactccccagatctacccggggaagccgccgacaccagctgggtcacccataacagcccccggaggacatgcgagtccccattggacatgatgagagagggtgccgacatcgacgtggccaccagaatcgactatgggaagctgacgacgctgcctgtgccacctatgaaagccgggagaggacgtgccaccgacgtcgaacacagtgggagatggcgccgccaccgtcggcgctcatgttgagggagggcactgatgacactcatgttaagagatggcgcccgcgtcgccggcgtcgcttgcattggtgagggggccttcaccgcacatgatcacggtggagaagggccctgtcagtgtcacttgccaagggggtcaaaaaaattatttctagctcaatggagtcaccaagtaatgcaattattgattttttatgatatataatcctaatcaggtatagatggaattcattgtttatgcctaggagtatgccatataattgccatgaaactatgaaatatccatgattattatcataacatcacgtttggtcgttgcaacgcacggtcactttctatcgtacaaagataagggcattacgt

SEQ ID NO: 70192 - DNA, 511 bp, Oryza sativa
tcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacatcaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaattacatctatttgcagcggaaaactataaaaatcatatgaacagtagcaaaatctctgtaattctctctctgtgaaaattctcccgttggttcaaatttaaa

SEQ ID NO: 70193 - DNA, 740 bp, Oryza sativa
  unsure (1)..(740): unsure at all n locations
atgcgcctttgatgactgatgatccnattcgaannnnnnnnnnnnnnnnnnnnnnnnnnnnnnnnnnnnnnnnnnnnnnnnnnnntaattttttgcgccgatagattatttctgtaaatattaaaagaaaaaaattaaaaatgaaaaaaattccttgcccggagatggtctccacggagtcgccggcccagctagctgcagcccaaggccggagcaggccggcccacaggccgtatccctcggcccagtacgggatcaagtcggacttgcgggccaggtcaactccaattcggactcttgagctcgtcgcatcgcagtgatcatgtcggagtcaacgggttcatcatcatatccgtggcgctataaatttgcagcgagcacgtcgtctcccttttatcacatctttcaagaatccatcaccgagctcgcggcctagctccgcgcccagagcgcgccatggattatctctatctggatgatgccgacgccgacgtcgaggctatgcttcgggagatcgcggncgccgtcgccgccaatggtcccggcgagcagcttgctgcgacaagacggacggnagctactgccccgcaagagatccgccttgccgggttggacttacgacgccgacctgtacgccaagcctccggccattgaaatggcccccgccgagcggtctttcccgactactgaccccgggcaacgcggccggtctaccttggacccccgcgtcttcgtggctg

SEQ ID NO: 70194 - DNA, 678 bp, Oryza sativa
cacgccgtgaacactctatgatcatcgcaggggagctgttctatccatagctaatctattattaacccatgctgacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatacggagcgtcgatccctcgcccacacggtacttaatttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagcttcagaggcgcacactcaggagcagccagaggtcacacctgtacaggcaggacgggttggccgtgccgtacccccagaccgactcacgtactcccaggggcacattaaggcgcagggtaagagggacaagggtaagaggcctcgtcagtagtgttctacctcttcagttcttatgtgaccgtttcttttggcttacaaactttgtaagcagtactaattttg

SEQ ID NO: 70195 - DNA, 5712 bp, Oryza sativa
aaaataataaatagaaattagagggagattagggaagttagaaaatttaaaataattagaatttaattatagatcaattatagtcgtagaattgcaaaatttaatataattatagattattttggtaatctctataggtgctcaattcacggtagatactcggattttattaataggaattttagacgtatattatatttaatcgtttagtcatagactaaattaaatcgtataatattataagataattttaggattccgtccaatatttagctcgcgatagaaatttctaacctattatatggatataatgctcgggtagattaaattaaaaacttatgataacaaaatatttatacccgcaaaaatagtttaggatgtataaatcaaaattgggttagccctagttcgcgaatagtaaagttaatataaaagaatcgacttccgcattcgacttctatttggatttatttggatttttatttgaattctaaccgaattcaaatcaattttcgcacgtaactatagagcccgagggagttgcggatccaagtgaagtccaagacccgcaagactttgagcaaggcaggtcatcactatcccttgaacatgttgatcccaattgcgaaattatttttatttacaaataagaatgcatgcaatgatgaacatcctatttatgaatatgccataccttgattattgtttacccttattcccttgtaaccatgattacgtatgagtgcctagtcggtcgaaggggaggcgaggccgagggcgaccttgccgctgcgatgccggaggagacggcgacgtcggccggcgcatgggcacggcggaaggggttgccgaaggaactccggcgaggcggagggcgagaccgagggcaggccggggtggagggcgacgcggcgacgtcgagggaggagatggtgacgtcagtcggtgtaccggtgatgaacagcagccggccggagacggaacagtggcggcaacgccactgttgccggcggggatgcacttccggaggtctccgcgggaaacagagggcaggccggcgaagaggaggcggctgcgatgctggaggaggcgacggcacggccggacggcgctcgggcgaggagggagaggcggctggaggcggccggcgcggggaaaagagaagggcgacagcggggaggggtgatacgaccacggggaggctcgggatgaggctaaaacgatagaacggaggatggggattccattttataggcgcggggagggagccgggcatgggagagggcggaacggcgacgggaaacatggccggcggccatggaacgcggccgggaatggcgcgggcgttcccgatgattgggggcacgaatcaagggggaaattagggggaattgatgaggaaggaatggggattaattccccccaatcagtttggaaagaagggcattgattcgcgtggatttagggaggaaacgacgctaggtttcacgggagagagaggatgccgggcgggaggaaggagacgaccgggtgggtgggacccaccggtcgggcgcgcagtcagcgcgcgtgcggcgcgcgtgcacccggctggctcggctcggcctggattggcccgggcggctgggccaaaagggaagaaggagggagggcggcccaaaagaagaagaaaagaagggaagtggcccgggagggaaaggggaggcccaagaggagggagagaaggagagggagagaaagagagggaggaagggaggactttggccgtaggccgagaaagagagagaggactttgggccagacttggcccaaaggaggaaggaggattattttttggtttttctttttaataaactttgatcatagttgtggttgcttaataaatatttccggtgctctaaaaattcaagtaaaatttgagggctctttgtagactaaggagaatttaacaaaaattctctggactacattcgaaattttcttgtacgcatttaaatgtttgccaatttcttttcaaattttaattaattctattattccttttagaaaatgatttttatttcgggatgaatttatcaagacgtgacaaccccagtgggacttagaaagcctatgatagtacactcacctgggggcgagataactgtgagtcatgcttgcataaacatacctattcgtcttagggatgtggtgtttccctccaaccttatggtattgataccccagaccctggatgtcatattgggtatggattggttaacaaagaacagaggggtaatcgactgtagacgtagggaagttaccctgaccacaccctagggatcggatatgagagcaaccatggatcaagatcctagactaaccgaacgtgccggaggcatatttaccatgctacccctaaaaggaatgcctgtagtgcaacgatttcctgatgtgtttccagaagatttacctaggatgccactagatcgtgacatagagttcattgttgatctgatacccggaactgctcccatatccaagagaccttatcggatgccagtcaatgagttggaggaacttaaaaagcaaatcagagagttgcaagaaaagggatttgtacgtcccagttcgtcaccttggggagccccagtgctattcgtcaagaagaaagatggtagcatgaggatgtctgtagactactgttcactgaacgaagtaactatcaagaacaagtatccactaccacggattgatgatctttttgatctactcaaaggagctaaggtgttctctaagattgaccttcgatcaggataccaccaattgaaaattaggaccggggatatactcaaaaccgcgttctcaacacactatggattgtatgagttcaccgtaatgtcgtttggtttaaccaacgccccggcatactttatgaatctcatgaacaaagtgttcatggattacttggacaaatttgtggtagtattcatcgatgatattttaatctactccaaagacgaggaagagcatgcgaaacacttgcgattggtactcgagaaacttcggaagcataagttatatgcaaaattcagcaagtgtgagttctggttaaaagaagtcgcctttctaggccacataatctcagccggtggagtagtagtggatcctgctaaagtggaggctattacggaatggaaagcacccaaatctgtgactgaaattcggagttttctaggcttggccggatactaccgaagatttattgagggattctctaagatagcccgaccaatgacacaactactcaagaaggaaaagaagtttgtgtggtcagaacagtgtcaggaaagctttgagcagctcaaagaaaagctgacctcggcgcctattttagttcttcccgacatcaggaaagactttgttatatattgtgatgcatcaaggcaaggactaggaggagtactgatgcaggacggaaaggttgtggcctatgcgtcgcgacaattgcgaccacatgaggaaaactaccctacccatgacctagaactcgcagctgtggttcatgctctaaagatttggagacactatttgattggaaaccattgcgatatctacactgacgacaagagtctgaagtatattttcacccagtcagatctcaacttgaggcaaaggcgatggctggaattaatcaaggattatgacttagaggttcactatcaccccggcaaggcaaacgttgtggccgacgctttgagtcggaagggccattgcaatcatctgagaacggaaggaatggcttctgagcttaaggaggaaatagcccaactaaacctacatatagtacctcatggacagataaacaccttggacattcaacctcttctgagaacccaaatagaagaagcccagaaggacaacgaggaaatccgagaggtgaaggaacgcctagctgcaggatttgcaaaggaattttcaaccgacgagaaggatgtcctatggtataaaaagaggatgtatgtacccgaacagagtggactgagaggattgatcttaaaggaagcccatgaatcggcatattcattgcaccccggaagtaccaaaatgtaccaggatctgaaggaaggatactggtggcccaacatgaagagagatgtggcagaatacgtagcactctgtggcgtgtgccagaaggtgaaggctgagcaccagagaccggcaggtttgctgcaaccccttaggattcccgaatggaaatgggatgagataggtatggattttattgttggattgcccaagaccgcaacagggtacgattccatctgggtgatcatggatcgactcaccaagacggcgagattcattcccgttaagacaaattatagcagtgccaaactagccgagttatacatgaccaggatagtatgtcttcatggtgtacctaagagaattatatctgatagaggcacacagtttacctcgcatttctgggagaaagtacatgaagccctaggaagttaccttgcgtttagcacagcttatcacccacaaacagatggccagaataagagaacaaaccaggtcttggaggacatgctaagagcttgtgcattggattttagcaaagattgggagagatgtttgccctatgccgaattctcctacaaaaacagctttcaagcaagcctaaagatgtcgccaaatgaggcattatttggtcgacgatgtcgtaccccactaatgtggtccgagactggagaacgggtggtatttggacctgacattgtcaaagaggccaaagaaaaggttcatctgatcacgtgaccgtttaaagatggtacaatcacgacagaagagttacgctgacacccgaagaagaaacctagaatttaaggaaggagattacgtctatttaaaggtttcttcgatgaggataacgaaaaggtttaaggtcaaaggaaaactagcgccaaggtatgtgggaccttttcaaatcatggctagacggggagaagtcatatatcagttacagctaccgaagaatatcgctgatgtgcacccagttttccatgtgtctcaattaaagaaatgcttacgagtgccggaagaacaagccccgctggaagagattcacattagcaatgatctcacgtatccagaacaaccgatccggatattggatgaagccaaaaagaggactaggagcaaagtgtggcgtatgtacaaggtacaatggagtaatcacactgaggacgaagccacctgggaaagcgaagaattcttgaggacagaatacccgcatctattcgaaaactggtaagaaatctcgggacgagatttatttaaggggggtaggtttgtaacaccctgaaaatttgaccaataaaaacaaaactctaaaaatacgggccttcgaaaacttttaaataaattgcatcatgccgatcttattcgcccactttatttggatttgatttcgaagttcattaatcgtaagtaaagaatagttaattaggaataaaccctagaagtaaattggtaaaataaatataatttaaaataaagattaggtggggatagaaatgaataaaatattatcgcgatcatatttgtattagttaaatctaaatacgacggaatgagaattaactctaattaaaatcaagtaagttatataaaaattaaatatgggtacaattaatctgatgacctactgtaccaatggttaat

SEQ ID NO: 70196 - DNA, 4660 bp, Oryza sativa
gtaaaactagattttttccgtcctccacttcacaaaaccgttgcaaatgactccttagaaggtttgagaggcggtttcttccgacgtgacattttgatcatgcgactggttgagtcaggacatgaaccccacatgttagtgtcttgtagagaacgtgtggtcggtgaaaactcactgagtgtcgaaataagatttcggcaatacttaaagggggtggctatcaagctagaaaagtagatgggtttgaagacaaggagttttatacaggttcaggccttcttattcaagaagtaataccctactcctgtccggggatgattccgccgagtatattgttgatcgtatgatctgggggaaaaaaggtgtcccgagaggaacccggacccctccttatataggggaagggtccgtattacaaaatacagtccatatccctaacgaaatatgtgattacagataaaatacaatcgtaaccgactaagatcccgggtatttccttgataaacaagtctagaaactaacccgagtcctcataaatatattctatctatatttgataccgtgtacccaactaaactataactgccacgtagatattggatatccataatctccacagtagcccccgagacctttgcagtcaacgaaatagctttctcagaacaaaaagcaataatccgagtgcttcaattcctactgctctggcctgccgagtactaaaatcaaagactgtgaagggcgaaaataaaacatggtgcatcgagtagatgcacctaattaggtgtagcccctgactatgtggttagttgaaaaactaaacatgtagtcaagaaccgagtggtcttataaccaaacatcatatagcaaagcatgcatggttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaaccagcggaaaaataagataaacggcgcagacgactccactccacaggcagcttgaccagggctacacctaatcctccacaccatcagcatcactgtagaactcctcctctgatgaatgattgcaaggtgagtatatgacatacttagcaagccacgcagcaaatatgcaagtgcacaggataacaaaggatggcatagtagggtttcatttgcataaacagcaattaataaatatttcagaatttaataaaacagttaagtaataattaaacaatattaatccaacgctatacaacataccctgttgcataggcccaaccattctgaacaaccaaccccggctgcacagttctatctccaaaccaggaattaaccattccaaaccaggagctaaataaattattaccagttatagcatcttttattatggtgagaagtgtgagactaatcacgaaagacattgttagacccgccattaccgcgggcacggctattcgaatagttttactctggccagaagtgtaccactgtacccacaagacacagccccacaacatgtcaccatgtgcctcaataccaccacggtacctcggaaaggagctgtgacagtacccctcgcacaacacaatccaccacagcgcaccgttcctggatcataatcacccccttataaacaaggcatgtacttcccagcgacccccgtgggcttatctccgccacttctcagtctggtgctccgtaatgaaccatgctatacaaaaggtaaagccgttgcccacgctggcttgtggttggcacggttaatgtttcacaaccgaaaatcgtgaaccggtccttaattgtcatgagcacgaccatcaaaaccatgtgctcacaacccaccattatcaagttttagttggcaatttaattaattaaccagtcacgattgaccaccatgagctatcattaagccatcattaaataatagtgaatcataagttgtcccatttatatgagctagtgtctctaagcacggctaagcatcctattcactttagctaaaaccatataatgttctagctaatcaatttattaaccaagtgacaaggatagggaatcaatagcaaaagggctataacaaggcaataggttatttccacccaatgacattcaaaaataaatgcagtagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaacaactaaatccgagctaagatgaattagttatgaatttttaaagattaaatcggattaaaacacttatatggattttaattgaattatgacgcaataatgaattatttttgaaaagaaaaaagggattattgcgtcagcggctagggttcacggtagaccgggtgcatggcggcggctcacggaaacgaacggccgagatcgatccatccaaaacgaacggccgggatctatcggcccacgaccggtccacgggacatggcgacgatgacgtcggcgatgacgtcatcaccggcggcggctcgggcgcgcaagcttgccggcgaacgacgacacgacggcgctaacgaaggacaccaaaacgatgcgggcgacgcggcgaactcaccggtgaccaaaacagtggcggaagatcaacggacggcgacggcgacgaggaagaagcggcgacgaccttcgggttgacgacgacggcggtcttccggcgatcctcagcgacgacggaggggcggacgaggatggcgacgacttggcgaacccgacgatggccttcccgagcgacgacgacgaccggagcggcggcggcgcatggctggacaagcggtggcacacgggctcacgaggctagggctctaccggcgacgagagacgaaagcgagggtggcgacgggtagcggaggcaccgggggtccttttataggggctaggagcggcgatggaggcccacggcgaccggcaacggcgaaggaaggtttagggttcggggagagagatgaatccgattcgagatcaaatccacggatttccaaacggaattagccgataattccaaaagggaaaagatagaatggatcacggggaccattttccctctatcaatttcgccgaagaaggaaagatgcggtcgaatttggaaggagacggcggcgcggctcggctagggttcggccgggagacggcacgaggaagacgacggccctgacaggtgggccccacctgtcagcgggcggacgcgtgcgcgcgagcgggcggctcggctgcgggccggattgggccaagggagagagagagggatgtttcggccgactttcggcccaaagccaaaagagaactttcaaaactttttccaatttaaattattcatgaaatgcaattccatttattaaaaatacttccttggctcaaataaatcccagaaaaatctaggaactatagaatcaagtaaagtatttaataaaattttatctggaccaattttatattggaatttatcatttaaaattatatcttctcttctaggcttttaaaatcaattctaataattccaattaaacaacaatttatatatttgagatttttagtgtgtgacaaacctaccccccttaaacagaatctcgtcctcgagattcggaagaactggcgaacaaatgcggatgagctgactttaattcatcttctcgttcccaagttgattcttcctctgagtgattactccattgaaccttgcaaaaacggataactctattcctagttcttctctcatctgtttccattccaagatacggattggtttctcaacatatgccagatcctcttggatttctatctgttcaagattagcttcctcagtgggtacccttaaacactttttcaactgtgacacatggaacacattatggacacctgccaacgattgaggtaactccaactgataagcaacctcacctcttcgactgacaaccttataaggtcccacgaaacgcggtgccaattttcctttggtgcgaaaacgatgaactcctcaaagaggcgtgacacgaaggtacacatgatctccttcttcaaaactcaaatctctgcgacgattgtcggcataactcttttgacgagactgagccacacgcaatctttcttgaatgatctttaccttctcttctgcttctcttaggatatcagtcccgaaaacccgacgttctcccgtttgatcccacaaaagcggagtgcggcacttccgaccatacagtgcttcgtaaggagccatttgaagactagcttgataactgttgttgtacgagaattccgcgtaaggcagattcttattccaacttccaccgaagtctaaagcacaagctctcaacatgtcttccaaaatctaatttaccctttcggtttgtccatctgt

SEQ ID NO: 70197 - DNA, 3246 bp, Oryza sativa
  unsure (1)..(3246): unsure at all n locations
cccggcattgatgacantcggatagnagancatcaaattgatgaattcaagattaaaacccatgatcttatggttcataacaaactctcctaaccaatttaccctatgacactttgtgatttgagatcattgtttgttttctatgtacatctattcaaattttgtgaacacaaatccattatgttactgtataaatcataccttgttactacgattcggtagtaacattatcgcagaagtgcagtaacatgatacgttactgtaaaatttataggtcgttactgtaaaatttataggtcattactgcacttttgcagtagcatcatgacgaaattgcagtaaaagagaacatacgttagtaactgtactattacagtaccactgcttgtgcatagctaaatttttaaatctcaatattgtgcaaaatacagtgccaaaaaggtgcatatgcatggtcacaagtgaaaacaagtgctaaaagtacttctctttctatatacaaagatacaaagtaacaagcttagtaaaagtaaacttttagatttctaatctttaaacaataatacaattgccctgttactatacgataatcaagacaagatgtttaacgaaactagatccatcatgactattttataacattgttactacgaaaagtactcgtgttactacatattgactatcgcgttactacgcatttccagcgagacgagaactaaaaaaagtaaatctcaacctttagagagcaatatctctcatgttatatattatttttgtaatccgtctgcaccataatgttcgtaaaaaagtgcataacaaaactagatccatcatgactattttttgatgtcgttactgcgagaaaattatcctgttactgcacgatgaccgttctgttactacggaattcctgcaagatgaggacagcaaagttgtggctaggggagggagtcaatgggcgggttttgactcgggtttgaccggcaggacggagctttgaccagcctttgactgaggtgggaggggggatttgggccctaggaagggtgggggaggtgggattggcccatggaaaggggggggtgtagaatagttattctaggggaggggtgtagaatagattcactatatatatgtatatatacatagagtgagactattctacacccagggtatagaataacttcccttctcatccgatccccccttcctccctcctgatctaccctctctcgctcccgatccccccctctctcgctccctccctccctccctcccgatcccctcccttctctctctctctaccgatctctctctttttttatttcatttttttctgttttttttctccctaaaacatttttttcctcttttctggaaaaataaaaaataaattgccaaattcaagatttgaacccatgacctcatagatcaaagcacattcttctaaccaattcatctaatgatactatttgttttaagaattttatgagaaattaatatgattatcaattctaatatctttcactatcgaaactcataacatgttactatgctctagtggtaacattgttgtaaaagtgtagtaacatgtgacgttactgtataacacataggacgttactgcacttctggcagtaacgtcatagtaaaattgtagtagatcaggaatcaaagcaacaatatatgggttaaagcctcacatgctaaccatatatttgttactgcacgaaagtagaagtgttactacataataggcgcatattaccacttccaagtagctatgttactgcacgataattatagttttattatgtcatttttacgagatgaagatcgaataggtgggctataggtaaagcctgtaggtggctttgagcgatatctgattgatgtagtagttgtttgaacaattttatacatttggtaaaatcatgttactacatgtatatgctcttgttactgcaagttacacattctgttactgcatgtggagggttaaagttcaaaatgccaatctttgaaaagcaatatctcacaagatatgtattattatttaaaatcgttcccaccaagatgatatagtgttactgcatgtggagggttaaacttcaaaatgcatctacgtactcccctcttcaagaaaccgttcttcctccctcttctcaagaaaatcggtctcctccctccaatatagtgttactgcatgtatatgacgttactgcacttttgacagtaatattgtggtgaattacagtaaatcaggaattgaaacaaaaatatataggttaaaagtctcaaattctaaccatatacttgttactatacaaaagtaaaagtgttattgcacggaaggtatacgttaccacttgtttatgctgtaacactacccaaaaaatacagtaaaacaaagtgtagtaacatcgtgatgtgattgtagtaacgtacaacagacaagtagtaacaagtactagtatggtattactacttgtggagagacaaattgcaaaaaagtcaagctttgaaaaactttatctcccaagtgatgtaaggttttttaaaaccgtttgcaccatgatgctagaaaaaaagagcttatcaaaagtagatccgtcacgactatatttcaactatattttaacgctgttactgcacgtaagacacagtgtttctgaacagaggtcattgtcacgcccagaaattcctgaataggattccaagcagaatgtgcattaaaacccccatccaggaccggccggggtacacaaacgacaaagttgacatacagattcacgtcttacaaacatcacaaaggtcttacatatcacagcctgattttccatttcaggatttataaattatttaataaattattaatagaatttatattagatgtactttaatttacaagtgaagttaaatgtgggaattaaaatttcctaaatataaagcatggctggatttaatttttattaaaatctccatgattaattgtactctctgaaattttctcggatttttcagagctcaattcctaaatgatacaaagaacagttcaataattagttaatcaataatcattaatgatctagttataattatgttaagtgcttttcttggttaaaaatccttaaattataaattgttggttaaaaggaaatattagaaatgatcttaaaagcctaaaagagaagaatctaatttaattgttaaatctcaatataaaagtgggctagataaaatttg

SEQ ID NO: 70198 - DNA, 1110 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatac

SEQ ID NO: 70199 - DNA, 1478 bp, Oryza sativa
  unsure (1)..(1478): unsure at all n locations
aacaccgaataaaagtttactctatttaaaaccaagtagttatataaaaattaaaaatgggccaattaatatagagtggatccattggttgggataatacacatattgagtatactttatttatgcaagatttagaaattatagattcacttttatatgggaaataaactaaaatcgggataaatagaaaaaacccctattcattatggcgtaggtgtccaatgcggtccatagctttcccttctcctctccaactttggcgccctagccggcctttagccatgcaacaccaccgcccgtcgcgtcgccaccccgcaccatcgtcgtcgccatcgccgctgccgcaccatgcgccgtcgcgtcgcctcgcgccccacgcccctgccccgccgcgcgcctgtcccatcgccgcgcgctgccgttccgtcgccgcgtgcccgtcccatgtcccctgccgcgcgcgcctcgcgccccgagccgccacgcgccgtcgcttcgccgctgccgcgccgcgccgccatcctgccgccccgctcgcccacgcgccccgtcaccgcccgtcccgtcgccgcgcgcattccatcgccgcctcgagcccgcgccgctgttgccgtcgccatcccatcgccgcgcgccgagccccgcgccgcgccgcgccatcccatcactacgcgccgagccccgcgcgccaccccgagccccgcgccgccatcacgtcgccgcccgtcgcgtcaccgcagttgcgttgccgccccgagcccgcgccgccgtcgcgtcgccgccccgagccccacgccgtcgttacgtcaggccggccacccctccccctctctttcttccccctctcccctataaatactccacaccccctctccatttctcccactccatctccctctttctcccctcttccctctccaccgtgccaccgccttcgtgccgtcgcgccgccgccctcgcgccgctgcaccaccgccttcgtgccaccgcgccgtgcgccgtcgtcgcgccgccctcgcgccgccgcaccgccgccttcatgccgccgcgccgtgcgccgtcatcgcgccgtcgtcaccgccgccgccgtcgtcggtaagccgccgcctcctccccttgctcggtcgccgtcgccagagagccaagagagagagaagggagaagaagccgggagggagagaaaaaaagaaaagaagaaagagagaaaaaggagagaaaaaaagaaaagaaaaagggagagaaaggaagacgggaaaagaaaagaaagaaagaggagaggaaaagaanagggaataaatnataaaatggaattagagggagattatggaagttatgaaatttaaaatattagattttactatagatcaatataggcggagaatgcaaaattaatatattatagatattttgtaatcttatagtgctaaatcacggagaactcggttttataatgggaatctagacgttttatttgtatc

SEQ ID NO: 70200 - DNA, 14819 bp, Oryza sativa
cttggacacgaagaggcgtagtgcggtgagcagcaacgaaatggccagcttgtccgcgacggaccactcaccttgctcgaaattcttgacgagcacggcctcggcgagcttggccgctagcaacatgactaccctgtcggcggcacctgggtgtacagcggcgaggacccgggcatggcgaatacgacctcgaacgccaccctccatccggcgtcctctgggaggccgttgagccactcggccggggtccccatccggccgtgcaggaggcgcagcgcggcggaggtgatccgcaggtgggggtcgcctggtctgtccgcgaccagccgggcgacatcggcgagcgcttggtcgaatcggccgtcccgagcgtgtacgagtgccaggcccatctcgacccggtagacgaccgtggactccgcggccgctagtttcttggcatactcacggaggtacctgccggtgaaggtcggagcgcggagtgcaccggcggcgagcgcgtgggccgcgtcgaggaacaaggcgtccctgccgctgctgctgccggcgagggccgcgttgaggtcccgcagcccagggtgcgcgcggacgaggcccaggtgtccgcgggtggtggtggcggcgccgtcttgcggcggatgggagacgcggacggaaatccccgacagcttcgccgccacggccgccgtcccggccagtgccgcggcgagggcggcgcggcggagtctggacatgtagccgtttgctctccggcggcgaggagaaagtctcgtggtttgctgaggattcgtcgtgcttgtactggacgttactggacgctaggatgcagagctctaaaagatgaaggaatcctttccctatataggtgtactacgtctggaactctggatgttctgcgcttctcaagcgaacggcccaatacaaattttgaaatattttcgtccaacaggtccatgcaggagcatagttattagtaagggtgaaaacggtaacggaaccggcgttcgtttctgactttctaccggtcgagctatatagaaatggtaattgacccaaaaaattggaaatggtaaaaaatatggagatggaaacggaaatggttttgctgttataccgatcgtttccgtatttaccgtatttttatggaaattactgtttcttataataattactgtatttctagatatgttgatatttatagggtatgtctctactttacccacagtttagagattgattgactcttcaatcaaatcctaacttgagtgcgtggctaaaatggatttaatttataatttatatagtatagcttaaatttatttatacatataacatacttatgagttaaatatatgttttctatagtttaatgtttccgtatttgttaccgggttccgatctgtaccaacatatttctatccgtattattccgtttccggttttccgatatttccgatatcgttttcgtttctgactttaccctttttgatttcatttccgagaaaatatgattatggaaatagttaaggctgttttccgatcgtttccgaccgttttcgtgaggcgaggcaggttcaatgtggcttcgtgaaaataaaattttctatgccacatcggacgtttcaccggttgttggaaggtgttttcggacacgaatgaaaaaactaattttataactcgtctgaaaaccacgagatgaatttattaagcctaattaatctatcattagcacatgtgggttactgtagcacttatagctaatcatggactaattaggctcaaaagatacgtctcgcgatttccatgcaaactgtgcaattagtttttctttttatctatatttaataatgctccatacatatgtacagagattcgatgtgacgtttttgggaaaaaatttctgggaattaaacaatgcctgtatagcacatagtatgtattactccatccaaaatatagtaatttttagtcttcaggacttatactaaaatatactactaacaacaattacaatcatccgccatttaatttctccacctacctccacttctcatctaattacaacatttcatcatttaattctacctactttctaaataaatgtgtccaaccctaaaattctgtaggtagtacttcactactgaattgctaaccttcattcgacaaaaattttaggtgagaattctgttgaacccttcacggttggattcatgtcacattttttcttctcgagctccgacgaatgaaggcggcccgacaagttcaagtctcgatttggggttggggtggaaagggggtgggaggggggggaagaggtgggagttcgacagccttagagggatggccatgggaggctgcgacccagcggtgagccatggaatgggtaggcggtgccgccgaagttgtggggttggcaactggcggcgaggggcaaaacaaagtgagtgattaggaggcatggggagggtgtagatgcgaaaaacacacactggcctggaagatctgcttaacttcagtgcaggtccaaaatcttgcctttaggttcatgagcgtgccagttgatttgatcctacaatcaataagaaagaaagacaaagaaaccgcggttaaatccataaacgatagccgatcggctagttgccgatgacatatcatttatttttgagccgatgtcatattgggatcgatcggccattgtgaataaataagataaagctaagtctactcgatcggctgtagatgttaacagtacataattgtcacgtcgatgtatatttaaaccaagtgattgggatagatcggtcgttatgccgagacagtataaatcacttaagtcaaaatatgcattaacacgataattatatgaatgttcacagcatagccgatcaatctagtacgtatcggctgatactccgataccactctatattaagatattaaaataaacataatacattaaacaggaagcctaacatattctaatacaataagatcttaacacaaagggtggatttagcataacaattaagcatataagatataaaatagctaaatcaggtaagatcggctgaaactccgatgctatctctttcagtaaccataaaacaagcaagatattacgattaaaaatattacttaatagatcaaactcaaccgatgcagcattaagcataaagataaacataagatctaagcaagatgatgaaagcatctaagagatggtagatatgctatataatctagattaacagcaagatttaaccctatcggctattttcctaacaataagaactagccgattgcgggttaaatagagtaattactaaagattatagaacatatatgataactcgacgaattacatcaacaagattagagtgtcataaagatggaagcactaatcccgagaacgcaagccgccatgacaagtttacctctagttgaagatcgaaatcgatgcagcccaacccgaaagcaagaactcgacgaaatagaacgaaagtaaaaaggtggcgatgcgccgaaattgtgttgaactgattgttaattgattacatggggtttgggctacttttatacccaaagtacacaatatgtccttgtcaaacacgactcctaacactattacaactcaagatacaaacaagtccttaaggcggacccttaccgactcaaagtataaggaaattacacaaaatatcctaattaatagatacaattgtcttctcaggactcaatccacgtgtggcaatccgtatgaagcacattaacttaacccgatgacgtgtactgagtcacattgtcagaatcggctcaatcggctaccttatccgactcgaactctgccaactctggtcgcagccgattcggacttcggccgattcttactctatttccggaacgatctacagaaattttggtgattatataagatattgtcagagattatataagatatatgataactcgacaacttacatgaacaagattagagtatcgtaaagatggaagcactaatcccgagaacgcaagccgccataacaagttttacccctagttgaagatcgaaaccgatgcaactcaacccgaaagcaagatctcgtcgaaacaaaatgaaagtaaaagggtggcgatgcgtcgaaattgttgttgaacatgtgttattttattacatggggcttggggtctatttatacccgagattacaaaatatgtccttatcggacacgactcttatctctaacaaactctaagataccataagtctttgcggcagacttttgcccaaacttatctataaggaatttacataaaatatcctaattaatagatacaattgcctccttaggactcaatccgtgtatggcaatccatatgaagtacttcaactcaacccgatgacgtataccgagtcgtattgtcaaaatcggctcaatcgactaaccttgtccgactcgaactctgccgattaaggtcgcagccgattcggacttagccgattcgtgctctgtttccgtaacaattcctatcttagattccgcttctgtttgatcttcatctctgatactcatattaccaaatttggtcgttaacacatgccccccaagttcggaatatttggtaatgtttcagatttgccatatctgtttttccaagaatatcgctcgttgccgtttttcgaccgttaccgcggtgttttaaatattaactgtcatctccgagaaatttcacaccgtcacctccgttttcaccgcttaagcaaaccttgtcttctctctctctccggcgatcccctcggtgcgcaaggcaattccaaggcgatctcctctccggccaagattccgcccgcggcgatgtcgacctccgccagcccgtctgtcgcgccatcggctgagtacgcagaggtacgtgctcatcagctagatccctttttccgtgcagtatatcagcttttcttcatctctattcttttgcatttgtagcatctctccaacttggtcgcggttcccagtctgtcaaacgagcaccagtattttctcggtccgatcggcaatcctgatccccatgagtttattagtgccgagactaataggattcctttcagactagccaacccgaacataggtcattggaaaaacaccttcaaatcttggccttccattgagaaaagtgcccctgagaaaagttggcctgtatggtacaagcgggtatcggctagcaagcaggctcactgggacgaaattggaatcggccaagcacttgccctgaccatagcaaattcggctaaggacaaacccctgatggccgctgcagcctatttctggtcgaacacacttaatgctttactctttaaccaagggccaatgaccccaaccctgttagacatcacaatgatcactggcttagatgtcacctcattggctaatcccatgagcttgaacactaaaaacacttttgagttcaagaccaagagcattggaggctggtcagggtatattgcagcgtacaagggcaaagggccagtcacccctcgagagcatgtagtctttctgctgatatggcttgaaaagttcctgttctgcggatcaagttgtggtcccacaaccaactggcagtttccagctgaagccctagaaacaaagagacaattccccttaggcaaaatcctcctcggctatctgtaccaaatgttgaataatgcatcggccaagatagctgtcggctcagttgttggtgtaggtggaccatggtggttgctgcaaacttggttaaacttggtagccatgaaagttgttaatcggccaactgctcctgctatcctagtaaattttgtcttcaaaaatctcaaatcggctgtacaatttgtcttgatgcttaactatcttcaactttctctcttgcaggtattagccgatctgttctcgtttgatatcaaagattaccttgatgaagagacagaagaagataccaccagcaaggctctagctcccttgtccgatgacgtgaagaaaacacttaaagatatatctcatcggctagggtcatcgttagatagcttagtagccgattgtggttcaatccgggctagattcaaggaaattcaactttagatcccagatgatcttgccaatattattactccagcagtatacctcgagcagcatcaattcaagctggaaagagctaaacaaagattagctgatcggcgggagcacaaggatatcgaagctacaatccaagccaatcggcaattggtgcatgaagaaaaatccaagctcgatcagctgtctaaggttccgatcaggtccaacattgatcggctcgaagcccaaaagattgatctcttggcacaacttcaagaatgcaatgccgagctggatctggaacacaagaaactagctgatctcccaaaagctgttgaggagcagaaggctaagctgagatcggccattagaaatgtcgccgatatgactaagtccttaacagtcatccctggaaccgatgctcaagacgcccaagcgatcgaagaagtagagtaaattagataaagggttgtatcggctatccaacattacttatcccaatgaatatccatgtaataggacttagaaaatttttgtaatcggctagaaaactctgatacttcatctacttgttctgatattctcttgtgccgattaatataacttctaaagttgttcaaaaattctcaattttttcttgcatatatgtgccctcctaattttgcaatgacgaagacattgataaaattataaattagtctaagggcgatataaccatatcggccatcctataacggcaaaacacagccgattatgtgaatgaaaacaacccgcttagggcgatataaccatatcggccatcatacatcggcaaaacacatccgattatgataataaaacaactaagggcgatataattatattggccatctcaaggcgatgtaaacacatcggctttacacgtatcagcaaactcagccgatcatgaattaacccatacacttgagtaatatttcttcaagtattttccattaagtgctcgtccataaacttcaccatcaagtccttgcaacatataagctcctttagacacaaccttgtggatttgaaacggtccttcccaatttggtgaccacttgccgaatttattatcacgagttcctatcggcaagattagcttccaaacaagctctccctcagaaaaagacttgggtaccacattcttgttgtaatgtcgagcaacgctctctttatccttggtaacttttgcaagagctcgcaacctaaactgaaccaaatcctccctttcatcggccatgagattatagtactcatcggctgtcaacatatcttgtaaatctgttcttctcgagctgattctaattttccatggtaaaactacctcatgtccataaacaagcttgtaaggaggaacttgaatcgatccatgacaagccatccgataagacaacaatcctttggccagtctagtatgccattaccgaggataatcagaaatctttctcttaaccaacttgatcaaactcttgttagacgcctcggcttgtccattgccatgtgcacagtaaggtgaagaattcaacaatttgatacccatgctgccggcaaactgaacaaactcatcggacacaaatatcaaaccctgatcagttgtaatggtctggggaataccaaatcggtagattatgtgctccttaacaaattgtatagcatctcctgaatcaaccttcttcaaaggaatagcttctacccacttggtgaaataatcagtcgcaaccaatataaatttatgccccttacttgaaggtggattaatctggccgatcatgtccataccccatcctctgaacggctatggcttgataataggattcatagctgatgctggtgctctttgaatttgtcacgaccgaaaataacccaacgggcgttccttacgtgcgtgtattattccttgtcccaggaggcaaggtacaccaaaagttgatacaattcagagtttaacaagcggaagcgtaagtaattaatttattacatgggcggcgaaggcccagcacacaagaagacaaacgaaaaacagcggaagactagggcgacgaccacaggcgcttgacggcaggcacgagctagacaccaaagccttcatcatccaggaactcctcttctgggtttgggaaaaattgagcaagactgagtacaaccaccgtactcaacaagacacacccacaagtgcaaaatagatgcaagggagtacaagggggttataatataaggggttagggtttgcagtaaacagcattaaaagacacttagttgctcaaagctattttgtcaatacgatcctagaggtatccaatgttattaatcaaggccgtgaacccacacgaacctgccttaacccaaggcctacgatgattcaaaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaataggttatactttgatcagaggtgtacatctttacccacaagacacatctttctcacgtgtaatcacgtgccacataccatcacggtatacggacggaagacgtgacatagtttccaacccatcctagccatagacaagagtaccgacccaaccccacctatggccggaacctccgggacaggtaggtaggactgagcccctagcagcaggacaccagccctgtgccatgacatttcgactaccgggccgcagctcgtgtagccttcatttgccctagagatgtccatcgacccccgacttcgtccatctccatccgtgtacttttgttcataaccagactgagccacaaactaagccttacccactagacatgtggaagtacgatagtgctttgcaacagaggcccgaagaccggtccttatatggccgaggtgttactatcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaattcatactagtggtaccataaatagagtacccactagttggggttttgtttattctagggtgaacaaggtaataataacaataacaacaataataaggtcataacaaaggtaaataggcatggctaaacaaaatagtgataacgcgggaatttaagtaaagcggtaatgcaataattttaaatcaaaataattttataaactgggattcaatatgttcaaggatgatgtgacttgccttgctcgctttcccaaacgtcggcttcaacctccacgaagagcggatcttccgaagctgcagcgtctacacgaccaacagaaaagaaaaggcttttactctaataaactccatataacaagcaggaacaaggcagaaaaatgggtttttgacctcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacccgagggcgcgggcagctgacggccgggccccatgcggcagacactcggcgcgcccgaaggcggccatgccggcgcggctggcgggaggcggcacccgcgcccctatggtcgccggcggcggccataggcacggcggagcggcggccgagagaggggagggagagggggaaacgaggcagtggtccacggctcaccccgaggcgacggcggcgacggaggaggcgctcggagcggaggaaggcggcggcgcggctcgggtcgacggggacggcggcgctacggcggtcggcgagctcgacaagggggtggacgaggacggcgacggtgcggcgaagccgaaggaggcggtgccaaggcgggaggcggtccggggcgacgacggcggcggaccggagctcagcagcggcggcggagagagagagcgacggcgcgagctcgattccggtgaggagaaggcgcggcaaagggtgaaaacgggcgaaggaagtgcggggagggtttaaatagggttggaagggggagagagcggccggggaggaaggaaaccggcgcgggaggtccagccgccatcaatggcgccggcgagatttgcgggggcaaatccgcccgtttgaacgcgagagagagagagagggaaaaaatggggggaaagggagaggggatcacggggagtatttccccccactttattgcacgcggggacggtaggatgcggcggatttggcggcggcggcggcgcttggcgcgggcggggcggcgggagcggcgggaggacggggatgacgggtgggccccacccgtcagcgagggtggcgggcgggcccgcccgtcagcggcgcgcgcgcgcagggagaggccggattggccgcggggagagaagggagagggggagggaaatgggccgagccggcccaagagagggagggagggtttttttttagggtttttatttttataaaacctttttaactttgtttatttcttaacaattattatttgtgctctgaaaattccactaaaatttatttacacattttaggattttaggaaatatacaaaaatcctccaagccttaatttgacttttaactttgcacattttaatttttgaaggctttcacaaggattttaattattctaggcataatttaaaggatatattttagagtcattttgggacgtgacagaattgctccaaatttttgacaatcttgacatcctttataatatctgaaacaatcttccaacattattggccaaaaataccctgcacgccgaagtaaccacttcatcttgtgagccgattgatgagtaccacaaattccttcatgtacctcacctatcgcaagctttgcttgatcggcgctcaaacacttgagcaacaccccatcgattgttcgataatataactcatcatccaacaaggtgtattttaaagccttataacgctatttcctcgaagctgattgagatgggttttgcaaatactgatacacatcatatctccgatcatcggctgtcatcgtggcaacttctacctccacatcttttaacatcggcttataccctgatgctccctgagccaaatcattagcttctatattctgctctcgagaaacatgcttcaaagttaccagccaaaatccatccatcaaccttcggcatttctcattgtagaccattaatgtatcattcttgcattcatactctcctgccagttgaccaataaccagtaaagaatcacccataatttcgatagcatcggcttcaacttccttaagcatttgcagccctttgagaaccgcttcatattcagcttgattaatagttgcataaggcttaatagtataggcaaactcaaaacttgccccctgaggagaaattataaccaagccgataccacaaccatgagtgcatactgatccgtcgaagaacaatgtccaaggcacaatgtcaaccaagccgattaagtcatcacggtgatccacaataaaatcggctatagcttgtcccttaatcgcctttggtgattcataccgaagatcaaattttgttagagcaaatatccacttcccaatcctttctttcaaaattggagccgatagcatgtatttgaccacatcggctttacataccacagtgcattcattggacaataaataatgcctcaacttggtgcaagagaaatacaaacacatgcataatttttccacaggagaataccttgtttctgcatctaagggcctgcgacttaagtaaaatacagccatttctttcccttcaagctcttgaatcaataccgaaccaatcgacttgtcaccagccgataaatataatctgaaatgtatccctttctgtggaggaatcagaacaggtggggaactaagatattccttgatattatccaaagttttctgttgttctgccccccaagtgaacttttgatcggccttcaatcttaacaaaggtgtaaagggttctaaccttcctgataaattagagacaaagcttctaacaaaatttaccttgatgatcaattcctgcaacttcttcttgtcctctggaggttgaatcttctgaattgcatcaacactcctttgagttacctcaatccccctctcatgaacaagaaatcccaaaaactggccagccgatacgccaaaagcacactttgtcggattcatcttcaagccatattttctagttctctcaaacaccttcctcaaatcggctatatggtctcctatttcctttgacttgactaccacgtcatcaatataaacttcaaccaaccaaccgattagatcatgaaatatgtaattcatggccctctgatatgtagctccagtacttttcaaaccgaaagtcatcacaacccattcaaacaagccgattgcaccaggatatctaaaagctatcttatgaatatcttcttctgccatgaagatttgattatatcctgcattgccatccataaaacttaatatcttgtatcctgaagcagcatcgaccaactgattggccaccggcattgggtactcatcctttgggatagctttgttcagatctcgaaagtcaatgcacactctaactttgccattcttcttgataactagaactatattagaaacccattcagcatatcggcatggccgaataaaaccagtatcatacaaacgtgcaacctcagccttaacagcctctagcatatcggctttacatctccttggtggttgttgatatggtctaaccccgggtttgataggaagccgatgctcgacaatcaatcggctgagtcctggcatctcatgatattcccaagcaaagcagtctctgtattcttttaaaagctctatcaacttggttctgaattctggagataaattcttactaatgaatgttggccttggtctgtctcctggacctatatcaatttcctccaaatcatcagccgacataaaaccctatcattgcttgtcatcgagatcatctaccatgtccttggtgtagacatttgaaccctccacgaccccctcaaaataataatttgggctctccatcttcaatcggctgtatatcacaattggacactcttagaaaatctccatcccaaacttttccagatagacaatcaataccatccatctctcaaagagctaaatcggcattagcaacattaactgacctgtcggctggtacaatttcaatcttgtcaccttgccattgaatcaagcactggtgcatggttgaaggaatacaacaactagcatgaatccaatcccttccgagcagcaggctataggaacccttcccattgatgaccaaaaatgttataggaacagttttactgccgactgtcagctccacattcaaaactcccttagtttccgatggattgcaaccaaaatccttgagaaccatgttagttttgataagatcatctggatttctacccaatttttttaatgtagcatatggcattaaattgatagcagttcctccatcaaccatcattttggacattggcttcccattgacaaatccattgatatacaacggtttgagatgacgattctctgtcccttctggtttctcaaaaactgtctgttctggtgacaaaaccaatttagccgaagcttcttcaacatcatcaacatcggtttgcctagcttcgaattccgcaggtagcacgaaaaccatatttaccgatgcagatgcaacagctttgcccttaagcaacctttttgccttgtcggcttcaacatcatcggctgttgtaaccgtgctcttaacacgccactcctgcttggtccaagttttcctcagccgatgattaatctcttgccgcacctcttgaaaacgcttcctgttcctcatcctttgaacccttctcttctgattcttggtgaaaatacttgtaggacaccattgtgtattcctatcatcatcttcattatggtgataatcttaatttaccgggcccaacctctgatgaataggtacccttttctgactcagccgattgcctctattataggatcggctagaactccctgcatcattgctgcatccaggacaatcctcaatcgacggtagcctcataccttcattccagcaaaatctgaaaaattcacaatcccaatgatgatcaaaaccaccatcatcttcttcataatacttttcctactgcttatcatgcttcctctgatatttgttaataactctagccgaattcatccggaaatttagattttttcccctatcggctgtcctcccagaagtgtgtaccatgttaacaaagaaaggattaccatcgaccttcatcggcttcttcaaatcatcgaacttgatctttcctccctcaatggccacctggatttgctgcttgaaaactttgcagtcgtta

SEQ ID NO: 70201 - DNA, 768 bp, Oryza sativa
cggccccgtttgaaggttgaatcggcttcgtctgcaagtagttcatcattacctttgtttattgtgtgctccatgggttgtagagatacgcaacacgtggtgatagctccgttcatactttgtaatgattcacattcaggtacatcatagagctataggcctgattcgtttggcaaaccatggaaaagccagtgccctaagcaagtgatagagttttaccttaacttaattcaagattattaacccatctggatcctctctatccccctcctaccattaaattgttgtccctggatgaacctgtttccttgattttacacacttgttccctgagattcgatatggttaagtgctacagcagtatccgtgcgcttgcgtatttatctgtgagtaataaatatcaatataagaatttctggcggtgttactatggaacagttgttatattatcttcaaacctagtttgccttcttatcttatctttttatatttcttttcttttctttccataatggacaacttttatatgaattgttccaagggcagtttgtgaggcagcaccttataaaaattaattttaaattttgatttaaacttggcttgctttatagccatccagaccaatcctttcggggtgcgatggctaatgatgactacggaccatttgataaggccagggaaaagtggttctgggggaaattgtttccgttccaattccaacaaaacaagccgaaggttaatggaaagccgggggctagagagggcaac

SEQ ID NO: 70202 - DNA, 5895 bp, Oryza sativa
tgccactttgattttacaaaagcaatttctctctcctttttctgtttatgggctgatctgaaaccaaaaccaacaatatgtccaccttttccacaaaaagaacaagtatatttttcacgatgattagaccattggtagcattagaagatttagcaacactagcaacaacatgaggttttgcatgcacaacattggattttgaagaagatgcactcatagtagacatgataccagcagatttaaacacagttttgttagcattaggtttaaccaaaatctcaccacttctagcaccaacacctaacacaacaggaggatgtctagaattataagcataaggattaaaacctaaaccacggttatgtgtgctaacctttgattgatccaaaatcatgttgaggttctttttaccatcagaaaatcttagtaaggaatttttcaaataagaaacctctttatccaaattagcacaattttcacaatctaccatgacacatttgcttttacgacatttagggcaagaaagcacttcattgtttttcacaacatcttccatgaactcaacatgacctaaagcatctttcaatttcaacttattcaaattacatgttgagcaatccaaaatatcatgaggttgttttaactttttaacagaaatcatgttaaacatcaaactagcatgaaaagcaatttgatatttttgcaacaactttttagttaaaaataactcatccaaagtgcgtgtgtgcaaagcaaaactacaagcaagagaagatctatttttcaaatcatgtgcagcattaacatctctaatttttgaaatctcattcattaaaacctcacaattttcgtaatcatcatcattaggaataagagattttaatctagcaatttcagatttaagagattcaatgataaatttctgttttctagacatcttctcacacttcttattcttttcactcaaaatattaatagcttcctcaaaagcacttacctcattatcttcatactctgtgtcagattcaccacgcgccatgaagcaaacatcggagatgctctttcccttatcatcatctccactttcaccatctacatcacttagcgactcgaaggcggcgcaaacttgttgaaaagccttcctgagattctctagcttcctcccttgggatgaacccttcggcttgttgttgttgttgttggtattctcaccatctttgtcttctcttttgcctctcccaagcttaggacaatgcgaacgaagatgatcaattgaaccacactcaaagcaatgatttggaccacctcttttcttgttcctggcattatttatagctcaagcaattctattagcaaccaaagccaaattctcctcctcgatttgttcgagttgatcattgtatgtggcattaaaaacagcaagaaaagaaggcttagatgaagaagcatcaacatccaaagaagaagaagaagaaaccaaagcactcgacttagaatcaacttcccgagaaagaacattcatctcatgtgttttcaattttgtgtaaagtgaatccaaagtcaaagtagacatattaacagactcctgaatagatgtaactttcatctcccaaatagacatgtcaagaccattcaaaaagtgacgagaaatatcagattgtggataattagtatcataagaagaatcaacagatttaagatcactcaaaattttattaaacctagaaagatagtaatccaaagcttctccaggtttcatctcaaatttaatatactcctttttgaaaatatcacgacgaagttctttaatgttatctgttccttgatgaaagttactcaaagctttccaaatttcatgagcagttcgaaagtgcgcaacacgatcataatcagaaagagaaataccactcaaaagaatgttgcgagctttgcaattttgttcaaactcagtttttaaagcagcagtattaatctcttcaggaatcacataaggatgagaaacttttctctaaatatcataatcttcagccataatgtaagattgcatcctactacaccaatgagaaaaatccgttccatcgaaaacatgaggcttagttgaaaacctagcaggagtagccatggcaaaaactctagatcgataaaaattcaaagaagaaaacaaggctctgataccacttgtaggattgaaacacaagaactaagacaaccagaggaaggggtgaatggttggtatacccaaaaaccgaaaacttttagcggtgtcggagatatgggcccgggggtatgcgaagtgaggggaatctaccttcccatcctgccacgcgtccctacagcctagtcctgtccccgcattccgcgaaccgcaggagcggccggggggtcggggcctcggggtgccacgtcatgcccctcgggcccttgcactgctttgccccgaggctctcgcccagctgccatttggcagggggagcaagcgaggagggggcccaggctgaacttcctttaatgcgcacagcgccccaactgccccctgtcacatttaatgcagtggagcagatgtgcggcgtgctaaactgacgcgcgatggtcaagaatgaccggtctgtgaccggcctgacgccggtcacgtctgactggacggacaaccgtgctcccacgtcgcatctgctttcggcggagtggaggtaggtatgacccgtcccatcggagggtcattcgggcggcggccaccacaagtcttcacctattaatgagggaatgacagggctgtcccccatgtcaggcgagggacggcgctgggccccgctcaaggacaaactgtggtttagctttcaggcgaaggcacgggtcgagttccagtcaagttagggtgggtccccacccgaaagaagagtaggtagaggcggtgcatgtggtatccccttgaggtataaaaggaggactttgcccaccgagagagaggacgactctcagaaaacctgagcttgtggaggagggaagtaagagtgttctgccgattttaggaacccttgtaactcttagtctaaatcccatacacaggagtagggtattacgcttgatagcggcccgatcctgtataatttgattgtgtgcgagctagctaggagccttggggacggatacgcaatttctagaggcgagcttcttccctcggccgaactcatgaaagggggggtctcacgatctcccgctagagaggatcacccctcaacaagcggaaataaaagttacccggttagaccgccgaaacccggtgaaacacaaatcgaagaactctaaaagtggatgacgactttattgattctctctgtgtttacaaagtgcaccaacagcactccttacataaatttcgactaaactcgaaaccctaactcaaaactcaactcaattgctctccaaagcgataccgggaagcctcacgctccccctctatttatacatgaggcgggcagcctaaagccacgaaccaaactcatactaggagtcctaaacaccttaggaaaccctctagtacaagaaagaaactttacataaccaatcgtaccaaatttggactccttccaaattcaactccgcatcccatacgcacacaatacctccatcgtatgccatatggaatctccatcaaccacgtgcatcaactctagcctaagtattccgcatgatctctgaccaccacggacgtcgtcttatccccaagccgattcccgatccatcaccgcaaatactctcccgaggcattgagtcacctacacatgaaataaacaaagaaaccatattccgagaccaagctatctccaacttgactcattagtagcaaacagtagtattacatacgtatagtatccatctagaagtcataatcatgaaataatcacggatatccaaacaaacaacccgaaaccgaaactgacacagcgtcggccggtcagaccgcgggctgcgccggtctgaccgcgcattacacgccggtctgaccggttaccagagcccggtctgaccggtcacataaaatgacgaatcctgcgatcacctgtgaaatccaatcatctctaaaaccacttcatgaataaataccaaataacaaaaccaataatctctaatgccaattgttcatcacagaataataaccaaaaacacctgtacacatggcgagtggcgctgtgtgaccattgtacgtatacgtaaggatgacgctcttgttgatgcaacgaccgcacgtatacgtaacgctaatgcatgaagcatgtcatcagagtagctaattaaaaaattgccacgtatcctcttaattaatcgcacctcttgaccactatacaattaattaactcagctaaatatactgcttaatgtcatccactactgttgctgctggaggcatatatatccatatgcatctatacttgtatgttactgtatcaattgctaaattaatgacacatcatgattaatattgtaacatagtgattaaccaccacgtgttagtccattcacaattagatcttgtttggaagattgccggagattcttaaaaacatctagaagagatgtgtttttcagcttttacttatctattggttaaataaatttggaccatttagagaacctcgggagattttggaaaaagctattaaaggcctagaactgtgttatatttttttcagatatataggggcttagaataaaaaaattgtccctcattatcgtgtggggacacaacgcgcgagagagagaatggcgcaatttataagctagtgtgcagtgttgtattcacatccatatgggagtggagatcggaggaggagatgatcgatggattgacatattccaaagctgagcacaattaggacacgagcaagtgctctaggggatcttgtgtactcgatttgggaatgattaattcgtgggtggattagtgccacccacagctaagatagggtactctatcggtgcgtggctgcatatatggtggagggattagctatccagccatcaatcggacactgcttttttttttctattaacacataaatactcccatatttcatattataaatcattttactttttttcttaatcaaatacctttaaatttgatcaagactgtggaaaaatatactaacatttttaatacaaagcaaacatatattatcagaatatattcaatgttagattaataaaactaatttgatattgtagatgttgctaatttttatataaacttaatcaaacctaaagaacttggactaaaaaaaattaaacgacttataattatatataatatgaaacggaggaagaagtatatatacaccaccccacgagcacacgctatatatacacacacactagtatgtgcacgattaatacatgttcaagacattgagaactaacgtgatcattttacttaaattcctataaccgaagtgcacacgcgtgtataggggccctttgaaatggattggcaaacaactttagagaattcaatttcttctaaggatcttttttttcctatggaacctttgattcataggaagaagatagaaaattttctacataattgcatttctatgatctataggaatacgagtaagagattagagattagacctcttgtaaaacttacttttggcttaatttctttttgtgcaatcaaacggattctcttcttatttcatgcattttcaagtcatgcaggattggaaaaactgaaactttaatttctgtgttttttctgtggtgtttttcctatcctgctggcctaggatttaaacctagcttgtttcatgtatacactcacaacatgtaatgattgaaacaatattcacgctaaatcatttggatgataatttccagccgcccctatcctaataa

SEQ ID NO: 70203 - DNA, 2323 bp, Oryza sativa
tagagactaaatgatcccaacagggccttagtcataggtggttcttcgttagaaaaagaaaaaagttactggccccattggttcgcttattcgtggaataagccaaacaacatatttgcaagagaagagtaatttatgaataaaacttttatatatgtgttcttagcgatataaaaggaaaggttgaaaattaaactttgatgaataaccccaaaatcacttccaattttaaggttgaaaattcaaattttggctgataagcataagcataagcgaaaagatgaggccgtaacatattatcgcagctcagcaacacacttcatatgactcatattaatcatataagaaaaaaataactaatgtacttccactggtggagaaagcgtttgtagtcccggttcgtaacccccttttagtcctggtttctaaaccggaactaccaatccaggactaaagatcgagttgatctttttttttgcatggccctgttgctgcatggtttatatatatatatatatatatatatatatatatatatatatatatatatatatatatacattaaagaaaatgtgtacacatgcatatagaaaaacagacatgtattaattacaatccattatgatgtcctagctagtacgatttcgacgtagtagtagtcgttatctcagaagctaaggacctatgaattgtatttccgtcgtagtagaattcacccttgggatcaaggatttgttcgttgatgaatcccatgagttgttcttgaaccaccgcgataaattccttgtgtgtgatcaggttatccctcatgcgaataaactatatgaatgtatgaaattaattagtaattaaacaacaaatcgatacgtaatgaaattttgaatttatttgtacgtacatcgagctctcttgtggtgatgatttggtctgcaaggcagtggcaatattcgcacacgtagtagccgcacaagttagttccctgcttttgctttgcgcactataaataaatgacaaatggcgagagatctaattaatatacacttgtatgtatttgaattggagattcaatataaatgtagagcatgtgtactcacaggaaaattgaacttccgcctaagtctttctctccatttgccgcggaccaaatgacggaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacggtgcaggccttcaggtcgaagagtaaaagcacccaggggaatctgcaatgtgggttggatgcattacgtatgaaacacttagcatgttcttacgggaatgaaatttggtataggaagacagtaaaattaaactaactctatgttgtacggcaacagtatgaacgtcttgtatgctacgccatcaggagatggacgagattgtcctatgtggcttgcggatactggtcaagcattgcgacgtttactttccgagggtcgatgaatccagtatcgaaaaccctccgccgtcgggccctttgaatctccattctacaacgataaaaggaagtatatattatatatagtctacttatacacaaggacctaattaattaaaggaaacgtaataagaaatctaactgaacgatacttacaaaatccagcaactcataatagagacgtcgagggcgtccagctggtatagttcgtagatacccttgaaattgatccagagaatgtcatctccttgcaagaagtccgtgtccctgatcctcgctccgatcatctctctaccggtggtgctcatctccatgtacagttgatggaacttgtatatttgtgtgggtagggactgcagctgctcaggcttgacaagcggtttaccgagttcgtacatgtatttcgcttccgccttttcgattggtgcgcctcgtagcaattgatccacagttagcccggtgtcattaataaattcttgtattccaaaatcttcaccggtcaccaacggctcgatctcctggtttggttgctctccaagctgagggactggtttggactttccaaaaaatgctttcttgagtgttcgctcatagtccgatagctttatggcctccttggcaggtgcagacatacccctaaagaagttcttgacactcgggtctataaaatcttcttttctggacttcgaggcttcaattgtctcctgacttctgatgacacataagcgtcaagctcctcttgcgtgc

SEQ ID NO: 70204 - DNA, 5314 bp, Oryza sativa
acatatataagcagcaacttgcggaatggacaaatctaaaatcgataaactacgagcttacctttattgataagttcttgaagggaatatgcagctcacatggtgtccgctgagtgatgtcatcaacggggcaggtggtttcatcatgggtttgcatggtgtccatgctctgtgatactacctgccccgttaaggcgcaactgctacgatttccagaagggctcacaattgcaggaggaatggtcggctggggatcatgggaccgatgtgcggccatgcgttcatcaaccttccttgccacctcctcttgcatgctaagctcgtagctcaataccttgtactcaagatctgcaatcttcgcctcggtatctctcttgctcctcatccgactcctgtatgtgtggatgtcctccttgaacccaatcttccaaggaatcacccctgtcacgccgggaaattcactagtaatttccgaactaatttgtgcataaaatcctcgtccaggaatcagccgaggtacacaaactgacaatttaatatacaaatccatcttaataatgacgttacatacttacaaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacagctccacatcatgtcaccatgtgcctcagtaccaccacggtacctcggaaaggagctgtgacaataccccttgcataacacaactcaccacagtgcaccgttcctggatcataatcacccccttataaacaaggcatggactccccagcgacccccgtggacttctcgccacttcacagtctggcgcactataatgaatcatgctatacaaacgataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgcattgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcatgattttagatgaatttagcaacttgaaccactcaaaaccgagttacgatgatttagttatgaatttctgaagatttaatctattagaaaaaacaggaaaaagaaaaacgatgatgacgtcatgatgacctcatcaatggccgggccaagatggcgacctcgccggagattggatggtcggctgcgactttggaggacatgaacacgtagaggacgacgagacgaacccaacggtactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccggaaaaatcaaaaaactcggttttggagataaactcgaaaacgagttcgattcggataagatactcaacgatttgctccgatttttgggggtaaagatagaggaggataagaggaatatttcccctcaactaaattggaaaaaggagcaacggggaggcgagatttggaaggaggaggcggcggctgcacagggcacagcacgggcggctcggctctgtccagagctggaagatgaacagtagatcagggagggaaaatagacttttccggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaattacaattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaaagaacatttaatataaattctaataataatttattaaataatttataaatcctgaaacaaaaatcaggatgtgacaacccctttccctcgtgttcgtcctggatgctctggagtctgcagggcgagtgacagctcgtccttctctctgtcgggtcggaacgtgccctaagaagaggcttccactacgtccgttagtcgatgcgcagcctcgcgtatctgatcgctgaagaccagagagccatcagctgggttgagcgttccaccgtgagcatagtaccagaactttgatcgatccggccaattagcggtggccggttcgatacccctctcaagcaagcttgcctccatctcctcccacttcggcatcgcgacgctatagccgcctgaccccaactggtgatggtacttcttcttggcggcattttctttgtttctttccatcatcgcctgcccttgttgacctgtctgatatgcaacgaactcgtcccagtgatcccttagctttgggaatgtgtcgaagttcggtgtctgccccttcaggatatatttctggtacagatctcccttgaagctctgaaattgttctgccattttctttagagtccaccttttcactttgtcctctgtacccgcgggaagggtgaatgtctcgagcattgtggtccatagcatctctttctccgaatctgggacaaagctctcatgatctccgcatgcccttgttctgcgccagtacaccatactgacaggcacgttatcccgcacaacccaaccgctgtgatgtacgtagttcttggctgcttccaccggggcactaggtcggccgtcttcgtccacttccgttatgatgtgccgaccctcaagcttcttcgcggcacctcgttgcccgcgtgccctcttctgtccagcggagggttgacttccactagcctcctcctcctggttcccctccacatccctctccacgtgcccctcctggttcccctccgcatccctctccacgttctcttcctcgttcaagtactggtttggatcctcgttcccctcttcttcgttccagtactggctgcttccctctgcgattgtatcgtacaatatctgtccctcatcgcgatcagccatctgttcatacaagaaatagttgctaagtcatgagacatttttgctttaacaatcttatatgctaacaatcatatatgctaagtctaactgtcgtacatgctaagtctaattacaaatctaataatcttatattaaaactataataatcttatattaaaactcaaatagtcatatatgctaagtctaactgtcgtatattagaaccctacacaatcttatatattgtatttcacgttcgcgttctcgttaagttcacgtttcattcacctacgttcgttcgttcacgtgcgtccacgttaacgtacgttaagtaatgttcgcgtccttgttaagttcacttttcgttaacgttcacgttcgttaacgttcgttcacgttcacgttcgttaacattcgttcgttcacgttcgttcgttcgttcgttcgttcatgttctcgttcacgtacatttcgttcgttcacgttctcgttcacgttcatgttcacgttcgttcgttcatgttcacgttcacgttcacgttcgttcgttcacgttcacgttctcgttcacgttcattcgttcacgtggcggcagcggagcggcggcggggctacgcggctgcagcttggcgcagcggcggcgtggcggcgcggcatcggcgtggcgcggcggcggcgtcgcacggctatggtgtggcggcgcggcggtgccgtgccgcggcgacgtcgtggtgtcccggcgtgtcgtgccgccgcggcgtcgtggcgcggcttcgtcggctttgcagcttcgtcgtgacgtcgtcgccgatgcatgccgcctctaggtcggggtcggcatcgtcggcgcggcggagtcgtgatcgggcgtgacgacgtcggcggcggcgtcggcaacgaggtagccggcggcggtttgggggaagagagagag

SEQ ID NO: 70205 - DNA, 21036 bp, Oryza sativa
tatagaacttaacggcgcggaatggacggaaccctaacaacaatggtatttttgggacaaaatcgtttgtactatggcatttcttggaactcacacttgtcgatggcatttctgggacttagacgcttgtcaatggcatttcatggattatctcataattttaacacaatcttgtaaaagttcgatagaatacaatattttggacaaaattttgacagaatttcagcaataagtttggcacaatttcaacagatatgttcaacatctcgccttatataacatgtccaagcatcacaaagtagcacatactcaagaacacacattaaacctctctagggttttgggattgggtgaaatgcaaccttctaacccgattcacaccctggttgactgatttacttataaggggtataatggccattcacaaattacaatatcattttttccctttgtttaatttgaaagttccgagtctacctaactactgtcacaactgggggtaaacggttgcttcattttaaaaagtaggggcaaaaacacaaacctaaaaagcagggataaaatcacaattgaaagtaggaggctaaggttttaatatataggaatgagattctaagataaacttgtgtctttttggagagatcacaatgttatgccagcaaaagtgaaaatgctaattacctaacttgtcaatatcactcttttccataactactttagctgaggtttttctattaatgtagggaacatctgcttgtaccaccttacttcaccatcaagtaagtataaaattcgtttgtaaagccaagaagacttgacttacatatagaccaagtaacaatgctttgaacaatacagcaacaaataattcgccactactttgcacaataccaaggtaatgtacggcttgaagtagaaaaccaaaaccaagtccaccttaaattttgcatggcaaaaggacatcaaagttgagattactagttagtagtaattagattactttacaacataggctcatctaaaaatatggttttgttgacttggtggagaagagtcatacataggagaggagtatgtatcaattcaaaagtggtggaaaggaggttctggttcctctcattatattgttaatttgttatcggataaggaaactagaaactattttgatagtgaagtaggggaatgaactatgcaatgaattcccaagaagggcatatagtttctagagcaacaaaaatgaaaaacaacaaaaaatcaagggcattaacacacatgtttaaccactcgatcgtaaaagtacttcatagatgaaatatttggtcccagtatatatcacactctgcgtctctgcaatcaacagttgatcagagaaccctaattaataaactcactttttacccccgaattaacacatgcaccaggggcgactaccagcttaactcaataaacaaaccatcctaattaagcgactaattaaagacctaattaatcaaagacatggccactccatatatatgcatgtagatcaatcagcaagtggcctggacggtgagcacgccggacaggcacccggcgccggcgaacgcgccggtgatctccaccgtgcacgactccttcccgacgcacgccgccgtgaacgcctcgtacgccgccttggactcgcacccgccctcgtagccgccgcaccgcccgcgccccacgccgaagctggccacgtcgacgctcgacacggcgtggccgccgccgcacgacagcgtgacggcgtcaccggcctcgccggaggtgcacacggcaccgggcaccacggtgcggagggcgacgcccgaggggtcgccgccggcctcctcgaagaggagcagcgtgttgggctcgccggcggcgaggaaggagcgcggcacgtggtagtagcgctgcgacggctcgccgcagcccgtgaggcacctggtgccgtcgccctccgcctggaacgcgccgcggtagtcgcagcggtggcagccggccatctccgccgccgtgtacgacggccagtagcggccgaggttgttgccgttcacccacgccacgcccttgttcaagcccagcaggtccaccaccaccgcgtcctcgccggacggagcttcaaatgtagccttcataacaaaaaaaaaagtaaccaaagtattaagattgttttggcggtgaaagaattaatgacatgatgaaatttcatagggaaggtaaattaagtaaattgtagtcttcataagaaaacaaaaaaagtattaaaaatccttttatttttgcaggtgaaagaatgaaacgatgaaatgaaatcatacaggtaattaaattactccagtttcataattgataagttttaggttaaacttttataaattaactaataatgactttaaaaatatctagtttaaaggcaccaaaacaacatatataaatttgacttacaaagtactataacaaaagtaatatatatatatatttatattaatatattgtaatagagaaatatagtcagaaatatattttgaaaattatgtcattgttcagaatgttaagaattataaaaccggagagagtgagtaaataatggacatatactgtaccttgtaccaagtaaaaggcctgttgatggggatggtgccattgttgccattccatttgtagcctggcttgtcaagatggatctgcctgtactcactagccaagccagcctacaacacaaaaaaacatcaaagcaagaaacactatatgatcaataccagcaaagttaacaaacaactaagcattgatgaaaaataatgtgtaaccttataagaccaggagctgttggagagatcaattgcggtgccattgctgtctatcagcttaacagggcctccaacaatgcccgtgggcatcttttcgaacgaagggccatagttctgtttaccaagaatgatcaaacaatttatcactggtatacatgattaattgcaaataaagaagatgagttcgttgctgatacgatggaagtgagcattcaagaaagaaaattaggaaccttgaggccaacggttgcactcagaagagagatgtagttcttgccatcatggagcttcaccggcgactctagttggaagacaaaatctccatcggcagaatggtttttccctgacaaattatgaacacacatgtttgtcaatgaacattctttaattttgacccgcaggttcacaaacattctttaatttcgacccacacagaattaaaagaatggtgcaacgaaaatatggaaaaaaaataactttgatactcaccaataagcttcccgttcacaaaggcataaagttcatggccagtcgtgttcacgtacaatttgtagctcccttctcctttgtgattaagactgcaattttttttttgttggtgacgttctaaatttgtaacatatatatatttttttgtcggaatcatttcaaatttacatcatcatgatctcttttctttagtataaagagattttttttttaaaaaaataccttgttctgtaccacaggtaatcactttgatcggttgacgtgacgatctgctccaagagctcattcttcctaaagttgcccttctcatcggtcatgaaaggactcaagttttcaggcatccaagaccattttaggctctcctgctcctgctccgccgtgttgggtttcttcaccatgacagacgtctgggtcttaatctaggtcataccaagaggaaaacaaaattaagagatgaattatagaccttacacttggtctcattttaatttcattattgattattgagaaaggaaaaataccttggcgctattgaaggcaacagtcttgcagtcaggcaagatgctgactgaccatgcaggcaggaggtgagtggctccatcgagggtcacattgacatctttatcatcaaatctgttgttgatgaagcaagcagatgaggagtccagagtgtacttggtaacctacattgatcagagatagtaccaatatgcatgcattagatatgtttgcattagacgtgataattttgattaaaagaagggcgtgatctgaatattactgtgatgttatcgccatagttggtgtcaaaatactctccatggacaagagttttctccatggacttgagcacggagtggagttccttcaagtgaccatatttgggttgcctgagattacctgtaataaatcaaaagtagaccaacaagattataattaaaataagacaaaaaattgctttcttattcaaattcaccatataattaacagtacggtaaaatatattaatcaaagcttaccatactcatccaaaggcgcgtcataatcatagcttgttgtgatgtacggacctccggaggtacgaccaaagttggttccaccatggtactaacaaaaaatggaaaaaaaaaactcagcataaatcaacgaaaattcagtcattgtgaaagagatacaagctagccagcataccatatagtaattttgcagagatccacgcttttggaagaacatcgcaaccgcaaaagcaatgtcttcagctgacctatggaaatccggcttgtcccaagctttgaacctaacgttaagtacatcaacaaattaagataaatctcctccatgttcatcaaaaaataattttgcaaacaaagagatatatgtactaaaagttaattttgtaaacaatgagagaaatactaatggaagaaaaaaaaataccagccagtccagttctctgtccaaatcttagggatgcctgtcctatttggaaaccagtcatggcaatagaatccattacaggtattgacctagagcggtccaaaacaatgacaaactcatgttattagatgagtgataaacaaataaattcatataatattctatattcttgtgggattaaaacccatgctcaccacattgtgcggcacatcgtcgtcttgttgacacatgatccatgggacaccgacgttctgcttgttcgccatgtcagcacaccagtggatgtattcagatgcagactggttgttgtttaatttccccatgatgtttccatactcattctcaatctgtgcattgatccattaatgcattgatattaattgacaatatatattgtggaatgacaatagtacaaattattaacatgctaatttcccattgttcaatcatattgaagaatgatcattacaatacctgagcaaggatgatcggtcctccttgttcagcaaacatttttgaatccttcatcttgttaactataagagtggtgaatgtctccatctcattctatatcatggaaaaaaacacttgcattaattatatgctagtatatgtaaaagtacacaaaaatagatgagaattttattattattattattatttaacctcaaaaggctcattatgcagcctaaactgcattccagggatgtcgcgtagccaagctggaagtcctctgcacatttggcatttgttttagaaaacaacaaaacacagtgagcacttcaacatgcatgcatggacacataataatgttatagaaagaaactagagtagtttagtgtgctcgcttgtttcctcttattctatatgaacactatagatataatatttgattaatttgcagatcgatataatagtctattctatttcgtttttttctctaattctatatgaacattatagatataatattcgattaatttgcagatcaatataatattctattctatttatcactttgacacacaaatgctttagcatttatatacatgatacatacccatagttccattcgccacagatgtacgggccaatgcgaagaatggcgtacatgccggcattctggatctccttgaagaacctgacgacatcgtagttaccctcaaaattgtactgccgatcaaagcaaaaacattgttatagtattactagtatttatccatggttgttattgtatgtaatagctgcagtacgtagtagtgtttatgtgctaaagcaaaagtagtaatattgaacctggcggcggtgcggctcatggccgttccaaaagatgtaagtctcgatggcatcgagaccaccttccttcgccttcttgatcagatccggccacatctgcatagcaacaataagattagattagatagaaaaaaaatcaaattaatcttttgcgcacgtacatatattgcttatgttcattaatttcttaacacaaattaagaaaataaagatcgaacgaatataagtcacaacataatatgcatgcataagtatataaaagtatagaacataaaactcctcgcactgcttagctcatcacgatctatggcacaaaaagaaaagaaacactcaagcaagcaactctgtatcctactagtacaaaacactcaaagttgtatatgcatttaatttgcagattaatattatcaactatctctattttttaatacatgatgttgttgattttttcacacatttaaccattcttcttattaaaaaaacataattataatttattttttgtgagttgttttatcactcaaagtattttaagcatgatttatatcttatgtatctccataaattattacaaatgttcaaacatattaaaaaattaacgacatcatgtattgaaaaacaaaaatagtatacactaggaatatctatacctatacagcgttaacctggtgaatctgccgttgatcaaatagacccacacattattaatttatagttaatatcatggtcccatgggcctcacaaatcccatccaataatctctacatacaattttgttgggaattcagttggatatattgccgatgatctggatttcaagcggaggcatcaacacaaatggaaatagagatgaactttaggacgcgctcagatatctccaagtcgatcgggtattattgtttctcaatctagattggtttctcatctcaaacaattttaacctgggtaaactatatatatgacacggttgaaaaatgagcacctggaagagtacatagtaacgtgctaattactttgctgacagagtttagtctatgattatgttgactacacggacagaattttggacaatgattatgttgctaccaacatatgattaattccgtggctactttttttatttctttttacatgtacagattggatctaatgccaaaatttatttaattaattagttttccacttaacacattactacgcatagttacaatttcaatataattctcaacggtgataacaatatcaatattgtacaccattcataatacatggatcttacaattttaaaaatatacaacgaattctatgattaaaatataattcactcagaaaataaattaaaaatcaccatattgcagttggcattaatttgccatcaatttaaaccattcctatacgattttgtatgactgaaatactatcagagtaaaattttatagggctaaaaaataatatttaaaattatctcgtgcgttgcacgggttgacggctagtataacaagtcggttacctcgggagtgctccggggataatggatggaaccagagaggatgatccggcgctggccgtcgatgacgaggctgcggtcgtcgtagctgacgctggtgcagcccacggcatcggccgccacggcgaggaccagcagcgccacccaccaccggcaccagctgctgccgcgccgtcccatcatactgctgctaatttgaagttaattagctaggctacaggggaggaggggaggagaggaggagacgagatgagttgcaactttgcagatgcaagcgatcgaattgcagagatcgggcgtgggggtgatacggaatttataggccgcagcgatacgatgcgccgtacgttggagatagatacaatagaggataattacgtagtacacgtgggcatgggtttgttaatcttggagatactattgcacagagaaacaaacaaagtagttaagccggatcgccatgcatacgataaagacgtatgatacgataattagtggttagccgtaaaatcgagattgcgtgccgtttcttttttttttgcggatagtgctaaaactagaaaagacaatctccatcccctcctcctaactgagagatttgataatttaacactattttcaatgggtttcgattatttgacattctggttcactttcatacactcatatggtctcacatatcatcctcacaaaaatatcaattaaagtaattggacaatgaaaaaagcgttaaattatcaaatttttcctcctaacttggcatcagaattcttttccatcagatgataatgcccctcgtctcttcacgagattttatcacctctcggaactggctgacaccctgtgcattatcatagactctgctgcctgaatagcttctgatgttccagttatccctatcagatatcttgatcctggcaccactagcctgaatgatctctgtaatgttccttccggcacgtcgtacgacagcaccaaaatgttcatcagcaataccaatagtgagaatcttgggcgtcattgttagcaggtgagatctcataggtgtactgggtttgttgttttggtcccttcctccatacccattaggtccataattcacagcattattatacggcacctgtgggatcataatacccaacaggaacaccagggtaactagggaaactaaggcctgcatatggaaatggggaactcagattaggtgggtagtgaacgtcctccgataacttatgcttcatatcaaatatattgcacgcatctgatggtccaagggtcctgtgacagtaacgagtctatcatgcaaaccaagaaaattgttatcctgtggtgaaatcttgattccagcatgtgtgtcttcaatgaatgacttgattcctttaccaatgattcctccacaataatttagataaaggaattaaagctttgttgatcatctcagataattacatccaaaggtgataaaattagataaggtgatacaattagataaaaaagagtattatttgcagcaagcaactgcgctctgaaaatgaaattcattgttatagaaaatcctggtcgtcattctcattgtttttttgttccccaaacactgcaaccaagcaataaaacaataggggctactacacacatgccctcatatgaacacgatggaaccagaaacaaataaatcccagaaccgccatatcggtgccaggaaaagttacatcggattgtactagtcaaacctgcagagaagcacaacccatatattcatcatgatcagtccctctttgagccgctaccattctggccggtgaggatcctggagatctgcagcccccggctgaaggcctggttgaagagcagccgagtctgaaactcggagacgaaggggaaccacgacaggacggcgatggggaagaagatgaggatccccatggtgtactcgtacatcctcgccatctcctggatggagtcccatggcccgatcttgcggagcacatcccggctcctcagcctaaacctggcgcagcaacgccccttgcatgcggtgcccccggtgcaacatgaacagaacagggcgcagagcggctccgtcaccaatctccggaacaatggtccacagagctgtgcaatctacgagagtaaagtgaatgtgatgattgaatacaatggacaaatgagtggacaattctagtgggaagggggaaaaaatcaggttgaagttgtgagcacagatgcatcacttacctgaagaataaaccagccagtagggatgaatgccaaaatactggcaccaacatcagagacagtcagattgaaaacaacaaataatatgaccaccaagctgatgaggacaataaagacaatgcccttgaggatacggaatacaagttgaaaattggtaataaacttctctctccccattgagacgacctggaagaagaaatatgctcaactgtaggattactattgcaaagaacataatacaataccaaataaactgttaccttaagtgatacaagaactatagctataaccagccatgatagtgcatacacctgtggaaacaaaaaaaagaaagaaaaaccattagtccggtcagaattcatacattgatgcagagcactctagtcaggataagtaccatgaagcttctgttcccatgcactatgtgtaaatgataaacaataccatattggtatatcaagaagcgaagggagaggacgaactccaacagcaggctacgtattgtaccattcctcaggtggtcatgttcacttatccaccaagcctcccaactttgctctggtgccaggccaatacctcctctattgctcatccaatgccaccagtcagtccagtcatcaacagtcttgtgccactcaaagcatgatggattgaagacaaaaggtgcaaacagccaacagaaaacaaggaaccatattgaaattgtgacatatagatacaaacttgagctcctgtacgaaatgccataagctagatagacaaccaaaagaatgagtagctccagtgctttcacaaagtggctccgggaatacatccggtaattctcagcaaactttgcatggcgcacaacaaacccccggcctgtacctctatattttgcaccaccatgaagtattgttcttccatagtagtgagtcttcgttccaagatggaaagtgaagaaaacagaagctaattgaagttgcattattacaaactctcccaaggctctgccaaatcctttctccaagccaacctctatcatcatagggaggacgagcaacattccaagttggaaaatagattgagttgcaagtgcattttcaaagggcttgatgttcttaatttgtggatcctggagaattgacttctctaggccactcaaaacaagatataacctcccgtataaaaatacatacactgtaagaacagccacctgaaagtaatcaaagccataaaatgcgttagcacactttgtacaaaagtacaaaccttatgtcacattttttagttctttataatctgctggtcactgctttaaaaatcatgaagaacaatatagaccattttatttccctactaggttgttttctttgtagagaatttatctcctcaaacggaatgcaaagataagggagcataattattgggccaacatgctaaatgtgcctcaaacttaacttcacatccaaatatcttcctgggactttttgttttttttgcaataatactggttggttattggttttagtggcaagatttttctagttcatatcttgtttgttgtcgtgctttacaaaccacaaagtgaaccaatcagctattgcagctccagaaactttatatgttactaagttgatgtgtcaaagaataagattcataccatactattgaagtagaaaccaactgtagtgaagtatagagacaacatcctgtagaaatcaaatctgtgccctagtcgataaatatctcgacagagtgtttgttcaccatttccgtttgccaccttggcctcaaagttggatatttgattcattccaacatcacgtcctttacccagctgtatatattcatgatgagtaacatttccttgccgcagggttgaattgaatcctttaatcagaacaaccataagcttactgcacagaacaaaactaatttgcatgatgcacataatctctggaaattttacctgcaaagatatcctcgctaaggttgataacctttgatgccttgcttatgccaccccttgtgaggtgaaagattctatcgaaaacatcagggtgaccataatggaatcgtaccctgcataagaaatttggaaaaataaccaaagaaaataactccgctgctcatggtacaattgtacaaagatctacacagcaaggtgaaaatcattctagcctaacctgtatcacttgagttttataattcctatatttacttaacaatttatctcctatcctctcaaaaaattatctcctacacgataaattgtacctaaaatcaggttttacacggtgagaattgtgatagtacctagcccccactggttccctaaaactggtgggttattgggtggtttctagactcactctaggcactgccaatcagtttgggattgatgaaaattgttcaagttagtcaaaccagtctaacttgggagtaaattggtataaatatcattactaactcactgaaaatgagatgagtaaataacaagaataattgatttgtcacatctgaccagtttgaccataaacaggtaagaactggctggtccacaggcctttacaaccctgtcagctgtacgttccttgaatttatgtgctgtaaattatcatttctaaattctaagtatattgccttcaacccctgtgttcatagcatgcatggccttgtgtttgctttgctatgctatgattttggctagtcaatgccatttaacaattttagcaatttattgttcaaaattatagttcctttacaccttaacaagtaaatctcccagcatatattgatcctttattccttgtgtaactcataaaaatattctagtttggtggttggttatggctccatggaacatttagtagttatcaaaatccaataatatgaaagctacacatttgtgggtaggagctctgccatgaattagataggatcaaagcttagacaaaaccatactgaatgcttgaggagaagccaacaacatgaaaggaatatgaatcaagcagacattaaggttgtgcaatatggtgactatattgcagaagttgtataaaatgaattggccaatataattttgaaggtgaaaggagacatacttgagagtgttcgcaagaacacgttgtccaatggtaacgaaactagtctcttggtttgacataaaccacgcaagggatgaaacactatatgtcaagtaagaacaacataatgttagtacaaaaggagttaaaaaaataaatacactatcagcaaaattgatggcgcgctaaagtctagaggtgattaatagaaaaaaagaaaagccaaacctcccagtaaagatatgttcgcgaacacccaatattgttggttcagactttccgtgtttaataaggaactcttccagtagatttctcattttaaatgcttcctcaaggtaattatcctgcacaacagagaatataagataaactactaagtgggacttattttacacagagattgcatacctggttcatgtcaattgcttgaagcgcttctcctctagtgaagattatagcgtgattttgattattaggctttccctcgccaatatctgttggtttacctgggagccttatccggtaaatttcctaaaaaaaggttaaatgtcaaattgcaaggcatcactagtcagtttaacttaatcatgtactgactcggttaacaacaatattgagctctatttacaagagatatttgttctaagttcattagtgtgcaacatatttccagagcaattaagaggttattcaattcgctgccatttcctggaatgttgacaactgcaccctgacatcagtgttgatgtctttatgcatttgaatactgttccaatttattttataaatattactatccacaacttgatctacaagcactttatcacttaaaggtaaaaccgatctataatcactatcatggataataaaatatctacagaaaaaggtagatatttgagttcaagcaatgaaaattcagtacctcatcattgcctttcacaagaactgagtaatattgtttctccattttaccatttggtaatggcacttctttctcatcaatgtaagcaatacgcaatgctggatacctgtattgcacataacgctgaaggatgcacaaaagatatgtactttataaaatgtaatgggtgttcagcaacttacgttaacatgagatttaagatgttttcataaagacctttttcacgggaatcctttgatgccttatgcatgccatagagttggcaggaaacaacataagtgaattttatatcagcaatggccttggaccttgcagattcctctccgtctaaatcagctaaggtataacaatgtagccaaagttaattgtttccacataaaatgaaaaatggaggaccagtgttttgtaacaagagcactatctgcctaaccttgagcatttgtcatatcctcatagcattgtagttcaagagctcgtctgtagtacatcattcctctcactagacataagaagataaaaacaataagatctggagaatagatataagtttggcagcttactagaggatagaaacattcatagtaccagttctggcaagtgtttgaccacggtaagatgcccagatacggacatcatccatgtacccttttactgcctcttcattttctgggtcaactccaatgcgttctagaaagttcttccattcatctggtgaagtgacaaagcattactcattaaatttttactatgaacacagaaataagatgaactacatttaggatacactaaaatctgatgagtaagatggttgatagtatggaaaaccagattggtggaacacatactctttcactcttcacatttatcatgtcactatttttaatttgtaacattgatctgcggatccttcacgaattgtgttcagcagtttttattgataaaaaagaatctgcaactcacctggataaatcttttgtagatagaacaaaattgaaatgccatcttcattcttcttattcagttcatgagaagaatagagcacttcctcattataatatggagtcaaaacactaaatagtggagtttgttagaatgtgaagttcctcaaaatgagtgcagaggatagtaaattaataacagaagtaacactgcgcattatgtacaggtgtacagggctgagtgaagatataataaaaaattaaaaacatcatatcgttaacatgatttatttcgaaagacatgaatctgaatatggttaattaaaaagaacatacatttgtccatgtctcaatgttcacatgacgagcacttgtgcatatagctctataaccatttatctaacaaacaatctgatgtcccctcccaaaaaaaaacttcagtcagtagggaaaaaaaaaaccttatcaggcatcggaccatccccaattttcagtttggttctgagcaaaactatcgggttcaaccggttactactgtttcatttgcatctctagtcttttatgcaaaccagaccaggtacgggctctagtttcccccagtttaaccgtcggtccattatagttaactattcaaaatgcagcatgtatgcacggaatgtcatattataaaaaatcgccgtacagagttttatttaattaatttattagtccacataccaatatattaggatatgttatgtacaaacaaatatggtgtaatctaatggtcttatagatttaggcaggtatcagaatctcatcaatttctgctgtaaccaacatatgcagacagaataaacttagaaatcaaatctacccatacttctgaaataaaagttcattgatgataaaatgcacacctaaatgaaatcatatcatgaacttgaggtgcttttggcattttcatgaacagtgagtttgcaaagaaggtgatcctacgccgagcatccaaatttgttggtacatccattgcggaatccttcatagtcaacaataagtgcaaccggacaaactgggagcaaaacatctatttcagtattaaacaattaagaaacaactttcagagaagtcacaatgatagttgcacaccttctccttccaaaacgattcctttatcatatccatgtctaaatgtgtgaacctctgctttctctcattctcatctttcaaaatactgccacagttttcaaacaattaaaccaacacatttcatatctaaggaacttattaattacaatagttcttacccctgtccatctttcatgaaatcccgtgtagtaatttccataaaatcttgcagagcattaatgatttttctctcagcagtaccatcagtagattcattgctctgcaaaatgagtgataaatacagattaaatgtaatatatatatacgcagaaaaggaactaataaaataaatccattcattcttctgcaaaacgagtgattaaatgaatctgcgttaaatgtaaatatatgcagaaaacaaactaataaaatgaatcaggcataacagttgttaccagtagatgcaataattttgccagcgtgttgctgactttgccaatctctgccatatgaaaatcttccaaaagtgtattattttccacactatcaagcactgttttatcaatggcatcgacgattctgcagcagtatgtcaaatgagccaaatcagtaatttctaatatattgtacagaggaatagattcaccatgtaaatgaaagagtatggcctttacttctgatcattattgtctagcagaagattcttaagaataagaaccaaggactcgtagcattctatgacagcattgaatctagcttggtctagtctgattttttcaatcaactcatggtaatccccttctttagaagtcatggccatgtgaagagctgtgggtacctggtatattcctgagaccatgagcatctctgcaaaataatcaaataatattggataatttattatctatttctgagcaaacaggctttgcgcaccttactggcaacaaggaaaggaggccatggagtaacagaaaaactacttgaaaatgacggagccatcagtatgtccctttctctatcaaaataaaagttgagggttaaccctacagtgaatggcatagtggaatactattcaaaaaaagtttacagttccaacctatcacttatgaagtcttcctctcgtaaggaattgatgaatgaattccaaacacaaaaaaatctcccctcaccacatgcttgctgcaatgaaggtaataaaatcactcaaaattcaagtgcctttagcaaatactaaagaaattatgcatttctatgtcttcagcccacctaaaagggaaacagatcctaacttactgccctctgactttgagtggctgacatgtgggcccctagctcgcgggcccatatgtcagcgacccacatcagagggcagtacgtcagaggagattttccccctaaaagatggcccctgtatgcattgtagccacctacactttcattctcactgcatgtaaaagggtaaactcggatatccagatctcttgtttatataatagcttcagcctacctagtctcactaagtcggaagtttcacaatcttagaggtgttggtaggatcacttctgaactacacacgctagtctagctgaaaacctgattatgtgctgctgaaaagcttagtaacttaggaagggtacatgtccttctataggacttttaagtcggtgctacagtagaagggcgtgtacccttcctaaattagtaagcttttcagctcagtttcagctagactaaagtacagttcagaagtgatcctattcctaccaacaagaggaaatttccatgcttgaaagtttcaaaatgacatttgaaacttccatagtaaatgttttctgaaaatacaagatgaatttgcttcacttgaaatatttcaagttttgagtcaaaagttgtgaagccaatgtgaaaaaatctctgcttttgcggtagggatgaagagggagatgacaattattacgtgtgtagaggggggtttctgcagaggagatagctatcagatgatgaggggagtggagtctcatttacttaggctgtccgtgttaagcatagttgtaaaaaggggaccagactggtggttcaatcagaaaaaccagaaccagatctcagcacagtttggttgcatcaaaagaccagatgtgcatttggacccctttgaacagctcgaaccaacagtcttgaggtcatgaggtgaactggctattataaacctggaaaggctgggccggcaggggaggaagagtgtttgtaatgggccaaacggaagactaatcctttccctcaagacccaccacagcttaatttctttggcaaaaaacacagtttggttgtgccgaaagaaccaatgtgcattaaactgggacaggttggcctggctggggaaggaagagtgtctgtggtggcccaaacaaaatcctaatcctttccctcgaggcccaccacagcattcttttgtcaaaaaaccagtaaagggtgtgtcaatgggatccgatccctggttgagagattcaaagcagtgtgccttctccatcctaccatgaaggctgctgcattttaaatggaacatatactgcatttaagtatattaatattaaccaaccacggtttgactgcctagaccgactgtcagcgatgggttcacccatcaatctgactttttaaccatgattagcagtcccatgaggaaaatacaaacctctctatgcgctgttgcatggcttttattgaaagcttctggcattgatttgaatctggctcttaacatgccaagggtacgtatctacattaaaagaaaaagaagatatcttacaactaaacatttttaacactgcaaatatattgtcatacataaaagagtcactaacctcaccaacatgactaagggcacctgaaacacccccaaatgcagttgaaaaaatagcataccatatttgtatatccatgaagtacacctataaatagagcagtaggttatatcaatcatggaacaatattagaaccttccaagttcgagaaaaaaaaattgaaccttcatgattataattacataccatgacgattggggcccatatagtaatgacgacaccaaggttgtgtggcactgttaaaaattaacaagaatattgtaagtaaaatataatcaccataagaaccatgcagataacatgtatatccaaaataacaagagaatattagaaaagaaataaggagaagccccatatacttaattatatagttgcccccctcccccaactgccacacacacacacacacacataaaaaataaagaaaactaagtgtagttaatgtatttctctcttctctcatgaaaccacatgacctcaattgtttgtagctttggatgatcaaactacagttcaaattgtctcacttctcttataaatagcctcaattgtttctaacctttggatgattaacctatgcagcaaattatctctcttcacttttaaagtcacatcatctcaattatttctagcctttgcatgtttgatcaaaggtgtaaattgcaaaaagcatataaaatcaattatcttgcaccatattttatcattgtggtacagtattcacgcagcaatgcacagggttttcatctaatgttataggaaatgaaatcaccaaatgaaacaacattattgcaagagaacaaaatcaagtttggccctcaacctctgttggaaagctattcactctgaactcaaaaaaggctgtcttccccagtactctaaaatctggacagataacaccctcaaccctattctatggtggttttgattagagtaaaatgcaccacgggtactaaaacttgaaaggtgggtgcacttcagttgtaaattgctcaagcaagtcacacaacttgtttcgggggttcaaatatcacagagtacatgtcacatgaactatttgttgctaaattaaaaacttttggcgtaagttgatgcacttgtgaaccgcagagcaaggttacaagtttcaagttaagcaaattaacctccatatttttacgtgcactcctacatgcatatgctttcagtcaacacaatcgcatagtgcttagcaataaaacaacaaaattcatcttaaattggattttactgtcaatacttttacaccattggtttatttgtagccatgtttatgaaagaaattaatatggcatccaacttcgaagatgaacatcccacatggcatatgttttatgtgatttgcacctcggaaacaagatgggtgattcttttgagctatttgcaaaatgagtgacttaattgcacccaccttacaacttgtggtactgctggtgtactttactcattagagtaattcagaggggacaggattgcattgaacatttggtccaatctagctatatcacaagatacttacggaaagggaagatttcatgccactcatagttcccaactccttggttaagaaggaactttgtcggaccaataattggggatatctgcacaaaacgaaaacacattccatagagtaaggaaaaaaagaaattgcatacattaaaactgttatcgtaattcctgttgcagaatagaagatagatatttttttgaaacaaaaaataatagacagtacttctttgtcaaggtcttctaaaattgagttttttacttggcagctgtgtaaacattaatatagctcattattagattttcaatagttgtttccttttatatggtaaagaagacatatcattttcaaacttgtatatatttttctagatttttcattttttcagggcaaacaaggttaagtctctggcccataagactactcggtactcacgcccagcatggtacagcatgtgttgtactttcaagttgtagtacctgcggtgcattcattaggtcgagccaacccgactctgtgtacaggagctcatgtcagaccccatttagccacacctacccaaaccgctgagtatgcaggagccaacatgcataatcaagccactaagacaaatgtgagcattagatgcacgttcactggtgtagcaggcactggcttgtactatcatcactgtacatgagagcacaggggagagacaagagaggaacaacattggatagaagaacaaggaaacatcactctcactaacatgttggaagtggcactagccaagccaaaacaacatgaagtaataatgaacacatggttttctatttttctgcaacagaaatttctcaaccttgag

SEQ ID NO: 70206 - DNA, 689 bp, Oryza sativa
agtgatagaaatcatggcagcaagtatcattattgtgatcacattctgcatggagaaatgtattttttccaagaatataagcccattcctctgctagtaaagttcccatgtcaacctattttactttaaaaccaaagaaactgtaaataaaaaaacgagatagagatttgcaattcactgggtacaaaagttagatgcacttctttaacattttagcagattgcttccaacatatgacatcaacttcccagtcagttggttattttacatcttgaaaagcaatatttttctatcagtccaactaatttgagaaaaaaaattctgaatgagatatgtcaagagcagttgtgaggctgaattgttcagggatgtatggaaagcaagcttgtgtttgacgcaacaaatatgtgtatatgtaagattgatggagtatggattctgagcgatagcagtagacaattcaatcaatattttatcacctaaagatcatgcatagtattttgacgaaacaacggcagatgtgcaccttcaagatgaagctttactgacgatccaagtcgttgagggggtctaagatccagaatccataaacactctccagaacacatgcattgcaggtgaggagccggacgggacatttcgccgagcaccccgcgttcattgtactctgaggaaaagcggcaagcgct

SEQ ID NO: 70207 - DNA, 63284 bp, Oryza sativa
  unsure (1)..(63284): unsure at all n locations
tgaccatgtcgtatgcgcgtactgaccatgacaggccccctggcttgcacactagaatctgactgatgtgtccatcgccaacgattgcagcgacaaggcttggcaagcacaggatcagcttgcttatgtgcagatgctctgagccgcggatatgcatccatgtgacagggtatgcagtgccttgttgatcgtacttagcaactgcatttggtggacggaggcggacgctggacagggcaaggagcgtcacggtggcgccggtgaagggattcaccaagaagcagccgtcgtcgcgcgggaagacgagccgtctgccgcaggtggccttgtagccagcgaagccgaagccggggaagcggaagggctcgtcgtagggggggctgtagaaggtgccgtccgggagcgcgagcagcggcagcggcggcggcggggggaggggccgctgccgcgcggtggcgcgccactgcgggcacaccgcggcgaagcgcgcgcggtcggcgtgcgcggggaggaggcggagcaccaggccggcgatgtccgccggtatgtccgaccacgacttcggcctccgtggcgtcggctcgtccgccatcgacgaccttgcaaagaaacacaaggaaaaggaaacacgacaacgttgcatcagccgacgcagccgaagaagggaagcacgccaagaaaaccgaaacgcgccacactcacgcaggcagaggcaaaacgtcgaacagcttgcgtgcgcgaccacctataggcggaggatagcaggaggaagagcaaggagcaaggagagggaagcggcgggagtaagtagaggagatggaagaggtggataccgcagtagatcgatggatttgcgatcgcgcgggcggccggagagacgaaatcgttagactgctgcctgctggtgtggtgagagccggagaggcggagacagttgacgagaacgagaggaggcagagtgagcctcagcaggcaaaaccagttcagctggttggcagcacttttactagcaaaaccctttttttagtctatttttttcccattatctttctattcaattattgcgaagagtgaatcagtgaaatacatggccggtccttaaacttgtggtgtggtgttactttggtccgtgaacttgaaaattacatgtttagatccgtgaacttggtttaatgtaccacccccgatccaatcgtcatttgaccacgtttgaccgccacgtaggcaacactttgcgctcagcccccttcacatataccttcgcacataacttgccctgaactcaacctcatggattagcggcgggaggcagcgcaatacgttttcactcaacgtagacgcatttgcactctccacccctatgcactcaacgtatgatggatgtctatgcttattatatattaagcatgattcgttcgttacatttgtttaataattgcactagtttattccctactaaagttatgattattatcttgataatttggattagaatatgccgaattgtgaccatatttccaacagggacgagcttggagaatccatgaggatgcctagtgtgcaagacgcattgcgctgcctcccgccgctaatctggccgcactgtgcaacctctatctgacctatctgacctcaatcgttggatttttctttccagctggttttctacctcagccttatagatcttaaagtaatgcagtgcttcatcctttgttttcaataagtacacaaagcaaaatctagtgcaatcatctatcagtatcatgaaatatttctttccccctttagtcaacacactgttcattttgcatagatcggaatgaacaagttctagaggagccaaattcctcgcctcagatgcactgtgaggcttgcgaggttgtttcgattgaaaacaggtatgacacttggaacctttaactaaagcaaattttggaattaaactcatgttggctaagcgcgtcatacaaccaaaattcacatgacagagtcgcgaatgccacacatttgactcgtcatcattgcttacatggtccaaagaaaagcggaacaagcctccgctatcataacattttctaataaacgttccatatttagatacaacacatttattggattcaaacacaaatctaaaatcatgtctacacagtagagagccgctaactagattcttctttattgaagggacatgctgcacgtttttcagctgcacggtctttcccgaagtaaactttagatcgaccgtaccaacaccaagaacagccgcaagcgacccattttccatcaacaaggaggaacctctcccgacttgataagaagaaaacaaggaaatgtcagcacacacatgaatattaacaccagtgttaacccaccaatcaggtgagtgacaaataggaagaactgtaggtaaaaatttaccataccccgatgttcctccgcccttgctaatgaccatgtttgcagactttctgtctttgcgcttaggacagtccttggcccaatgcccaggcttgccacacacaaagcagtcacccttagcctttcccttgcctttcttcttaaaagtagttgtagccttgggtttgacatcaggcttgactttcttgttgttatgggatgcttgagggtttttcttctataccaaattggtactagaactcccctccacctttttgccgcggttgtcctttgccctcgccttctcctcaacacccaaagagcctatgagatcagtgacactgagctcttgcctctgtgttttagagaagtagcaaagtcggaccaaaaaggtggcaatttggctatgatacctcccgccacgaacatgtctggcaactcatagcggttgttctcaagttcctttgccagcatctgtatctcatgagcttgttccactacagatcgatcatcgaccatcttgtagtcatagaactgctccatgacatacagctcactgccagcatcagaaaccccgaatttcgcctcaagtgcatcccacatttccttcctgaaggcatgtgcatgtacacgtccactatgttgtcgatgagcacactgatcaatgctccacggaatatgcaatccgcagcctcgaacttggcctcctcctcaggagagagaggcggtttactcagtttgccccgtgaaacaaagaaacattgcatcgctgtcaaccatagtagtgcacgtgctttccatctcttatagtttgaaccatcgaaagcgtgcggtttcagtgatgcggcaaatccaactaccgaaaaggacctatcaggtttttggattgttggaaatatggtcacaattcagcatattttaatccaaattatcaagataataatcatgactttaacagggaataaactagtgcaattgttaaacaaatgtaacgaacgaatcatgcttaatatataataagcatagacatccatcatacagcaatgcattgaaaacattgcgctaaacagaaacacaataagaattaacgcagtaaacaatagtatagagagattatacccagagaatggccctccgctggattgtgaggcataattgtctccgttgatgaagcctccagtaccatcctgtctagccgtacccttcccatccgcgcgcgttggtgttgtccgccgacatggtgaggatcgcaaccgtgcaaaatccaagaaaagagcagtcgcgttgaagaacgctcccaaaaacatgattgcccgcctacccgtgctagcagcgcaagaacagaaggaggtaaccagcgacaggaagagaggcacagagaggagacccgagaggactgattggcgatgggagagaggcagagtatttcccgagagtaacgttcgctcgggaattaatcgtgtcgttaatgccgaaacaatctctgtgaattaatcgcgtcattaatgccgaaccaatctccatccgttgcgctgttggtgttgtccgccgacatggtgaggatcgcagccatgcagaatccaagaaaagagcagtcgcatggaagaacgctccccaaaaacatgattgcccgcctacccatgctagcagcgcagtaacagaaggaggtaactagcgacgggaggagaggcatagagaggagacccgagaggactgactggcgacgggagagaggtagagtctctcccgagagtaacgttcgctcgggaattaatcgtgtcgttaatgccgaatcaatcttcgggaattaatagcgtcgttaatgccgaatcaatctccgtttgttacaaaacatgagagagagagagagagagagcagcagcagcagcagcctgcctcgccacggccacgggccgaccggccggcgcgcgcgcgcatgtggcagtccgcccactatctcaaccggtcaatagggactctcctctagttctctttttaagttgagatctctccacttaaattcccgacgtggttttattacctctaacattaattgtgggcctatggaatttaattgaattatattgggcctagaccatttattccaacagtccctgtcttgaagttgtcggaagaaggtgttgttgatcaagtacccgttgcgcaaggataaggttattttggagcgcagagcaatggcaattgctaatccggaccgcattttctatacatgcaaggagaagaatgagaaggaagaacgattttaaggattttttttggggggattctggtgtcactatatagctacaaggagatatatgcgacgtgttgtgatgtggagggggctgagagcaaaaatgttgtctacataggtggcatgccacgttggcggtcaaacgcagacaaaggacatttggaccaggtgtagcatcctaaaaaattacaattttctagttatgcatcatgtcggttcttatgttcttattaacatcctaaacctaggaaaatataattaaagagacctcctaaaactaacttgcttaaaacttcttcgtttatttaattccttttatgacttttattaaaaacctatcttgagatatttcttgatttgatttcaaactttcttttgctaaatctttctttatttaaatatagtttgaaaacccctttttacttttatgaattatggtccaagaaaccttcccatattcccctagaacataaaccaaagcaattccaattttattggaattaagtgtcaacccatcctttgatcttaaacctcaattcaaatatccaaatccttacttttgacctagccactgatttaaatcctgtggctataatacccttctcggcgcaagaataatattatgaataattgctcttgtgctaagaaaataggtttcatctttttatccaaaatccaagttccctattagcctcaaatacatctccaaaatccttgccaaataatttgaggctaacatcctatttatttcccctccatattcttcccacatttccaaaaatatatccaaatttaggagtcctattattcctagtgcagaaatacccctacttcttatttgagtacttccaaataaattccctcaaactccacttctaaaaatattgcactcaaataaaatagaagatctttattttggaattcacatataaactccctccaaatataaccccatctatcaattctactcaatctgggccgaagtaccttcacctaggcccaagtcagaaaatctaatttccctccctctctctgtgggcgcatttggcgcccaggctacggccgccgccgcccacagtcctgccgccgtcgccagccaatcaccgaacgaggccggcgccgttctcttcgcctccactccaccgacgccgtgccttgccttcctcctccaatcttacggcagccaccacgtatgcgcgccgcccttttcgtccaatgggagaacgaagccgacgccgtattcctcttcctcacgccactgtcgccgtgccttcctcgtcttccaccggcgaaccgaccttcatgaaccgacgtccacctcttttcgccatccgagccttgagctcttcttcttctctctctcctcccatgtccggccgtcgccgccgacggtcgatctcctccctcgtagcttctctatcctttcccttgcgccactatgatggcgaatccattttacccctttaccccttcccttccaccttgagttaagccaccaccgccacctcccaaaccggccggggctaagctcttgccgctgctgttccggccatccctctcttcctctctaccaaccaccgacctccccgagtgcgcgtcgaccgggaacacaatatgccgccgacgtcgccacactttggccactggaagcccggcgccccgctcaccctctcctctctcttctctcggctcactgtgaggcagaggaagaagagaacgaaggaagaagaaagagagaaagaaaaataaaagaaaaggatattccctgacaggtgggcccctatacagtaccctttcatattttctagatttaattcaaatcctattatttagaagcccatatctcctaaatcatagatccgatttcagtgaaacttggacctaaattcatctaaattcaaaatctacattttgataccaaatttgctattttaatattttatttgaatttacttaatttattcaaataccatttgaataaatatttgatttaatcttataattgaatttacaatttaaacttacatttgcttttcaaatattttattttatttccaaaataccctttagccactaaaaagttgccggttggaactttacgccttacatggggacgttcgtgcggtctaccgaccccaacgtcggaccgttggttgtaaagcccagcaaaaccaaacctaaggtcgaagtgctgctcctggcaccccacgcctcgatgcatatagtggtcggagcttcactattccctcgacctccacagcacgccgcacagttagctctcgggctctatgtgatcctagccgctccaccgccactcacggttgttggagtaacacttccgcccccactaatcttacaccaacctcctattcctctagccgatatgttgtctgtcgacaccggctagagaagacaccaaatctagtcgttatgctgccaactctagcaacgactagcaaacaaccaaaccctagccgataccttcttagttaaattccagccatcatccaaattccatatcctctacaatattacctatccaccatattctccgccacctactctccacctaccagaacctatatataaactatagagcctaaccgatgcgctatcctattccacaattggctctaagatataactaaaccccagctattatattacctaaacctaccgccatcaaatactagctagccacatactcgcttaaccaagacaactatccaaactagctacttcccatccttccaaccaatcaaagccttcacataaaatataagcaaccttagttgcctgatcccttctccaccttagcctccaacccttcagaacctccaaatgaaatagtagcccaataatcctaataccctataaaagagataggctataccctaaaccctagccctcctaatcgtttaccgctttcttgctattttatggcttttattgaatttggttcttcctcttcttcagtagagtctattatatttggatggcaacctgtggtatttcgagcatcggataatcaggttgcctatctcggatttatttgcgttggagcaaggtaagttattattcctcctcttgagcataattatcctataatctatatctctattctatgcattagccattcatgattttaaatgcataacctgaacatatagcaaaccagatatgctagcttttgcttagccatgcctagttagattgcataaaatataatgaacttagattgaaacaatacggtagaagtggttgatttccgggtggctagtactgttccaaccgatataagactgccaagtacatgtgaagaacatacgagtacgaccgcaattctcgtatgggcatagacctagctgattaagttatctagcaaaggtgatacctctgtatagtggttcttcttaagtcctcgcgcaggaggcaattctatgccgagcagggcaattatgatatttaccgaggcacaggtaaatatacttatattgatagtccaggggactatgttatggccatgtgattttgtgaaccctgattgcgatgacatggtgtcatacaatcagttctctctaaagacctcgggaacgccagaactcctcacactgctgacaacgttacgttcagagcgcatggggactagagttcatggaacaggtaccactaatgttaataactgaaaagctttgccatgacaaggctaatgtgtttggcacgtcatgggttgcgggtaaagcgtacatttactgcagtaaagtataaatgaatctattcgaatagccgtgctcacggatttgagcattgggactcatatagtatttggttagaaacttaattccaaactttattaaatactgttgtattaaaatcattacaggctttctacttatatattctctgctttctgcaactaatcatagccctactcaaatattaccatttcatacattcattattgaatataatagcttgctgagtacgttgtactcacccttgcttcaacccccttttcacagtcaatttggagttcttactgaagctgggagttcaatcacataaattagttcccttttaacctagtcttcaaatcagattatttagatggtttaagtctataacaaaacagcaaagttaggccattctaaaacttctgttgtaatagttagccataatcttgtaaataccctattactttatataataatatctctttcaaagatatgtctaaacgtatgcaaagacgatccagattattgaacttgtatcaatctactgattcagggcttgatacagttttaatatgtcggttaccgaatcattagttttgggacccggcaccggggtggtacattaaactaagttcacggatctaaacgtgtaattttcaagttcacggacctaagtgacaccaccacacaagtttaagaaccggccatgtattttaatctattgggaagaacgagcccatttggtagttcggttttcccctggcttctcaagctatagctcaagcatgattcattaacaatttgctttttaaaaaaaattattttgcaaataaatgctccctcggtttcatattataagtcgtttgagtttgactaagtttatataataatttaacaacatctaaaatatgaaattagtttaattaaatctaacattgaatatagtttcataatatgtttgttttgtgtcgaaaataccactatatttttctatttttctataaagttggtcaaatttaaaaaaaattgactaaaaaagttaaacatacaatatgaaacagaaacggaaggagtgatgttcaatgtctcggtgccaacgacagagtcgaaacttgttatccttagcatacttcttttcttctaaagtgaccgatggtatcgatggggtgacaccaatatcatttgctatgaggttcgacgtcaactattattggtgttgactgttgagctcccgcacctatcatttaatctgagagaatgtgttctacctcgatctcacattttatccaaaagaacgaaacaaattataggaatgtaaagagggaagggagtagctatatttacggcactatatttttcaccaaaaaatagtcagcatgtatttacattgtaagtccctaaattacatatgtaaatttagtatatttataatgtaagttttaaaattacatatgtaagtcccaaaattacatagtaattacatgtttaagtagtgtataagtgagatgtaagtggagtgtaaatttgtataaagtatagtatgcatgcgtgtaaaaccttgaactaatgaagatgttaagctttaattaatcgtgttgcactactaaaaaaatacccattagtgccagttcttaatgcctaaaaggtgctggttttgcggccgacactttttggtcggcacctatgatcgaagtcattggcacctataatataatagctgccggatatacccctagaaccgagactcatatggtactataggtgccggtgtctgtaaataacgggcacgtattcggatgaacgaggcaaaaaaaaaattccccagccaagccgagcagagcaagcactgtagagcggataatatccatcaaaaattcattacatcacaatccctaaatccatgaaagatccaccatccaactatattttagaatcaaaattgacaaaaaggaaaattcacagaacataagtatttggtccagaaaaatcgaccaaaaaaattcaaaggaaaatgtagtctgcaattagactttgtatcttaagtcccaattttttccaggaacatccaccaacctgctcgatgtaggggatgacgatgtcgtcgatgagcttgaaaattgcaacaggcagtccacctcccatccgacgagatgcacccgcaccatcgtcttcctctcgctgtccacctgcacacacgcatcatcacatgcccaaatcagtaaccatcacagcaagaacacgcaacagattgacaaggcctccgagctcagcacctcggcggcggaggcgcccaaccctgcagctgcggcgccatcagagggaggagctcgccgcctgcttcacgccgccggccgctggtgccggatccacagcggaaaccaccgctgccgccggatcccacgccgtcaccgccgaatgcgccgccgcaacccgtcgcccccgcctcccgcctcctgactcccgcctcccctcccgccggatccggcggaggggagggcgccgccgccgcccgcagcttcccatctcaccgccgcttacgtcgcctctgccgggatgccgcccgaccgccgccgcgcaagagacgagaagcagagaggaggcgagagaagacgagagagagaggcgagactcgagagagagataaggccgatagagagagagccgagactcggcgataagtttgactcgacggtctggatcggctcggctcggtttggaaaggtgccggtttttttaaaaaaccgacacctataatttattattggtgtcggttctacagaagacccggcacctatatataggtgtcggttttttatttagaaaaccggcacctatattatattaaagttgtttttttaataaaccggtacttatgttataggtgtcggttttttattagaaccggcccctataattgtttaaaggtgtcggttttatgtgttttcagtccacggaggagagaaaaatattataggtgccggttttaactgttccggcacctatagtgccgatctctatgagcttttttttagtagtgttggcagtcgcaacgttaggctgccatggcaatatgcacggccaagatcgcattggcacgggacaaacgaaatcggacgcttcaaaacgccgactgtgatggaggagaaaatgtgtttgcgattccaaagagggaatattgcttcggtcaattttcactatgaaatccaactctaatccctacttaaagcggactatataaggtgaaattattattatctacacctacatatatgcatgcatgcgatttaaatagtgatataaaatttaacaagatgaattatgatgatgaacaccagacaaacctaagtctaaattcgatcctacaccttgccgttatataaggcgatcgatcccctgcatcccataaaaacctactggggcttttgcctcagccctactcaacataatcgtgtagatgtaacacacttttgcgaaaacgctttgtgttgggcgtccgatctggagagaaaaatcagatgcccacacacccacaccactcttctctcaaccttatctcttccccaaccccccctccctctctctctcacatgtcactctccccctgtacttgagcgaggcggagacgaggtggagcgcggcggacgggtcgccggagtcgagggaggcagccgcggcgtggaggcggtggaggggagagcggcgcagggccgcgcgtagggagcccggcaccgggtacgccgcgatggctgcgcggaggggcgaggctgagttcaccgacgcgcggggtcctcccagcggcgtggcggagaggaggatgagcagagtgagcaccgccgccacggaggctacggggaggaggcggcgccggcggagttcctagtcgtcgtggtggccgtggccgagggagcgtagctgttgatgcgaaaaacacacactggcttgggagatctgcttaactccagtgcatatccaaagattgatgagatgtgggcgtgccagtcagtttgatcctgcaactgacaagatatgtaaactgtagatcaaatagccgatcggctaaacagccgatagagcaatcccagccgatagcgatagggttttgagctatcggctatatgtccaatgtaaataatgatataaagtcaatcggctgataataatataatataacaatatcataatccaatagaaatcaatcggctagcaatgatatgatagaataagcacttatccgaaggttaaagcatacatcggctagaggtccgatgccataaaatccacagattagattaaacagtgaaacctttgttgtcatcggctaaatccaacttatatatatatatacgtaatccttataagccgatgcaacgtccagatatcttatcggctagcaccccgataaaacattagcatgaacctatcggcttaacaagacttatattatcaacaacaatctagtaggtcgaacctaaccgatacagcacgagattgtatatgataatctaatacccttaatgtgatggatataacaaatctatctagaacgacattgtgattgtagagatatatcggctatgatagaagatcagacttaaccgagacagttccagctaaaccgatgcatctctaaacacaatgtaattaaagatagaatcgagatatcaggtaggcaaatcaatcaaccaaaccagagcgatccaagagattgaagcgatgcagccttaaacgacgccaacgtagatgacagattcaccagagcccggcggaacgtaggacttaccctttcgccggagatcgaaagccgatgcagccccgcgtcaggtgcccaaatcccaccggttgataagtaaaaaccttaggaaagagggtggcgatgcaccgagagtagttgtattgatcgagattgatagattacagggacccctggtacacaatttatacccttgggcctatagagtccttgtcggacaagaaacaaactttctaaaagataaaacagaaacataaagtccttatcagacacactttcctaaagataaaaggaaactaataaactattcctaattaatagatacaattgccttcttcggactcaatccgcacgtggcaatcctcatgaagcactttaaacgaacccaacaatggttccaacatccccttgtcggaatcggctacatcggcttccttgtccaattcgatattagccgatgcacaccgtagccgatgcagttccgaagccgatttatactctgtttttgttgccgatttccttccaaatccgcttcggtcttaactccaaatccaatgtatgatttaccaaatttggtcgttaacagcagcattccggcaccgttgaagatttggccaccggggtggaggaagaagccaaatctagaccggtaaatttatttgatttttcaatgttccagtctattttgtctcgatgtttctctgtgttaaatcgaaatgtttcactgcatttttcaatggtgtttcacatttcaacaacagtataaacttgatgtttcatgtgtaagatacaaatgtttcaatcttgccggtgaggggtagaagatgaaggtgggttcatttttatttgagttctagagatgttgcaacctattgttctatctcgttgcactttattgtgctaaagtgtttcattttgtttttgtttcagtattgcactttactgattcttcgtgttgcaaccagtctatttcagatattgcatttgattgaaacaattttgttcaagcaatgaaacatttttcctcgatcgatgaaacattttcgttgaaacatttttttcgtgagtggtgcaacatgtgaaacactttgtgataatatagtgcaacaccgtccgatctattgcaaaagatcggacgtccgatttgtagcaacctccacacttttgtttcccctacgccgcaccacgccaccccgcacggctgctggctcgatacacctgcccgcccaacatgtgcaggattaatatcatgtttttcaaccttgctaataagttgcgatggtttagtaactcaaaatatgatcaaaattttgtatgctattctcaacaaatacaccaagaataaagcttacaatcagcgtgagttgtaacatctcttattgcataaagaatggtattacaaagttacccatcttctcttttctctcaagctcttccttttcagcaatctgtttcagcgtagtccacccctttcttgcccgcttccttgaactaccagacatctgagcagaaccacttgctacagatttatttttcacacggtcctttggagctgacttggtaggcattgtaggggccttgccagtaactgaacttggcatctcccctttcttgttctgaatgcttcttgtcttgaccagttctgcagaatccttatggtccgtcacatccaccagtttgttctttcgaggagtaacaaaacttgatccgactggaaattctgcttttgaaggaaaatcgggttggcatattgcaattttgttagcagaaacaggctcagtttcatgcatacctttttcacttgtgattgttaccactattttctgtgagacattctcctgatcagtagctgatgctgactgattcagttccaccgatgaacacgctacctccttttccatagattcgtcaagaagattgggtactggactttcctcatactcattcttttcaagattttgttgtttcaacccagatgttgactctagttgtgagaccgctgcctgagaatattcaaagccctcttttatagttactaatctcttgttattactgtcccctttcaactttatgctggttacatccatgccaactggctttcttgatgataacaagcccttcataatattctttccgctgccccttattaggttttggtctccacagaaatggcacaggtaagaaatgctgttctggcaagtgtttaacttcttgcgtcgctttgcttttcttttgttgttctttatgcggattgtgcagttgaagcctggctgtaagactgtttcacacctgcaaaagtttggagaatgtttcttcagaagtcctatagagatattgctctcttctacagtagtaatgcttatgatccagacaaatggatacgcgcagtagaaaaaaaaaacataactaggaaactgaactacaaagtactcattataagatgttttgggttttgaatagattcatgcatggatccatgtatgtgattcatatgtgtccaaattgataaggatgttagtgaatctagatgaagaatggagaggccaaaacatcttatagtgtggaactgagggggtacatagtatgtcaaaatgttttgtagtcgctttaacatggctactttagtgctcacatcatactatagatgtattaatcataattatgggttgacttccaagatttagaacaaacacatggcaattactatgctgttatttgttcaagctttgcttcagccatacaacattatcaggatgactactcatttcaatttcttataggcaaaatttgctacaagacacttaaagtctgtggcctttactgtgagacactcaaagaatatgtatcttctcgtggacactgcaaaaatgtggtaattagctgttggacacccgagacattattttattattttcggtggagacggagagagaaacattggttaaagacaagtttgcctatgggcccacttgtcaatctcacatatcctctctttctcctttcctcttcttcctcatgctgctctgttgctgccactcatgcccctcgaactcgcatcatcatcgctgctctgcagaacaccatcttgtcgtcgttgcatggcatcccgacgccgctggcgatgcgtgacttcgggtgacgtcactgacatgtacctgtgggcgaacccatcgagagggcgggagttggaatttggaacgcgttatccatctgttgaggtggaggcggacatcgccgtgacgagttgccgggcgccgcgacgggtggtcgacttcccgctggtttggtgccgacttggcgcgtagcggcgtcgcggcacggccacaacgaggcactctactctatggcgatcatccagttcaacagcattggcctccccaaggacagccgcaacctccaggccggcccaactctgcacacgcgctgcatcgtgcgggcagaacgacgtgctccgcgagctcggccactacgtctcggacggctacggcgtccgccactccctctcgggcgtacgacgcctcctcatctaggccaacctccgcgagctgtgcgccgcggtcgccacgggcgggacggggttcgtcgtggcgctcggccacaacggcgagtgcaagccaccgggcccgcacatgtgcctcctgagcgactacgggtgccatatcgccggcgtggcgaggcggctcgcgcacgcggcgaacacattcctggccgaattgttcgcgttgcggccgctagggttcggcgctagcgccggggcgctccgatgaagcaggaagaagaacagtactccgggggcatttcggtattttcaactctctttctctctgttttcaccggaaataataaaataatgtatcgggtgtccaacagctaattagcacatttttatagtgtccatgagaagatacacgttctttgagtgtctcacagcaaagaccacaaacaaactttgagtgtcctatagcaaaatttgcccttcttatatggtagcatcagtatacttaggggacaagatggaagaatagccacacacacatgcaagattgcaagaaatacttccttttagagtaaagagataattgtacatgcaactgtcagtgacacagtgttttgaatatgtgaccaatgaagtgctcattctcccaccaattctctgtacggatcaattttggactacaagattttctaaaaaagaaaaacacaatcatttgtttggacttagtgaacaaggttacagggtatgatgctctcatgaactagcagtttttaagccgtgtgaaacagtattgcaacaacagtggttgctgacagataacagaataaatataactgaaaaaaaaacaaaactacctagtgacttaatcagttcaagtcaatatgaactgttgttttgtgaatagaaggagatttacacaaatttggttagaacttgagtaatcaatcacaaagagagtttgagaatgatatgcacaatggatccaactaaataaatcatatgaataggttttgattttacaatatatctgtaaaataggtttcgattatttgctataaagaacttcaagacttggttatctgtatcccataaaactgatttatgaaatgtaccgatcgagtacattaaagctacagatcactctgtcattctcactgatagacaaatgattttaccaataaaaaaagcaagtgcaaaattatatgaatagctgaattaacacgacaacatagcatcaaaaggctgcttgatacttctatggtgcataggaaattaggaatataggataggacgatctgtttaacttttgggttctatagtatctagccggacaagtccttaaactggctaaaatgctgcttagcacaaaactactgcaatttcttagaggtatgaggaggattatgatactaataatatctgcaatggttggggggcagattggctccttcaatatcatgcaacaatttgaaagacgatgaaccacaaatgaggatctttcagtagaagaattgagcactttgccccacaacagacaggcaaattctgaaggacgcgagcatccgaccgaggtgtagtaagaagtaagcagtgaccctgacctctggcataggaaggtggaggcggccagaggtatcccggccgcctcggcgttggcggcgaggcgtcgccccagcagggcgccgagggggcccgccccggcctccccgcctgcccacgccgccagccgctgcaggtgctggaccctcagcagggaggccgcgtcagcgcgcgtcttcccggagctctcctcgcggagcgacaccgcctggttcccggccctgggcggcgccgccggggcatggccatggccgccgcgcttcttccccatgtagccgccaagccacaaccgcgaggaaggcaacggggcggggggcggggggcggagggcggcgggcggcggcgcgggagggagtaagcggaggcgaggaggcggcgacggcgagagtgtctgggtcgttgtgggccggttgggccacgccgccgcttaatttggactagcttcttttcgcctttcaggtttccagttcgagacttcgagggcatgttgatacataaaagaataagttcaccggaggtacctcaacttaattttttttaggtccttaaacacaaaaccagaaatcttcacccctaaactatacaaaaccatacactaaaggtcctatggcagtatatacagcgagatttttttaggtcccttaaatacaaaaccagaaatcttcaccctaaactatacaaaaccgtgcactaaaggtcctatggcagtatatatgggtggttctatggttcataaaagggtccataaaaggacatgggcagccaacagagcaaaagttggctctgtttcgtttgaatttatacttaaattcacgaattggtccataaaaggggagaaatcagaatcgcctgtcacctttgcagacgaggggacgccattgaagttagttgtcctctgttgtggctgggttttcttgttcagcatctactatgacatccgtgccctgttctggggtagatgagccagtaacttgggtggctggatcgacattttcattgactgcctctgctacttcacaattctccaacagcgcctgagctgacgtgctggatgagagcacattgttggaatcattgtgatccacatacataggttccaccattagttcaatctggcccatttagttaggattttccagatgtccatcttgatcaacactagtgctttgctgtgggattgcagagcctggagcaggagtggctgtatcacactcatcgatggctggtgtagctgagtgactgtgttcctccaactccagtgaaggacatgggcagatgacattgttgaaaccattatcctcctcatccataggctcgagggtcattgttgcatcatccaccatgtgaagctcttcctcttcctgatgctgagcttcttgatcggcatcaacaatgttctgttcagcttctagcaaaagtagaggcatgtcttgagcggcagctgattcaacatgtggactagtagcggaaccaccattttccttgatctcgccaaggtcatggagaacatcctgaaagccatgcagaaactcaaagaccaaggcttgtgtggttgtatcagctgtggatgtcatggccatcttggccttctttaccataccatgcagtttatcaacctacaacaatcagcagacccttcgagttaaatatattagttaaattatgcatggagtgattgtaaaactatttgaagtcttgcaaagacaacatatatctgacacaaatttaggtccaatcaactatagaaactgatcataggaactgaatagataatataggcttactgctttgcggatcataggagccttggcttgatactgaagatcaatggaatcatcaggctgtaatgaaggtcctgcttccacatcatcactgattgatggtacaagataccgccgtgtaactcctgagtaccaatgcaggtactcctcataagacgatgggtcatactgctctgactctggaaatatgcgctgccggcgggcttcccattcctgaatgtactcatgatgtgtctcttcccagttctcatgttctctgccacgtcgactaatacgatgcagcgcctgtagggtaggtcgaaaaggtggtggaatggattggcgaagcccaaattgccgcatcactcgctcaggcaaatacatctcgactatcggaaaatttattagtggagcttgtgtaagccacaaatctgcatcttttgtacaaagcaatggcaagcttgaagactcaatgtgcaagtagggttcccacttcacctgatcagctcgctgcaggttcagttcatccctgtactgcttaagacagcgtgtagcattctcactttgtgtgcgcgcacctacccaacgaaagccaacaggtggcacatcctgtggaatgtctgtctctgggcacaggggagaccggaccaatggtctgccaacatgggagcgctcccagctccaaagctgcaagagaagcaatgaaccaccaatattcttgatattgtgggaggaagcaacagaacaaagagaacggtataggaaggccagcactgcagatccccagctgtatgtcccaacacgagaaagatcagcaatcaatggaagatatatcagactcatccgtcctgttccatctggaaatagcaccccacataaaaggctcaggatatatgctcgaacatgcctctccacagtctgatcatctgctccttctggtaattcatagaaatgcttcttcagccatttgtagtgcagaaaagattttccaggcattgatggtcctcttggatcatgacctagacaatcaatgaccatctgcgcataatcatgatcagtggtagaacaaactggacggccatcgataggaagagctaacaacattgctacatcttgtagtgtaactgccatctccccagaagccaagtggaaactatgagtttctggtctccaacgctcaacaagggcagtgatcaatgccttgtccaattgaggcatcttctggcaaatttgtgagagcccaagaaggccagcatccctcaaataaggacggtatctctcatgaaattttaaaggtttgtgatgtcgcaacttcaactgctccacagcctgcaaaaaacatgacctcagtggcactgcgaagtttattctgcctacaataacttgtttacttatgcaactatgacaaaacttaattgctcttggattaacctgatcaccgaagattgcatccgatcggtggttgatcttagggttgagtaatgtgttggatacatgctctgctgctgggcttacaagacaaggttgctgcgaagtgaactcgatattgtcctctttatcagaagtagtgctcggggaagaaagtgcagaggtttcatgaaagtccatatcattttctgccaaagcacttctcccacggccacggccacgaccacggcggccaccacctcctctccttgaagacatggtcttgtactgttcctgttttgaaaaattcataagaccagtcagaggaaacagcacagacgttgacagtaaaaaaaacataaacatgtgttgagaagttagacaaggcttaagccctgaagtatgcaatgtgtgtgatcattttagtagcaggtccgaagttttaagaaatgcagaggggtctctccactaacctgatcgccaaaaaaaggagaaaaggggaaaaaaaaagaaaacatggctattcctctttatgactcgcttggaaaagagaaaattcacatgaatttgacaacaatcatttcaattcgagcgttccagacgagcctacatcgagtgaacttgctatattgatctaaacatctaatgatccacatacgcatgtcacaaaccaaaacacacagtggcttccatttttaacctacgattttccagtgacaaccaatgaacagagatttgagagtgagaatctatggaaagatgacattagagaacggtacctgcacccgcgcccttgaggactaggcgcctggctctagcaaaatttgggttcgccaacggcgcgcccacggctacatcccccctgcccccctcccaccagtctggctcgccggcttgctacgcccgcggctcacccctccgccccgcgaccacggaaatccggcgggccggcggcggccgacggggagacaagctgtagatcttcgctttctgggaggggaagagtgagccctagaatctgctttcccggggaggaggcggcgaggcgtaagccgtaaccctagtcgtaacccatctgggattcactttgtgcttttgatacatcgatagcagcttcctcctgccagcacaacgacggcccatatagccataaccccagagacccatacaatgcgccgtacttgtagtcaaaacatttcttttgtattcattgaagttgagttgtggattcttagtgaaatatgtgaatattacagccgcactcaaaattccttttttggcttctagctcatactccctccgtcccataaaaaccaacctagtactggatgtgatatatcttaataaaatgaatctggacatacatctgtccagattcgttgtacttagaatatatcacgtcaagtcctagatttactttttttgggacggagggagtacgtatcttacggtgcctaggattacaaatggccagaaaagcgatgtgtagagcttcgttgtgttttttatggagattggacaaactcacataactgaagttgtgagggtgtgaggccaaacttcgatcgaggtaatattgatgcagtcgacaagaggcttcgatgcgattatgatcaaacttctgctcggagagttttggagcttgcaatgaggtgcactagccggtcctctatcaaaagaccaacaatagcagaagttgtatctgtttgagtgaaatattagccacggtgaaagagacatatacaagtagcagctatcagtacaatagtggcacgagggagacggaaaaaatggcccatagttattcatgaatgttcctgtataatcatgtgatgaataatcttgatgatgaacgattgtcaaaggtaaatgtttattgaaaacacggtgaacactatttaatgttggtgaacagtttgttggcaatgaccgtatgtattcatgcggtctaaccagggtagcccgatggtcagactagcagactctgagaaggagtcgatttcgggttgttttcgtggaatttttaaattgttttatgtttatggctctagatggtttctatttatatgtgatattatttgtgctgatatgagttaagttggtacgaacttgtacttgagttaagttggtacgaacttgtactcagatatggagtttctttgttattcatgtgcaggtgttgcttgaggacataggagtatagccagtgatggatcgggactaggcttaagaggagttaaggtcaagacggtcaaggatatcatacgggatacttaggctaaagaacaatgcacgtggagatgaaggtttccatatggcatacacgtggtgttgtgtccatatgaacagatgagataaatttggattgaagtctaagtttagaaagattggagtgtagagttgacaatgccatgaaaaagagaggacagcctactactattagtatttgggtcaagctgaaatgctagtgagtcatgcatgattaccaagctaaataaatactctcacatcacaacgaaatgttcagaaaaggaaggcacaacagttcaccatatatcacaagagaaacatgctaattacacaggagaaacatcactggatagaaggggcagagagatgtaccgttcttggtcagtttgtcctagattttggccttcacaaccttgccatcaagccagagggagtggtcctgccataccttcttgatgtcgtatgtttctcctatttccaagtacttagcttaaatgtgaaaaacctgcaattaatatataggagcaacctgaaatcagaatgcaaataactagcagtggtagtagtagtagcggcactccatcaatctcttttgtgagtgaacatggtaaattagaggtgattattaacaattggaaggtgacaggaattttgtttggaactgtactaagctatgagctttacatgtgagaactgtctgaaattacagcaactttcagtgagctatttgcttatgcaagcacaggttttcaggaagatcacaatttttttttattgttctacagaaactggacagctagcacttttgagtatcacatcaaggtattcttgtaagaaaaggatgacctcaatcttcaagtctttgatacagtgttaccattatgtatttccagtactaatacagcataagatcttgtcatgagctgtataccatctaagctatcaattttcaacagcctgtccattgttcagagaggacaaaaattttacaatagtagttcaaaattccaataaatgaatcctaaatagatgcagttaaatctgcacctctgctctgcaccttgttcattgaagcaaccaagcaagacaggggaaaacagagagagctctagacagatcaaagtatacaagtaaactggattttttttaaaaaactttctctacctctacctgatctacacgatatatatttctggtgtgtatgcatgatcaactttgcccaatcaaatgaagatatctaactctagtggacaattcaattgttattatgtgaggtagaggcaaagaaggcgccattttctctaattttcttgcaaataatacagaaaccagtccaaaaaatgattaaattgctggatgaagaactgcttttctggagaacagaaaaaaaaacaatgacgaacatgctatagaaaaactggcaagagaagctgtcctctgaaaccttgggtcatcatcaatgaggtcaattctaatgatagcacttaaattttagctgtccaacacactacaagaacaggagatactcgattgtcatataggggctttcccattgtcatactgcaagtctggtgaatgtttatttcaagcattgcacacacttgtctttctcgaatctctactgaaaatattacattctccttatgaatcttgctactcaaaagggctcgaattgatctgaaaaaacacaggttctttatggatggttgtatggcgtcatgcatgttaatattcagaatatgacaggctgaaactaactcggaagaaccccaagaatccccatcggcgacgacttgcagtgagtgcagatccaagaaagaaacacaagaaccccaagaatcacggacctggtggatgggcgggtacatggagttggtgcagacggggcactcgagcagctcgtggacactcgtcgccggcgggacgacaaggcccccaaccaccacccggacccctcctcctcctcctcctcctcctcctcctcctccccccgtgccccctgcccccctccgccgtcgacctagaggggcggacttggacgccgacgtgggaggcggcggtgtgggacgtcgacgggggaagagggataacgcaggggcgctggagaggccggcgacagagctcctaggcagcggccatggcgccgacgtgggtggtggcggcggcagcggctggagtctccgcctctcgcctctcctggggatttgccgatttgggggaatggccgaatggggctccactgggctcacccattttggatccaataatttttaaccaaaaccaaatcggtccaaaccaaaacttttaggtaccaaaccactccagcccatttgtggtggcagcccatttccccccatccggagttgctccaattaaggaaccgaatcgtttggcccatttggccccaaaccattagcaggcttacaggtacgttcttaatttggagctgagatttgtctctcgtgatagtattagcgaaggggatctgatttaatttacggtgtagtacaatcggcgggttttgattgacctgacaaacctgtcaccaccctaagtttaaagaattggaagtttctaaatggaacacaaatttgtcctgacgtacccgctcagtaactgagcaaaaccatcgccagccagaattggtttgccacaagaatagcagaatgcagctaaaaacagggtaaaaaaatactacagaagagtgttttcttaggaacgaaggaaacagggcttaggaaataatcaaatgatgacaagacagtcatcagcacccagctggtttgaattggaagtcaaacggggaatgggtaatgcgttcaaaccgtaccaaactctgtcttcaaaacttcaaccacgtcgttgatggtgaaatggtgaattgaatcaacaccagattccagattacacgggcaacagtttcattacatgaaagaagagaatgaatcaccacgttgaactgacagatattaaccatttttgaacttgcctctccctcatccggggctgttcatgtaacaaatgttaattacagattatgcacagccaagctcacatgtacaacaggggacaacgccgcatcaaaagccaagtcaaaacacaattacagagctcaattgcaaagctatggcaacaagctacaaaaactgtatggcgctggcgcgttttttgccaaaaagaatgatgtctagttatctactctcactgtgttgtactagtatgaatgaacctccccgcttgtttcagatcaccaccaagtcatgcaaagacaggttcagttcttgggcaagttgtgctgattgaccaccccgcctgcaccaacaaaatatgaaaccatcacagaatgtcaggaaagctagctccaacaaatgacgtgggtagcaaaaaaaaaatggtgcacacgaacaactgtcagcaagcttaagaaaacaacagtctgataaaggccgagtttagttccaaattatttcttcaaacttccaacttttccatcatatcgttccaatttcaaccaaacttctaattttggcgtgaactaaacacacccaaagtaaaggataaagcatctcatacagggaggggaggggaaggaaaggaattacataattaaggggtgtagaacttgctgaatcttttgcaaatggttaaaacaccgactgcaacgttgcaacctgtgtacaatacacaccagcgaagtcagcaacagtccagttcatcttgacatagacagagcaataggttataggatgctacaaacgctgcagttttttaaaacaatggttcctaactgaagtgcagggacaggacccacttgtcacctcacatccagtgtctctttgcaatttgcaggttttgcggcgtcctttaaatagcattcccttgaataaggttaatgcacgtacctctgctcagcctgaatatcaactccaactgctgaatgagctgacaatgttgaacgaataactggtccaaagatctttataagatccaacaacaattccaaagaaacaatggcatgcctacaaattgaaattaaaggcaaagtaaccataagacaaagttactactaaaccaaacattttctaatgtaggatgccaatatctccatggttttgtaaagaaaatagatccatgactttgcttgcaatagaatgaacatactaacaagaggatagacaattcaattcaacagcagcatcttgtgtctacatgtgtgcacagagcatgtgcgcttaagttactatgtatcacttggtccagtcagacaagaaccaacatgccaatatatcacctttcagccttgctggtcagtaaccccgcaagaacaggcagaaagcttaagaaaatgtctagactgaagagatcaagtttcctcttcagagtactaacaacatcagcttgaacctgtaaaaaaagagtcaaaccattagcagctaaagaatacgaagtacatgtacatccaagaataacgcacggcatcttgagaaatacttactgcattgtcgggcaactttgccactgcagcaattgctcctttgataccattttggtcaaagacatgccgcatcatctgaagacagttaacattaatatcatatgctgatggagtgatggctatgatatatgcaacttttactagttttcaaatgctttcctcactgactattccccactctccacttgtaggataattagtagatggtgggaaaagtgcatgtcaatgcataatttgcatacaggtgtagatcactctcatcttatatcaggctatcagaaataatggagctgattaattttagggtgttgctggattgatcaacaatcttcactagagctgacttcaccttcaatttagaggtgtgtacacaccaattgtctttaagaaaatgccaataaatcatttaacgcaagtatcaaagaaaaaggtaatgttcaattctaagttgtctaattgtactcaatagactaacaacaataggccattttccctgtactgaatagcctaaagaacacagaagagcttcttttttgggaatacgcaaggagcgcatctttgtattaagaaggaataaatgtatgcataaagcgggccaaaaagacaaagcgaaggggacagggcacaggagaagaaccaagaaacaaaagcctaatctccaactaaattttgcgacccttctctactaacatgagctaccaaagcagggattgcagctctagctagccgccacagctccgcttcacccgtcataacccttacaacctccgcccaagatctgctcttctggttgaagactcgattgtttctttccttccagatcgtccatgcaaccaacgtcgcgatggtgtcgaaaccccggcgatgttccttgaccatcctcttgcgacagtcgcacaaccatgagaggaacgagtgttcattgatcggtaagcactccgaatgcccgatagctctgagcgcaacccaccacagttgccgcgactccgggcatgcgaccaagagatgatcaatcgtctcttcgcattgatcacacagaacacatcgatccgggtgcgacaaaccacgactccggaggcggtatgttgtccaacaacggttaagagctaccaaccaaaggaagtagcgacagcgagggggcgccaaagattgccaaattggcttgtgctggagacgagttcttccaaaaaagagaacacaataagccgagcgggaagagtattctcccgaggtctcccaccgccaagatagagagtccggctcttcggaaagctgcactgaccgaaggcaatcccaaagcttgaaatactctaggatcgcttgaatacccaacgccgaactggatgtcctggatccatcttctatcagtcattgcctcggccaccgtgcgatgattccggagacgagcagggactgcagcatagacagccggtgctagcgacagaagagcttcttcatatgtataatctatcatgcaaaggtatgcaagattggttccctgtttattggatacaaaaggtcaaggaaggaattctatggtgcacatgagctggtaacaaacaggagtctgcaagtaaaagatcagagacaagacacacctctaactttgtcagccgagattttacggcatttataaattcatcatggctctgcatcaaatcgattggaatcattgcttcatcaattgttgacaagtccttctcatatgcctgacttggttctgcctgtccattacaaccattgcaaaatataatgatttgagtaatggaaaaattcgtaaatgctagagagcatgaacaaataaaaatggagcaaaggtaaagtcatatttttctatcccatattctgattttatttctgaaaatactccaatctcccagaagtacttaagtccacaaaacattacattatgatttatgacaatctggtttctaacaatactttatcccttctatttctatctccaaatagcatgtacttcgcagtaaggggaaaaacgaatacagaaatttacattgtataatatgcaagaataagtatgtatgacatgtggttttattccttgacagaatctgctcgttggtggatgagaggacgacggcggtggctaccctagagcagcgatggaagcaccaacccttcacaagagctcggacgtcgtgctatagggtcgaccaacgggcgcggagtccgtttctgcctctctagtcctcacgccgtcaacaacctaggccgacaagagcacgatttttcctgcctcctcaccgtcgccgccagccatctcgtcgtgtgtccccaagtcctactgctgcgcctactcaatgtcctctgctgcgatggtggcgtcgcacctgtcatcatcgttgtcgtgctcaggcatcctacgccttctccaccgcaaaggccaccgtgccgcttgcccacttggttgacctgctctagctcctgttccacacgtccgtcttcactattatcctctcctactgccttgtccttctgcccctatcatgtgcaccctctgtgctaccaaccggcccgccttctcccactgcccctttctgccattgctgccatcgggaaggatactcccctcccaataccatcagtaacttaggacgaggctgctaacttggatagagagggttgcttgttcgtcggcgctagaggggagaaggtggcaacgagcaacaatgaactgaggagctgggcagtgtatcggtaggggtaagaggagggagaagaaagagagatgccactgacatgtgggcaccacatactaactcaggcagtttgatcaggtcaaagagccctgccagcgaaaattgcccccaaatcgaccgagggaagcaaactacaccggttttaatatttaagggtcaagatatatgatataacgttgagggaaacgacttagattggagctatatttgagggagtcaaagtgcacttatttctaacgggaagatgagtacagtgtgttaaaactgaggccgatggttatggcccggatctagtatgggccagaacgggccgttcagcgtagggggtttaacgggaaaaagtatactttaactccctcaactatcgcccgagtatgattcatgtcctccaaccacaaaactgggtatatcaaccactccaactatcaaaaccggtgcaaacaatgtccctcagtggttttggctgacgtggcgcttacgtgtcattcttgaccgaacctttgtcctacgtgctgcttacgtggcattagaataaaaacagaaataaaagaaatatgtgggacccatatatcattcacacaaaaaaagtattgtgggatccaatgacatgtgggacccacatgtcatcctcccactcccttcttcctccccctctatctcccttcttcaattgcatacaccccttgcacctctcccacactcacttgagctttgtgttcatccgcttagtgtgtttgagggttgttctagccaagagtcaagtacattgcttccactgtagagctagtgtggcacttgatcatctccgagccgggtcatcgcttattactcttggaggttgccgtctactagacggcttgtggaggtgttgcccggtgacctctccgaggagattgtggaggaggcccagcgccggtttgtgagtggtttggagttcaccactttcggagtgaaggaagaactacccctagtgatcgaggcttagatagtcctctccttgggccagctcccaccttgcccaccccttgacgaaggaggcgtgcggtggcttcgtggttgagcggtggagttgggctcgcctcaacggggattaggaaaccggcgagtttccgaacctcggtgaaaaactccttgtctcttgtctcatttatttgttgcatttacatttgtgtaatttacattcatagagacatatttgagcacatatcaccctaggattgcaaaacttaacttaggtgtattttactttcctagagatatacttgagccactatcactctaggattgcaaaacataacttagttgctttgttagacttatccctcaccaagcctagcaacttatgttagttttgattaggtgtcatttagttttaaatcgtctattcaccctcctctagtcaacatctcgatcctacacgtgcgctgagggaggagctcccggccgtccccgcgcgggtgaggagctcgctgtcgtctgcgcgcgggggaggagctcgacgccgtccgcgcgcgtaggaggagctcaacaccatcttgccggtgcccatcggcatctcgagcagcgcgtggccgcgcgtgtcgagggcgcgctttagctcacccatgtatcgcggccgccgctgctcccgctccctaccgccgtccccaccgccactgccaccgctaccgcccccgcccgctgccgccgccgctccccaccgccatccccaccaaagagaaatgccgagggaaagagagagataagggagagagagaaagggaggaggaagaagggaaggagagggaggatgacatgtgggtcccacatgtcagtgggtctcacgatactttatttgtgtgagtgacatatgggtcccacatatttctttttattttttgtttttattctaatgtcacataagcgccacgtaggaaaaaggctcggtcaaaaccgccacataggcggcatgtcatccaaaaccacatcagttttaatagtggttggaggacatgaatcatactcggggatagttgagggagttaagtatactttttccgggtttaacatgatgtttcgccttctcggtccagcggcccagtttagaagaacgcgctccgacgggaaaacgagataccccactggggccgtttcgtcttgttctcgctccctcctcgcgccgctagtccggcaaatcgaccgatgtttgcaggcctgcagccgcctagcgttgccggaagagggcatcgcgatgagccatcctccccacctgacccagccccctctcctcgctaccttccctccctccgctggaagcgcgagatatcaaagtcggatttatcctttggccactagctaggtcctagtcctacgatttgggatctgatgcacgccaagcgttcggagctcagccaacaccgtccaaagctctcacgaggaggccccgggagcggcggattgatgaactctccacttctccaggctccaggtacaaaccaacacttttgtggctttctgcttgtacgcattgcctgatgaattctgtcaacacattccacgcgtacatgtctgaaacggcattcatcagactagaagacaatggagatcggatcaactcctgaaatttctaatatattgaagggatgatatttgaacattacaagctcttggcacactaaccaccaccaccacacacttcccacaatggcatgttactttctgaatcacaaaagaaagcaacagaaacagccatacatagcttcaggtagccttagcctaagctcacaatctcacattactcaacctcatagaaacttcaagcttactaccaaaactagtggcctcctcatacttacagaagaggtttatatatctttcgaccacaatcactaagagattcagaacaacatcagactgacaatgctaacaatgccaagcagcagcccaatacttgccttcaacccagcagctccattcaagccccagacgcgcacatcatcgatcactggcccacagagcgagctgtggtcgtcgcttctcgtgttgtaatacacgctgtagaacgccactcgcgtcctctcagctcgtgctgtgaatgtcacattcgcagcctggcttgtggcattacccatgggcgagtagtggaagttctgggcctggtcacctgcgaatgccatgacagccattggtggctggcatgaatcccctgctgagcccaatgtgaatgtcaggctgtactctttctgaggggttgtctcgaccatctgtgagatgatgccttccttccctgatagaagctcaatggcgcgcttcccttggggaatggtgtactggtcagagtcgacaaagcggacagctcgatttgactcaatcatccagccaggcaaggcagacgtctgctcatcgaggttggttgggagaagcaccccaaagctcgtgtttggaaacatccatggaccctcctcaaagtctccattcgacaccacattatctgttgaaagaagacaacaccaagtgatgacttacgaaccatacacatgagaaatgaactagagcacctctagctctcttaagacatcctgtaaggatatacactctactaggtatagagataagcagaactgtcataccctttggtttgtctggagtgaagagcttctttatggcaacgttgtcaaggataggcccacaagtcggatcatcctccataccagggttcctgaactcaaggctcgcctgctcatctgttgcctgaaaagccagtgcatatgcatcccagccttctatgttgtacaatgtctgcaggtccactgtctgtgatgcaccaccgagcacagacacattgagtgactctagctgtgcacacgttcaggcagcactgaacgtgatagcatactctgagcccttctcaacctgcaccacctgccctatacttgcatcgtttccaagacgtacagcatgatcccctgacatgaaaatccaaatattaaacacatcgaatacaaatcaatggtgcaatttgattgatcagaggacagaaggagaaaagctctgtaggataccctgtggaacaataagaatcatgccaccctggtgctggcctgctgagatgagctcgactgtcccattgatcgtccagccagggatcgatgatgcaccctcagcaactgaagcagatttgacaaaaccaccagctggtgctgtctcaaagtcaccattgctgagcaagcctgttgtgcaaagagatcacttgttcatgtaagtgccaaggtcaatttagtaacagatctccgaaagtaacacggctgcaatccaagatcaagaggcagaaaatatgtttctcaagaactctacttaatatctacccatgttatatgcgaaagtgttcccatgcaagtgaagccaagtacatctatgcaagtctgcaatgcaataaaaccataactattttaagttgtgtagctctagcctattgtaggataggacgaaccataaatctgatcccccactgaacctagtacactgtgcgctggactatctttgttatggcatatataaaataatgtacaactcagactgagggtgcgtttagttcacgccaaaattgaaagtttgattgaaattggaacgatgtgatggaaaagttggaagtttgaagaaaaagttgggaactaaaccaggcctcaattgaatggcactatacaactccaatcaaatgcataacagtgacaaaaaaaaacatttcagataaaaacttaaacctttctaatcaaacatgtgtaacaagtgaaatgaaccatcacagtagagtttgaggaagttcatttccaagactggtttttcttataagtgacttcccaagcttgtttttttatggctaccttcccagttgaaagcatggttgcacagataaactgtaccataattaaatctcctgtacaaaaaattaacagctaaaacctctaattcagtactataggagagaaaacatgtccatgtttttctattgtacatccaatgcatttcattggggcactgcgggtaggccactttactgtgcttcaatgtccttacaaggacagccatgtgactatgcacgacgatattatgtggtgaaagtgaaacatccaccaaccctaccctatccaccatcccaccatggagagccccatgcagtggtccagactccagagctgcccatgtccggaggaaatcaccacggcccgtagcgtaattctggggaggttaaggtacgaaaaattaaagagacaggcatggaccctcacggccatccttttaataagccatttgacctttttactggacggttcattgaacacgtttgcaggacactggctcactggtttctgctgctgtgctgttcggcctggatccaagtttactactacgccacatttcattttgactttcatgcaacttcgtccttgcatagaggttcatagtacctcctttggacaagataggaaactgaaactctttcagttacaagcctgaagattttctgaatctttcaagtggttttgttagcagcattctgcacccaacagaatgtctctctcatcatacaggacagctcacttgggggtttttagtcattttcaaacataaaattgcatgattcatagaaaaggaataattttataaagatatatacatgcagactactaaactcgaaggcaagtaaggaataggggggggggggggtattaagcaggtataaatatttttatccaattaatgtacttaaaagaagtggttagtggttacactggtcactgcaaaaaactacagtcgcaggaaagctttggaacaaattgcagtataactgatcagtttttggctgtccagacttcaataacaggacaggtttggataattggtatgaataaatgttatctcaacctccaagggccaaggctccttcctactttctaggacctttactttgcaggtatactgaaccatgctctacaaaaagagaaaaaaaaaagaagggggggactatcacactccttcctcacgagtgcaaccacatctcttgattcctagggcacaaagctaacttcttggcatgctttaccacaccattttcctaggggattatttttctcttctcctacccacccttcaaatttctcctcagtgctatgtatatgtgctaatgaactccgcatttgttatacaaatgtgggatgcggagaggtactaaatcgcatgatttctctatttgctgagatctgtgatgcagaaaactacccatccccacaaactccagccaaatattccacaaatatgtcaaaatactgccttggatcctccagcatcaaaagaacagcagcactactgatcctccagcaagggcaagaaacagaaacgatcgaagagacagcaaagcataccatcctccaccgcagcggccgaggccagatgggagggcgccagcagaagcaggcccaggcacagccccagcaatgcgagcctcctcgccgtatctccctccatctcctcctcctagccgcctcgagctctcgcctcctccttcccccctcgccgaggaagaagaacagtggagagagtgagccgaagtacagtgtgtgtgcagctgaccgagtgagcgagccgagccagccctactcactgggctggaggcagctctctgctcacgccctgctttttatgggactccgatggcgattcccttttcctttggcactttgctggccacccccattattctatttttctcgcaggcctggcctgtggggtctgaaaggaaaggaaggaggagcagtgaccactgaatggtgagaatgccgtcgatggtcaatactctagaggtcaccctgccttttgcttttttttcgcagcgttttggtagcactttttgtcgagcaccaaaaagaggcgccgctgccacttcacggaaacacgactgcagtatagtagaacttgcctgtgtagtgtagttgtgttctgcccccagtagggcagtagtggagcctgacccaaaatctcaagggttcctagagctcctctaattttttgccccatgtaatgatacctccgaatgatttcaattaagcaagttgaatctgtacagcacaggcttgctgtgttcagttcatgtctactccagctccagctgtcatatgtcagctaactactgactatgactacacatttcagcggagcaaattttggatgaaatctgaacagctgtgacgagttggtgttttaattctttaatttactgaagtactactacctagcagtagttcatttaccgaaaatgatatgcccgtcctttgtgttattgtgtatctctgagactctgacagcattgggctgcagagaatgtgtttttcaggaaaagaatgtggctggtaccgtaggagtatgtatttgtgccagttggcagcaggatttgttttctatcttcttttggaagaacttgttgtttttgggtctataacttgtgttaaattgtcattgccctttttgatgttacattaccatggctgtgtttagatccaaagtttggatccaaacttcagtcattttccatcacatcaacatgtcatatacatacaactgctccaatttcaatcaaaatccaaactttggatccaactaaacacagcccatgtgaagctgtcaacatttcatacatgaccatgatgtacaatgatgttccacagacaggccacctcattttttttaatttagaattgttttaattcatttaagtctttgagatttgagaccatgcataaggctagtggcccacaacttctcaaatttcccaacaatataatttctatacgctttaaaaaatcatattaatctatttttcaagtttttttagctaatacttaattaatcatgtgctagcccttgcttcattttacgtgttgggagggaaggggtctgaacacctagctaggttcgaacacaccaagtttgtatcagtgttcacctcttcgatttaatattagattccgaacacggtgatatgattttctttggccaaaatttgataaattttgattaatttcggttgaattttaccacttcaaattcaaattatcaaaaactattcaaaatttcacttataacctactttcatcctgcatcgaaacagcgtagttttcgaccagttttggttgaaaatagcctcggtgatcatttatcctgcttcgcccgtagagcgaacgctgaacttcccctctcagaatattgtccacacgtcgggcgtgggagcggtgaagcacgcacggaagcagccaggccaaggctacgtgacagcaacggggtgccgtgttgccgaggcaggccaccaaagccagtagggccctgatgattagcaacaaaagcgggtgcctgccgtgtgggctgccctgcatccatcggtcggtccatcgccctccgtccccatccccaccgtcaccgaagcgacgcgacgcgacgcgactgctgcttgggatttgattagttgtgttgagagatggccacaccgcaactgctgctacgccgcgccttctcctcctccttcctctcctccccattccgccgcccgccactccaccccgcccgctccttcgttcccccccgcgccgccatggcatcctccgccgcgccgttccacatggtccagatccagcgcgacgacacggtcagtcactctcactccactcacactacgctcgcccaatcagtccccccctccctagggttttgggttttcccgtttcccactgtttttatttaggaaatatatgttcggcccgcttcgttgcggtttagctcccgcttcttgtgattcccccccccccccccattttttagagaatcatccatgcttcttgtggtcgaggaggtgatctttgagacatgaatatattcgtttttagaactcactttgccgctttttccccgccttcccgcattggctttacctttaaccctttctccgctaattagatggcacataatgctattgagtcatgacaaatagttctggctgtcatgaatttggtggatactcggtatgcgttgagattgttgtgtcgttatgtggagtaatacaacgattaatccattcgtttccggttttcttttgcctaatacggaaaccgtttgcatccttttccttgtattaatttctatggtatatacatagaattgatcgaagtattgcagacgcgaacttgctagtacggttttacagtgccaacgatttcacctggactattccagatgtttcagcttatctgtgccttttcatatattcacttgattattctgtccatacagcttacctgaggttgttatttgttggtaagaatgtgcattagccttgtacgaagtaggtacccaatttctctccaaccagaaaattgtaaatgtgggacacttttaaaatttctcctaatctaagatcagttagctacttagctcaatgaactaaattggctggaaagacagcttgctataaatatgtggtgattggtgaaaataaaaaaagatgatgtcactgaggcattagtcaaatttatgtgagttttggaggcatatgccatcacttgatgctctgatgctcccactttcctctaatcaccgagtaagcattacttccttcgatatacaatgcatactgtattaaacttcattactgcagtatgacagcggacataacctactatagtagtaattgtaaataaactaccatctcaaaaaaatgtactttgtaaactagggcatatcacagccataactgaacaaaaagaagtgccaatattttttttcttgatttcttgcaagctaatattaagattctgcaaccttcactctacatcatgagaattgctctttatatcgtaacggtcgcagtgtgacactaagtcaatagtacttgtacatgatactatctttttctctgtagtaaactggtaatgtggtttactcataaattaatctaatgctaatctgcagacttttgatgcctatgttgttggaaaagagaatgctcctggaattgttgttttgcaagagtggtggggggttgactatgagatcaagaatcatgctgtccacatttcccaaattggtgaaggatacagagctctcattccagagtaagatcatatcttgtggttctttattttgcaagaatttcctcatttgtcacaaagttaaaatggcataatcacattttccagagagtttgtgtgctctttttctgttgagtttgatgcaaatcagttcatttgccacaatagagccacctctcctgcttctcccgagaatgaccattgtgggtgacacttcatcgtcttcaacgcatgcgctgactccagccatcatcacgccatgccagctactgttgcatccccccatgctggctccaatgtcgcctttggttaggagctaggagagagggaaggaaggtggaggaacaatatgggaaaggaggcagatggctgggcatgggagctcattctcgggagaagcaagagaggtggctggagcttacacataattgttgtgcatgtcattgtggcacatgagaaaattcccattcaactcttgtaaatttgagcatgccactcaacttctttgcacacagcaaattttcattcttcagcaataattagcatcacgtattcaaaaacaaagttctaggaatggatgcttcataaatcttaatacttagcatttcgtttctcagccaagaaacttgtttaccaacgtgcctttttcttcagtttgtatcgtggtaaggttgctcttgatgtagcggaagctcagcatctgatggaaggtctagactggccgggtgcggtcaaggatattcaggcttcagttaaatggctcaaggcaaatggatcacccaaggtagggctcgtatttgttcttgtttcattgttttctcatgttttctgtactactgaaattatatctccgtccaccatccaaatattttcagatgccatgacatatttacccaactaactcgtaactaattatttctgtttgctgactgaacttcactggtagattaaaaagaactagagagttaaaaatgcagcatttgtatcttgttacgtgcttactttagatagaggtacctcgggcagaaatttcagcaatagcaattgattggtttgagtaacagggagacagaagaagtaagagcattgttgcagtgataagttgtgctgatggagagggaaggagatttcttaactcttactttccataatggcaggtgtatagtctttaaaggaactggccctaacaaatgttatttagagatgacttagtaaccagaagataaacatcgtaactgtcagattcttggttacagaaaataaacctaggtatattccttgatttcctacatatgccttttcatgggaagtaactaatcatggggatagattactcagctgagttggttgcttgccatgtgcctaacttgctgcaccttttaggggtgtacacatgatgtattgacatattatcctaattgatggatgaaacctagcaaaaaaaaaaaattgtctacattctgatgaaaccatgcagaatgtaatgaattgcattatgataacttatattcctccatgtaggttggtgttactggatattgcatgggaggcgctttgtcaattgcaagtggagtttcagtcccagaggttgatgctgttgtggctttctatgggacaccaccttctgagcttgccgatgcttccaaggcccaggctcccatccaggctcattttggggagcttgacagttttgttggatttgcagatgtcacggtaagaccacctctcatatgttttgtctattttgctatgtattgacattatgcttggggcaacttgtttaaatttcacattcatatactagtatcggcattgttgaatagttaccttttttgttcaaggaagggcttgattccatacaatttatctgcctagaatgatgtacattggactagagaatgattagagtctacttatagatgctcaattgagcattttgacctgaaaaatctaatattattaataggggcacttattaatataatgtttcaggcagccaagtcgctggaggagaagctcaagtcatctggcgtgccacatgaagtccacatctaccctggctgctcgcatgcttttatgaacacatcacctgaggccgtcaagaggaggaaggagatgggtctgactgatgagaaccaggcagcaattgacctggcctggtctcgcttctcgacttggatgggtcgtttccttggatcggcgtgagccatttacgcatatatgttgtcaacctgtcaggttgtatgaataaaatcattcaggccagatgcagagtaattaagtatacccaaaccaaataattgtgctgtgttggactatgtgaacatgccatgctttggtttgcgaattatctgtggttttactgtgctttcgagattgcatatatattctgcgttggcctcaatttcttgaatatctgccgcagggagcgggatttgattgtgaaactcggctcaagtagaatccagcgatgaactagggtcgagaacggatcctgccgaaaattcaaagagttcctataaaatttataaggaactttgttagcaaagaatatttttgaaaaaaaaaattcaatttccattcagtttgtgaaccgcacagtcaaaagaaaacaatttacaaggaaagaggctttccttccttaaaagtaaaggaataagttcactttagatctcttatattgagatcgagtttgaatcatgttcttaatcataataacaaatataagtgtctcttgtcttataatactagagtaccaaggtgtgagagcagtattatgcctagttttagctgatttaacgggctaactattgtgcctagtttcagctgacatggcgagctaagttagtatgagacgcatgtggatcttatatgtcatggcctgcacaactcgcaccttaccgtcctcccttgtgatctcttctgttactatttctatacatttgttgttgacattgatctccctcgtactgaagatatatctgacggcaatttatattacacataaattaaataaagttgtttgggtttgcagatactatataattattgcgtcaaagcggaatggacaaacatctgttcctactgaaacatgtaactccacgctctaattactaacagtggaacaggaattggcaaaattaaccaaaagtaagaggtattctggtgtcagtttgtagtaagataataaagcaaaagaaggaacaggtggcagtgaagttaccgtaacacatggttgggacctgcagattttgtcacgctcattaccgcaccgcatgattagaaacaaagagggcaattcgtgtccaaactgcttactccacaaggccacctaattaattcccaacgcttcccgtgtctatgataccatcacttcttgcatcgatcgtgcatagccaagttccccgttctaaactccaacaacatctagatttttcctcgatttctgtttgcacgttttttaaactgctaaatggtatatttcatgtgaaaactttctatataaaagttactataaaaatcaaataaatccattttcaatttttaataattaaaactttattaaccatatgctaatgatttatctcttgttacgtgcacacttaattttcatcctataatcagattcgaacggggccttaatttgcatgcctcccctcatgttctatcaggaaaattgtaaaattcaagcaggctggaaagaggcaggatgaaggaatgcaagggaacagctagctccaaaacatagtggaactggaaggtgtgattgctttcatagaaaaatcgggaaaaaaaagtggaatggaaggtggcgtgcagtgtgctgaagagtgatgcgcttttaaatagtcaaactaatacgtcgtcgatcaaccccacgacacgtggaactgcttgccaactaggtgggcccgtggtatggcttcaagagctacactcgcaagttctccattcacgctgatgattgggacccacgtggacatgtcagcgcatacctatgcaaacgcacgtcgtttagaatctcgtggtgtatatttccgcttatgtagagcggattttaggttttttcatcgaagtttattttttagcctttgcttttagatcgctaaaatcatctatataaaagttttatttataaattacttttcgtttgtaaatatgtcgtttggcttattctacgaataagcgaaacaatagggctgttggttaatgaagccaagccttacattttttttattatgttattttcgattgaccaaatattccaacaattttccatttcttattatttcggtcagcatgcctatcaccattacagtgtacttgtcaaacgtaataggagcgaaggactagctagaaacggaaacagatctcttgactttatgcagattgcagttgtgccantgacatgtaggccatataaaagnggggtnganatatnagtggnacaactgcaaactacacaacgttagggatgtaaaatcaaaggtatttttgattattattctgtgatgaataattgggcattggagattattagttttgttatttggaatttattcacgaagtggttttggagatgattggagttcacaggtgaatctacaggaaatcgctgttatttcatgtgaccggtcagaccgggcaggtgttgccggtcagactggcggtgatcgagcagtcggaccggctagcccacggtctgaccggccgactctgtgtcggtttcggtttcgggttgtttgtttggatatccgtgattatttcatgattatggcttctagatggatactatacgtatgtaatactgttgtttgctactaatgagtcaagttggagatagcttggtctcggaatatggtttctttgtttatttcatgtgtaggtgactcgatgcctcgggagagtatttgcggtgatggaccgggagtcggcttggggataagacgacgtctgtggtggtcagagatcatgcgggatacttaggctagagttgatgcacgtggttgatagagattccatatggcatacgatggagttattgtgtgcgtatgggatgcggagtcgaatttggaaggagtccaaacttggtacgattggttatgtaaagtttctttcttatactagagggtttcctaaggtgtttaggactcgtagtatgggtttggttcgtgcctttaggctgcctacctcaggatataaatagagggggagcgtgaggcttcccggtatcacttttgtatcgcttttgagagtatttgagttgagttttgagttagggttttgagtttagtcgaaatttttgtaaggagtgcagttggtgcactttgtaaacacagagagaatcaataaagtcgtcatccactttaagagttcttcgatttgtgtttcaccgggtctcagcggtctaaccggcgatataccggtggtcagaccggcggcacgcggcggtcagaccgatggcatacgggtggtcagaccagcggcggcggcaacaggcgcggcaggaattccagggcggtcaaaccgggagatctacaccggtcagaccggcggctacgcttcggtcagaccggctaatctactctggtcagaccgatctccatcgatttcgagagtaacttttatttcagctaaaagtttttggtttttgggtataccaaccattcaccccctttggttagcttagttcttgctattcgattctacaggggagtctcatccgccaggaacatatctagaaaagcacaacataatgacagcagaagggccttaaaagagaatgtgttcagcatcctcaggcataccacaaagtttacatatgtgattccccctcttcagtttatcttgacctattgtacaacagactggactctatcataccaagctaggaagtgtttaattttaaatgtttggggcttccaaacatcccgtatcatcatcagctattccctagaaagtcagacatatataaggtcttattcgataaattctcaaaagagaggaattgaaggggattgagggataattctaaaccacaataggtattgaattaatccccttcaaatcatcttcaattctcttgtaaaaggattaaccgaacaagatctaaagtggtttggttgaataagattttactttttgttaaagtctagcagagctatctctaccaggataggccttagcacctctcaagtgtacctcacctacaaggatcttatgttcattacttatttggaggagtttacaacagaggaatttgataggacaaatatctctccagataccatgcctaaaaagaatgtactcccccattccccacaaacaactgtaattctcgccaaagccactctttcatagcatgtaatcctttctgaaactgagaaactctaccattacctgtctaaagaaaaaacctctctctaacatatactctatgcttactatctctaagcaagagctggaatcctaaagcttcaagagtttcattgtccattgtccatttagcttggtgaaaaatattcattttgctggacgctactaaacccaaatctccatatataatcttttggtctagccaaagcagaccatttcaccaaccggcacattatatcatctttaacaccagtccaaaaattcacgatttcttgatgccttccaatattgcacccctctggtaatatactataccctgcttaatttcgttgactattccgatggcacacggttttgctagcaatctgggctgttctttcctagctgctggttttgtctggcaacatgagtgtacactattatatagtgtgacaattacctcaattcttcctatatatatatagaggaacacctattgattggactatcttaaacacacaatgtagtatgtcagtgcttgttggaagactggagagaagcaaagtggcaaagtggcattgtatggtcgctacctaccatgactaattattcagttatgttttctcttagaaaagatacaaagaaaaataagtccttacaccaactatttctccgccttcaataagcttggagctttttttttttattggaataagcttggacctttggtattatttgcaaatgaatgtggaacaaatacacatccatccatttaattcgccttctgtttgtcggaagagtcaatagagataaaagccatatgatttagtgcattttcatcttaaaagaaaatatgcatatgaagttaaattaggagttcttaacccattgatcattttctaagaaatggtatgctttttccccaaaaaggctatttgcagcataggtacgacaaatcaactataattttcacaaaattttagctggatacatgagattttatatgtgtaagttgaagctggaaaaacaaatttcactgtacaatttaatttttttatttcagatttcttctccgaggaatctattactttctctcaatatcaagtttagacttggttatttttagataagcatgatcttaattattttctgtgttaaaaagatgataaaaaaaatctcacaaacctaggccttgtgagccagcttgggcatatggatgaaatagcgaggttctgaacttctgatcatattgtttttcatgcaggcacccagatgtgattcgctgatgcaatgcaacctccattcagccagtcgagatcagttagaaccacgaagcaagacacgaagcaagtagatgcattgttcaccacgggcgcgttgcgctgaagatatcaaaaggcacggtacatggagaacgctgcttgctcagcatgtcatgcagcacattacctctatattcccctgactagccgatgagaaaatgaggccctccaactcccgacgcctctcatgcctagcttgagatatctatgccacattgccagagatgcagattgttgagttgcaagtgtaggactggcatttgcgaacatcttgaactggcacttgtgtaggactgactaccatatcccaaacagctgtatatgtatcttcagctgcttcttgtaatggtcttgctagcaatcacctccgtcctccggttgttggttgcaatgaaatactcctatttggaaaccatgatcgcactaatttattacaactaaagggtggccatttaagattttgtacatggagatatggaggtatgaggcgaattttgtcgatatagttaaaagaccctgaatagcattcacacacggttcagaaccttcatgaatgattgtttgattttgtgtatgtatgtgatatgccgtcataaaaaaaaattacgtgcatcatatctttttaaggatgtgcctatccatcagttgacaagcacgggtcactgacaaaatcgcaagggtagatattcaagtggttttgccccgaaaagaaaaggaccctttaatttgggctatttttaataggaaattagataaaatatataacactcaccctttcgagataataggctcctatctgttggaaataggactgcaacttctgcagtcctcaagctcacataaacaagatgaatacacaaactaataaactggtattatgttctcgcataggagtatgtctcatgatcttacaaattaaagcactaacctatttacatgggacatcaagtcattttaatcaatacgctaattaaacaactgacccagtactaccgacttaacaccacatggacagtgaagatctacggcatggtgtcctcccctgttcacacctctcagcttgtgagcttgtcacaaaattaagatttgacgactggctatgctcaataccctttgattacttactcccgagatatatacaaatgtgcatcttgccttaccattttattagctaaattaaatggctgaaaatgttatttgattaataagtaaattatttctggttaaatggaaccaacgagaagtttagccagaaagaaataatgatgtaaaattatcattgaccgtaagatggccggcacgatttttggccggcttaggaagtggtgggccacattattattttttaagcccgccatttatgttttatttatttccaaaaattcatttatgaactttcttagccatttaaaattgctggaaaattatggtcaattatttgaacacttagaaaattatttctagttaaatggaaccaacgggaagtttagctagaaagaaattaatgatatgatattatatttgaccaacgttaatatgatttcatgtcaatatttattaagattattatttctttaagccatttaatttatttctagttgaatgggaattcaactagaaagtatattatgatttcatgtcaacatcactatgatggtcatttccttattaacttaattatttatagtcgaatggaaccaacgagaaattcgattagaaagcattaagatgtgaagttatatttaacccacgttattataattgcatgtcaattataattttgttcctttcttatttctacccaatggtgatataattaaggaattaattttaagattattcataattatttatgaccaatggtgctttgactatgaaattctaagtttattttgcatatgattgattaagccatggtaaactaattatatgcaattatcaatgcttattatcagttgcaatactgagtaaattatttctagattaatggaaccaacgggaagtttatctagaaagaaaggtgatttcattaagattgttatttccttaattatttctgcccaatggtgatgtaattaaggaaaaaatctaaatatcgtcaatcattattttcttcgtcattttagccttaatggtgatatgacttagaatcttatttatgccattagtgctttatttcctttatcacttttaccttacagtgatgtgatcaaggatctctaattcgtcactaagcttaattcctttaccatttctgcccaagggtgatatggctaaggattttaatttcgtgtcatttactaatggcattatgccctatatcatatctacctacttatggtaatttgatttaggattttaatttcagtaattcatgataacattattcctctaaattctctgtcatttcataatcttttctaccctatggtgtttgattatgaaaatttgagttttatttgtatgtgattaattaagtcaacggaaattaattgcatgcattactaatgtttaattaataattaattttctcagcattaggacagcttaaggctattcagcttcttgatggatcaaattacgttgagtggagaaataatgtgtttattaacttagccataagagaggatccgcccgaggaacctcaaccggctgaagaactcaatataattggggaagaatatgataatctcatgtgggcctacaataagaagttagccaactgggagaagtccaatagaatgtgcttaatttatgtcaggggtgccatctctccagaagttattggagaaatcattgactctaatgacattaagacgtatctggcaaacattgaagaaagttttgaatttgcacctgagactcatgccaatacgcttgtaagtgagatgatcactagtcattatgatggcaaaagtggtataaggaagcacatccttgagatgactcatatggaaaatcaactcagatccatggatatggaaatatctgatggatttttagtgcacctcatcatgagatctctaggtcttaactatgatccattcaaaataaattataatacccagaaagagaagtggaccatacaagaactgatctcacactcagtggaagaggaagagcgccaaagggctgaaaagcagaagataaaagaccagctcaacctcactaatgcctttgataaaggcaagaaggtctatcaaggggaatcctctaataagaatagcgagccagagggcaagtagaagtaaggcgagccgcaagctcagagtaactgatggagtgaagggttgttggagacctcacacttagtttctccaacagttgcaataatatcttatttgttcaccccattaagagaaaccttattaattatttaaagtcatgtgagaaacgggtcatgtccgttatttttccaaacagaacatgttatattaagcgtgataataaagtgattggtcttgcccttgtgcacgacaatcatatttgttctttggatgactatgtgactattataataattgcatgtaatgacaaaagatgagacgtcattgaaattgtgacattgtaattgatgtcacatttctaggggaggttggaacgtctcataagttggagagattctttcccttggattgattttaattacgttatttaagctttaagggaaaaattcacgaagttaagaaattagtcaacaagcgaatacttttggttatgtttaccccataaggctatgtttactcataagagacctccgatttcctttaagaaatttaagatactaatgctaaaatcaaatgaagttatgagatcgaattatggtggtaaacactaaataaagcttgttcaccttataagacattaaaaataagcgttcatccaaatggtttttgaaccatgtaagaataaattgagattgatgaacaaaacaaagaatttagtagaagtttctaaatgagtcaaaatagtaggccatttaagtgggttaataaaattttggctgactctaatggaaatttcgaacaattcaagtgaggtgaacaacttcatgaaaattaatggtgggaatttcattcaccggtactctatactaatgacattttattgtcaagcaatgcatattgctgatagaaactaaagaaaatttttcatgaaaatttttttggtctaaaggagtactgggcttatatcagtaagttataaattaaataaataatttgagagaattgagttaaagttagtcaagctgaaattaaattataaagataataatttatgattcagctgacagttagctcaaatctggatgcatacagatttggcatacatttcttactaggaatcttgacagtatttaaatccagactagaccactggtattaagaatgctttgtattatttgcaaggcaactttaagtaacatgctcatatttctaaaagtctatttgtcggtgaaatgggtccgggggtacgcatcgtgaggggaggcggcttccccgtccggcacgtggctgtacggccggccccttccctgcctcccccgggggggggggaggtcagggggttggaggcccgccgagggaccctcggggggccacgtcaccctcccctcgggcccgtaagggccacgtcacacccctcaggcccgtcgagcgagccaccccaaggagggtcacccgaccgctgcgtggccggatgagccacgaagcaagaggcgccttgagggccttaattgcgcggcgccccaaccgtcccgcgccgcattaaatgagacgtggggggagggggggacgtgcggcgccgcacgattgacgcccgtcaatcagccctgaccagtcggtcggtggctgattggatgggcggcggtgcccccacgccccgtcctgtgttaggcggagtgggggcaggtatgacccgtcccatcagaccagggtcgagtgcgcccccctgcaaaagggcgcatccaccgaagtctctcggcatttaagagggaatggcagggatgtcccctacgacggactgaggacggcgctgggccccgcctaagaatgggcgaatgccttgcgtccggttgaaggcacggttggcagttagatccaggttaagtgggccgccttccggagaaggagtagataggggcgctgcatgtggtatccccttaaactataaaaggaggacctcgccatggggaaagagagagaaaaaaagaagagggtgcttgtaacgtccagagataatcccaaacataggagtagggcattacgtcttttagcggcccaaacctttataatccctagtttccagtttttcctcgggctaaaggaagcggctcccgatcctcgcgcccttctccccggccgaactcacaaaggggggtctcacgatcacccgctagagaggagctctcctcgacactatttgatctcaaaattttagagacatttggacacttattttgtgagatgtgtggatatttataaagattattaagctaatttagattaagctatatccacacataggggagcaataaccatggaaaagctccaaaataatctcttactgcatagtcgacgatgcaattagatttttaaagcatgttatgattaatcatatatttaagaatttttcccagaactaagagtggtaaatagcgctcataaaccactcaaaaggtgtaaaccacccaaaattatactgtgctataagttgtgcactaattaaacactgttttctattctagtagcagcatgttgtgtgttttcttcctaacacattgatatggttgtgaaagacatgtcccaggatcaaattattaagctaagcatttgctcatggatccatactctaaaggctcataaaattaataaacatttgctcatggatccatactctaaaggctcataaaattaagattaattaagattacgttctggccagtacatatgtaaattagagccttactaagatcctggatgagggggacttaatttttcaatcaacacccactaagttaagcttgagtttatttgagtactatagtgagctattgttaacgaccaaatttggtaatatgagtatcggagatgaagatcaaacagaagcggaatctaagacaagaatcgttacgaaaacagagcaagaatcggctaagtccgaattggttgcgaccttaatcggcagagttcgagtcggacaaggttaaccgattgagccgattttgacaatacgactcggtatacgttatcgggtcgagttgaagtgcttcatatggattgccatacacggattgagtcctaaggaggcaattttatctattaattaggatattttatgtaaattccttagagataagtttgggcaaaagtctgccgcaaagacttatggtatcttagagtttgttagagataagagtcgtgtccgacaaggacatattttgtaatctcgggtataaatagaccccgagccccatgtaataagataactcacgttcaacaacaatttcagcgcatcgccacccttttacgttcgttttgtttcgatgagttcttgctttcgggttgagctggatcagtttcgatcttcaactagaggtaaaacttgttatggcggcttgcgttctcaggattagtgcttccatttttatgatactctaattttgttcatgtaagttgtcgagttatcatatatcttatataatctctgacaatatcgctgtctaaccttcaatcggctaatatctatcattagtgggtagccgattaggttaaatattgacgttggcttagattatataggatatctaccattccataaagcttccaatagcttgattgtctacatattgtctttcttttcatacttatggctgcatcagttgagtttggtctcataagtcgtgtttagaactatagtctctagcctgcttcttggttgttgagtagagtagcatcggagtttcagccaatcttacctgatttagctttatgtcttatgtgctcaattgttatgctagatctgccctttgtgttaagatcctattgcatttaggtgtattaagctctctgtttgatatattttacttgctttaatatcttaatatagagtggtgtcggagtattagccggtgcacgctagatctatctgatcggctatgctgtgaacatctataatctcatcgttaatatatattttgatctaagtgatttatactgtctcggcatggcgaccgatccatcccaatcacttgatttaagtatatatcgacataaagattatgtgctgttaacatctacagccgatcgagtagatttagtttcaattcacttatttacaactgccgatcgattcacatatgacatcggctcaaagataaatgatatgtcatcggtggctggccgatcggctatcatttatggatttaactacagtttctttgtctctatttcttgttgattgcaggatcaaatcaactggcacgctcatgaacctaaaaggcaagattttggacctgcactggagttaagcagatctcccaggcctcgtgtttttcgcatcaacacacttttggcatgcccagtgggaccacgagtgttaacgacttcttcccgttggcccaaaaactaccaccgtcaccagggacaggagtcaaacctcccgttgctaaaacaggagctgcaaatccatcaactaaagtgaatcccagcaacatagttccagtcacattggataagctgacagctgaacaaaggggtgagcttgagcaaatgatgagcagcatgaaggatcaattcatgaattcttttcaagaaacccgcagaggcacaatcgtccataagtacaagctgaaggtagttgcagccgatgaggttggctcaagctcttctccaggtcatgcaggtaccgtggctggctcaggcgacaaaggtgatgttcctaaagatggtgcagttgaagatcttggtgaagatggcgaccaagagcgtttacagtttaataactttcaagactggatcgactatgccgtgcaacatgctctgatcaaccaatctggagtgctagttaatactttgacaaacatggtgaagtctgtggtcgatggcacgatagctgagcatcaaactacagggccagtttatttaccaggaggtgttttcccgaactatcggccttcgatcacaggaaatcaacagggtgtttctagtgtaccaccaatccagccgatggcaccagtttcaactactgcaccagctgcgtcatcatcggcacaaagacaggtggtcaatcctagattgttgaccagagaacaaccacaacatgctgggcgaaatgccaatcggctgactcaggaacaggttgctgcaatgtttctaccaaatccacaaacagctgacccagtacagtcaatgctgaatcagcaaacgccgccaagacagcaaacggttcagccgattcaacagcaaaacttgcaacatgtatcggctaggttgagaacacctgataatcggctaaggcagcatgctgcaaatcaattggttcctgagcacttggtccataatgtacaggccgatcagtcagcaatacctcaagttgttcctgaacatttggtgcgtaacattcagccaaatttcaagaattatcaaggaggtaatttaaattatcaatataagccttcgtcaccttatgttcagtaccagcaaacaggatcgcctcaaccccaatttgctcctcagtttaatcagttcgagccgatgtagcaacaaacgcaaggagtacctcagcagaggccatgggctgatatgattgtagatgtgatgagggagcagtttgggctcaaaccaaaggacactggaaacttgtatcggcatccttaccctgaatggtttgaaagggtttcattgcctagccgatacaaagtgccggacttctcaaaattcttaggacaagacaatgtttcaacttatgaacatgttagccgattcttggctcaatgtggtgaggcatcggctgttgacgccttgagggttaggttgtttcttttgtctttgtctggatcggcattcacgtcgttttcttctctgccatataattctgtcaatagttgggccgatctggaaaaacagtttcatagctatttctacagtggagtgcaagagatgaaactgtccgatttgacaacaatcaagcaaagacatgatgagtctgtgcaagattacatccagaggcttagggagatgaggaataggtgttacagcttgtctttgacagattcccagctagccgatctggcttttcaagggttgatagcaccaatcaaggagaagttttcatctcaggacattgaaagcctatcacatcttgcacagaaggtgaccttacatgagcaaaggtttgctgaagctaaaaagaatttcaagaagatcaatcatgtatatccctatatgtatgattctgaagagcatgatgattccgaagtagcggcaaccgaatgggtcaggagcaagaaagtcataccatgccaatgggtgaggagctctaggaaaagaggagatgtttgactttgatattactaatgtgtaacatcctgaaaattctcaacaataaaaatcactaaaattttgaactttttaaaacttttgcatcatgctggttgttatgattcctattgcttgccaaaccataaatgatcaccaagaaagtaaagaaaagaactacatttaagcaatagatataatttacgagaatatatttaatcttacaaataattatgcacaagatattaaaagcaaataaaagaaaagttattataaacctattttatcaaatatgaaaatatttgaataatgtaggtgtgtgccataatatgagtacacatgaaatgatgatccttcaaataaactgagctctctgtatatataatagaattatgggagtatttaattcgatatgtagatcgatattgcaccaagttcctaattgcatttagggattgaaatttaatatattaaacccctctatataaaataaactaacatatagataaattgagctaatgtgctaatgtgttaataacagtctcattaggaaattatagaatctttaataaaacttaaatttggacaatattaatttgaatataaatttcgatgaaataacttagacgcggtgtatttttacattgtgacaaaattagtggcaacagtatatttttcctaattgcaaagtaccctctaaaatcaaaaatagttggctagcactgttcattagcccctaggtgttcgatttggtttctagccatcccagctctctttctccccactgctgcgccaccctagccggcctcgagccccgcccgcaccggcaccatcgctgtcgtgtcaccatcaccgcgccgcgtcgccgtcgcctcactctgccatcaccgccgcgcgccgttttgtcgccattgccgtcggcctaccacgctgctgccgtgcgccaactcgcgccctgcgccgccgcgtcatgtcgcgtcgccgtcgccgcgccgtctccaacccgccgcgtgctgtcgccgtcgccgtcggctgcgccgcgccgagccccgcaccgctcgtgtcaccgtcgccgtcaccagcgccgcgccgagccccgcaccagtcgcgtcgccgtcgccgtcgcatcagtgcctcgcgccctgtgcgccgctgccgcgccatcacgtcgccgtgtgtcgtcgtcaccgccttgagccccgcgcgccatcacgtcgcccttgagccctgcgcgccatcatgtcgccctcgagccccgcgcgccatcatgtcgtcctcgagcccagtgcgccgtccgtcgcgtcgaccattaagccacccttcccacaccctataaataccccccttccatcttccttcctccccacacaccttggctgccatcacaaggcctagccccatctctgcctctttctctttctcacacacatttcatcgaacacctagcgtgcttgcgggatcttcttctctactccacccccgcgacatcgaacttcgtcgttcctccatccctcggtaagtcctcgctcctctggcctcccctagttctgtagaaagtatagtcccctttaatttcgccaattagcaaccgtcgccgtgccggtccggccaccgttctgccgccggtgagctcgccgtggacaagccatcccggagctcctcctctccatctagtgagtaaaatggaacccccacactccgtagatgctcacgccctcgtcaatttggttggaacttagccctagcgccctatccccttgcaacccgagctcggccatggtggccatgctgcgccgctcgacctcactccgccgcgcgtcgccaacggtggagggatgtcgcccgagttccgccgcaccttccctggccaccgccgtgccggcctcgcgccgtcgtggttgcgcccagccgcgccccgcgatgcctccctctctctggcgagaggtagaagacgactcccggctgagtcgctgacaggccgggcctgctcctcctattttcctttagaaaattaatcccgtgaaaaagaaaatcaaagctttgaccccacatgtcagcagctgttagggataaggatatatttcggattaaaaataaatgaattaagaacagtgccttttcacaatttctcggatttattcaaatttgaatctttaaactagcgtaacttgctcattttagctctgattcgagtgaaacatgaatctaaattcatctaaaatcataatctttcaaatggtatataattcactatttaataaaatatatttataattataaaatagttaataccaagaaattagataatagtcaatttaaaaatgtgctaataaataaaattgatattgtactgtaaagtagatgtcaaataattgtctttaacatgctttatcactgtaaaacccatgtaaactaattaaaagcattgtttcaaattaattaaagcataggaaatgctagtgccatttattaatatatgtccatatataattatacccatgacgtccaaaatatataaataatgtttagcctcatattttgtgactaaaatatgaacacgcatggatcagtccttagcttatttgtgaggaataataacagaccaattataaataaaccaccaaaatgaagttgattaatagcatagggaatagcatatagttgatttggttagcatccaattattgcccgaacagtaaatcactcatggatccactttgatcacatatacggtatatcttgtagtaaataataattaatcaataaatgatccaatattaagacattgtgcacacacataatgtacatcccgttatagctatacggtacagtattaatttgcgtgttgcatatattaaattagagggagtttatgacaaacatgtatattggataaatactagttataaattttgacctcatataatccaagttcaattgtaaattaggattattcattgtaaaattatgtgatgggatagtccgtaaccataatatgattaacctaaatatttctaacatacaaagcatgggtaattgttaaccttttataatttattttgacaactaaaatatgtacataattagaataaagcctccatcaataaaataataatacaaatgattcacagtaattatttgaccaatccaaaatccatccggcaacagaacctctactgtataaccgttctatttagatagatgcatatatagccatttgctagactaaaccacatattagccaaatatgtatcccataaatgctatgttggttaactcctaaaaagaccatgatgacaacataaagattaagaaaccttagttcttagcttgattagaatccattagcaaacacgagtagtatgagcaaccctaggttcgaccccaacaactatattttgtttgtacatatttgattgttgtttgaatattggtttttctcgcgtattatagaatttgtatatcggttagtcatgaggcaacatatgctgcttccaggaggtgaaggttgatcaagattgtatcaagaataaggactatcctgagcaggcaagtcatcactattctttgtacatgttgatcccaattgcgaaattgttttgtttactaataaaattgcatgcaatgatgaacatcctacttgtgattatgccatgccttgattattgtttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatattgatgacatgatttgtgaaaggaaaatgaaactaaacaaatgttttcgactggggcggatggaggatttgggtggtatccggaaaaaggctagtgccgtccctggtcaattaaggaccgagccatgaagttaagcatgaaacgacccccgtacaaccgtacttctcgaatgggtatagacctagcggagtagatagctgagcggaggcagtatccatgcatagtggtttcttgatgtgtgaggcaggggctctacggtggggcagccattggtaggaccgcggggcatgtgtctacagtggtgtcgccatcggtaggactgccatgtgagaatctaaacataattataaattaatgcatgtgtgagtcttcccttcccgggtgcgccagaactcctctcactgctagaaaccgtgtacgcctagagtgtatgaggatgtaaagttcatggagcgggtactgccaatgcgaggttatcgaaaagctttgccgtgacgcgtcttatgtgttgggacgaggctcatgtgttgggcagtcgcggagtgcgggtaaagtgtacatccactgcagtgtgagtaaaccaaatctattcgaatagccgtgctcacggttattgagcaccggttcatgtattacacttggctagactctaaattcttaacttgtttgggatgggatattgcatgattatttttatgctgatggagccacttcctgagaggagggaaggtggacgtcctcagaaaaccatgacgactcaatggcgggaagctatccctgggatcacaatggatggtggacagaaccatcgttgtttaatgtgaacactggtactaaaatttgatcagtctatgctaggtcttaggcttgtgaaaagatttgcaaaacttgctttgcgcaaaggaacctgaagccattccttgaaatactctctatcatatgcatcattgctgtggtggattgctgagtacggttgttactcacccttgctatttatatatcttttaggagagtgttgaagagaagcccttgttagtacgcttgcgtacttgacaagatgatcggagtgcggtcttgttctaggtctcgttccccagtcgactgcctgtggcatgttaaccgggcccttgtattattttgtcgtccgctgttgttctctgatagttgttggcctacctggctctaatgtaagtatttaactcttttagcttgaattcattcatgatatgttgtgattcaactatg

SEQ ID NO: 70208 - DNA, 5818 bp, Oryza sativa
gtctcatcattactcaatttactagatggcaaaaacgacgaaattcctaacattattcaacaactctgtggaaaacaactcatcttcaagttcaagctcagtgaacaaaatctgactgaaggcacaccaaactatgttgtcaaaaggacatttgtgcctgattatatgcttgagaagcaatacctcattaataaggctgaagaggtaaagcaggctactactgattttttacaacacaaaatcttgaaaattttatttctgaaatgtttccacattatgattttacaggagttaatggacgacgatgtggataacatactaaaacaagatagagagacagatcaacaggtatttgaacatataatacaaatattcatttatttataatatatagcacatatgacaaatactttattgcctttgaaggaacaaaccagcaggggccctcttattaaaaaacagatccatctcactgctacccgtgaagcaagagctagaggatagtgaccaggaaatcatgagtgaagatgaactcacttcgtcggacaaacctcccagttgcaaacaaataagacggaggacatacataatagaagacgattcagaagaggagagcaacgaaacaagtatgataaaatgtgtagatgcaaaagttcgaggcaaaatgcaaaaggcgctcatgcaaaacccacaaaggcagaaatcagaaatgacaactacagccatgaaataaacaaatcagttgttcaagaatccatcaaggcaggaaaaagacaggcgaaaaccatcaatggcataggcaaggaaagctctgttgagaaacgtaagaaaacatgtgttcaaccagacaatatagcatgcaacacaaggcctcagagaacaaggaaaatgaattctaagtatacagatagtgcttagagctcatgagaatagttcataattagcagtacctcggtagaatatcctgcagttaatgatactagctagaaagaatagctcatagtcaatacagatcattacatgtactatattataatagctgaatattgtatgtgaataaactgagatatattactatgcgatctgttattttatttatgattttttatcacctctatatatacagacctaattttgcaaccgattgcacatgaagcatccaaacatataattcatgcaaatgattagaaaagaaaaatagcgtcaaccaacctttgcctgcctgccaattcccccaggctcgccaccctggccgatccgtgacccaaccaccgcaccacctccaccttacattttgctggatgctgaaatgagacccaaaatagcagattttgttatggccaaattttttggtgaaaaccagctaaaggcgaatactaaaagagttgtggcaacatagtgagtattcgtttgaaaacctgaccttaattttcatataaaagtatttgattagcatttaacaattttcccatcatatacctcgagcagtcggcgcaaaagctctccaccgacgaagctcgccgcccgttggatctagcagcagcatgtggagttggggcaagtgggtgtcggagatctgagagctgcgcaagaactcgcgcatctggctctgcacgtttgccaccgccgtgccatcaagggccgcgccacccccgtcctcttcaactaaccggagatcgcgcacgtgcttccccgctcggcttcggcagcccccaacgacgtgagagccacacggcgctcgcgacggcgatggacgaccccgatccggcggcggtcgcggcagcgcctcgccaaaaagcgactggactcgatagagatagccggatccggcggctacgacatcgccgaccatgccgaagaaaggagcagcggtgaggaggggaatatggaccccatgctgagagagaagtttccctcaggttccacctctccctttcagttacttctcctcatcggatttgacctcacctgatcagatctggccattgaaggaggtgagaagggtgataagaggcagcacaggaagaaacgagagaagaggagaggagaagaaactagagactggctgtgaggattgggatgggcatgggcggctgaaacgagaaaaatcaacatatgtatctaccgtcccctccactttctctttctttttctttttctatttgttgagatgaaatttttgggttgtagcacaaaatttaaatcaataccttcaaagatacatatgttgattaatatataaagatttgtcttactaagtacgataaacaaaagtaagaaattatatattatttatttattatatatattataatttaaaaacatagtcaaatatatattttgaagatcgtgtcattatccaaaacatcaaagatgtgtactacatccaacatattattttcttcacacatgcaaaacaaagcaatttattagcatatagctaattaagtattagttagaaaaacttaaaaaatagatttatattattataaaaataattttacttttaagtaccctgacatgtgaaattagttgaaattaataatttaattctatacagcatttatatatagatggagttaagatatctgtaacactgattttaacggcgttgtcttatctcacacgcaaacatttaatacttttttttcatccacatttaatgctccatgcatgtgtccaaacatttgatgtgacggaagttttagaagtttgaagggaactcaacactgtctgaaatagaagtcataaaatgtaaaaaaaacgtgatacatcgaataatcaaataaaggggtgactaacgaataagagttagcgactgaaatcgcttttaaaacctataaaattgttcggccttttgaagtcccaaaataatgagacagctatttaacaaaatataagaaaactcatatgtaaaagaagataattttatatggacgctagccgcgcaattgcgcgggtcaccctgctagtttgtgtataagttttcgaagttctatatcttgaacattatatagagtggatttcgcaatattttacatatgtaagtttacatatattatttttactttgcattaattctaagcagaatgttgacatcatccataatgataaaaattagcaaatctgcctaacaagcagaatgttgggcataagaacaaagagcattaactagctgtgtcttcacctagaagcaatgtgacaaaaaccaatgcaacgttttcaatgaatagaactaaagggaagaactggtcgtgcactgaacaaattaaaccagacacttagttgaactgaaattaccggtccatagataggcggcgcataaaacctcagagagatgattaatttatgagttgcatgaagatcgaagtcagagatgtacagggaaaatacgaagataaaatagaagcaaactaaaatatattgcattgtcaaatagtcaatccaatatggcataatgaagtacattaggtcatactttataaatccgtaatttacggatgctagggttttggcggcgcccaggcgactggggcgcggcggccatcttctcctttgggagggttctttggatggagttcgtctttgttccaccggcaaagtttggtcctgtgacgtttgattctactgttcgcatctctggagatcatggaaatctctctggtggtcttcagcagtttgagaatcctctctcatctggtggggtgagacctgtcccactatggaagcggtccacgttcttaggtatttctctgttggctatcaagttctgggatgttcatgagacaatcggttccggcaggtttggtcatctacgtaacttcgtctcagttttgtcctttggaaagacgtatgtgtatgaatccaatctagactctggctcctcctataaaaacacacatgtggtttccacaacgatacgtcctttgcaaactctggagattctcctgtcaggttttgatctaggtcctgggcagtgttctctcaatatccatctcatggtgaaatctctcagtgggggcgacaaagggaccatcaatgcgatggttacccgcccgaagctgaaggatgacgccgtattggatctagggaacaaagaggtagaggattccagggctctggtgaaagctgggcaggatctggtggcggcacccccggcagatgatcaagcggtggatgtggtattgcaatctagttcaggcgtcaacttgggtcctgaagcacatatggagggtgcagttttggaggaagaagaagatgcaattgaagtggaacttgacaaggaggaagtcaagcgtgcaggacaatggactatcctagcgagattctagttgctcaaattccccaaccaggtggccttatttgaggacatgggtagagcttggcgactcagagcggagatgagttacaaatctctaaaggacaatcttttcatcgtcacctttaatgctgagggagaccataagtttgttctgcaaggcggcccatggattcacagaggagatgctctgattgtagctgatttcaatggccttttgagtccatcgatggtccccttggagtcagtgccaatttgggtaaggatatatgatctgcccttagtaatgatgaacaaagctagaggtgagctgtatgggagtaaactcggcaaggtcagggaagaggatgtgcagcaagatggcagcaacaagcatgatttcttccgcattcgtgttgatctcccggttaatcgtcccctgaaaagacagattgcaatcaaaatcaagatcaaaggtgttgaggaaatcagaaggttcaatcttcgttatgagagggtgccgcacttctgcttcttttgtggtttcattggtcactcagataaagagtgcgagaaaagattagccaatgaggctcaaccactcatgttctctgctgatctacgctgctctcttcttaaagctttcgaacggaaaatcagcaaggttaaggcaaatcagagtgccggggttcagaggaagcttgtgttcagaggcgcaggtaggctagctcttcttcagcggggaataaacagggagactacttctacactgacccaccaaccagaatcaatgcctacgatggttttgattcaagagaagaggaaggggatgagttagttgatgctcaacttgctgaaaaggtggctcgctgcatatgtctgacagtactttgtcccgtaagaaccaaacaaataagttttcagctggggatgagttagcatcacttccatcattcgagatgatcccggccattaggaacctgggcactcaacaggagtctactgaggacgtgtccaatgaggctactatcagcccaatcaagaggaaagggtctgataatgctcaactgaagataatgggcaaagtgcaacaggctctgttggagtttgatcagagtgaatctcagggaggatcggggcaggggaagacaggggcccctgctcgagcctcgaagcgtttcaaaaaggatgagaaggctgagaacacagcggtggatatggaagcaaccagtctcggggctactggtaaactggcgagacctatggctgggtctcgccaggagcaatgatttgtttagcctgaaactgtcgtggtatgggcaacactgcgacagttcgtgatatgtgctccttagttaaggaagccgatgcccgtttgctctcctgtgtgaaactaggcaaaaggtggaaaaagtgtgtcgtgtgcgtagaagattgggtcttaaaggttttgtgggtgtcagtagtgatgggatgagtggtggtttagcgttgttttggcatgaatctgtttccgtcgat

SEQ ID NO: 70209 - DNA, 703 bp, Oryza sativa
acttctactattagggtaaatattgttatggccaatatttttttaaccattacaaactattttcatgccattgaaaatctataatatttatgccaattgaaatttacaggggggataagatcagattaacattgtgggggcaattggctcgattttttagcgaagatgtaattggcaaccaaacagttgtcattgttacatcaacaacagtgcaagaatatataggtaataacacaaactatggaaatcagattgttctttttatttatataatataaactaactaataaccatgattatataggtttatctctaaggtcaagcagtgccacgagaatatatacaaatctacacatacgtgagacatggacacttattgacaggtatatgttattttaatactgatttttagtaacataatacaaatccttctttgattcaaatatttatgcctcatagacaattctccgaagaaacaataccaaaaatgatggaagtagataagagcacacaaggaacaagggaggagcaaatgttctacaacagaaaaacactcaaggatataacagaaatgcggcatggcaacccaggaagtcaggtaattcctacataaattttatcttaatatacttggcaattatatatatccttaaaaaatttcataaattgcaggaatttgtgtttacatcaaaagttacgattg

SEQ ID NO: 70210 - DNA, 15633 bp, Oryza sativa
caagtaaaaagtacatgaatcggggttgcatcctgaaagaaaaaggaatcgatgatttagttgtccgctccagccggtaggagtagtgtagtacgaagaaaagatgaaataataaagcagaagctgcattctgcgagaaaacgggacagcgagatgtcatccacaaaaaagctttgctaactgccatcttttcttaattagcagagtggaataatgttgattagtttaagcttgagcctcagatggacatcgacatctcatattctcatgctttaatatgtggtaatggcattggtggtagtcatgaagctagaacactcttgcattgtgtggttttttttatgaatatataataaaatacgtacattgaaaactatgtcaaagtcttagaccacgagtaaaaaagaatccagggagcaggaggttcagatggtttgatttgctaaatatatgtagtagtacttcgttgacaataatactcgatcgtataaagggttaaaaggctattttggagaactgagacttactatatactccatccgtttcacaatataagtcattctagtatttcctatattcatattgatactaatgaatctagatatatatatctatttagaatgacttacattatgaaacggaggaagtatatacagctagcactgcatcatgggctcatggcaataaaagagctcgatcacatcgaccaagatacaaaatacacgaaaatctcatacactggaatggttatctggataacaaacttgcatgagttcgatcgatctggccagggtccaatgatcccatcgcattcgctagctagctagctaagcccatgtttatatgaaatccattttaagaagaaggcagcaactaccagctgaaacggtagttaatcaccaaacatgcgtatctacatcatgcatgatgctactatgttagcgaagaatttaatattattattattggtaggaagtagtacgaaggaagaaatggaagctagggagggctccacagagacacaggtggtggatgtggttgcaaacagaaacagaaagtgtcgcgcactgccatggttgatggaactcttgataacttcattctttaaccatatagtataagctactccccctccaaaatataagcatttttagctatgaatctagataactgtgtgttcagattcacagctaaaacttgttatattttgaaacggaggtagtaatatatcttcttttcaatttacactggaatgttatataaatggtcccttcataacttcacataaaaactatcgtgggctcgtcgactctatgtatctgttatggagacccacatcgtttagagctttttatttgaaaaatgcagaattttgttttttaccgaattcagttcgattacttaaagaatgctttaaaaatcctattttacaaaggctctatgagtttctaaaatctatttatttgtacgtgactctaccatacctactatactgagatagtccacaaaactagtaatccaacggttctcgaggaagacaatagcggggaactagttttcaatcggtgccaacggtggctgcggcgttacctctccacataatcccactcctgacggggcaagaaacgatcgggttggcacaacaaggctggagagcgacgacgagtaggcgaggcgagaggatgaggaaggcatcagcggactgacaacatctcctccctttggatctgaatctggattggtggcatctcctctctttggatctagatcggcggctgttgatgaaaaaaatcgaacacaccggcctaggagatctgcttagctcctgtgcaggtccaaaagttgttgagatgagggcgtgccagtcagtttgatcctgcaactgacaagatatgcaaatagtagatcaaacagccgatcggctaacaaaccgatggagtagttccagccgatagtgataatagccgatgccgataccagccgatagcgatagcgtttaagcaatcggctatatgtccaatgtagataataatataaaggcaatcggctgatgatgatgtaataaaataacaatataatccagtataaaccaatcggcaaataatgatatgataaataagtatcgatccgaaagttaaagcacacatcggctggaggtccgatgtcatgaaatgcacaagattagattaaacagtgaaacctttgttgtcatcggctaaattcaacttatatgtatatgcaatccttatgagccgatgcaacgtccagataatttactggctgaaaccccgatgaacccttattggcagtcaaaaagcaggctagagattatggttctaagcacgacttagtagatcaaacttaactgatgcagcactaagtatgaaaagaaacacaatatctagacaatcaagccgatgactgattttcagggtggtagatgcctaagctaatctaatctaacaacgcgatttagccgataccggtagaaaccctaaagcgagaagcaaccgatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctgggccgacggaacattggacttaccccttcgccagagatcgaacatcgatgcagccccgcgtcaggtagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacggaaacaaatttttcttggaacacgaaaaccaattcaacttctaatagaaacaaatatcaacatatataattagctcattttatataaaatgtagtataatttataaatatttttaaaattttaaataatattaataatgtggactagtgttaagagatgaactactattaaaatctaaaaaggtatattgaaggtcatagagttataaagaaatggggtatgtcttgtggcttctgcggatatccgaattattattcgtatccgacggaaaccctgataccatattcgtattcgtatcgagagaaaataccgtattcgtatccgtatccgaactatccgatccgaaaggtatccgtattcgtttttatccggagcggacggaaactatccgctccgttttcatccctagcgtcaggtgccaagtcccgccggacgataaaataaagtagaaaagataaaaggtggcgatgcgccgaattgtattaatcgtgaagatagattacatagaccccgggtgtacatatttgtacccatgggttgatacaagttcttgtccgacaagaaataaactttcctaaagataaaaggcaagataaagtctttataggacactaaacacactttcctaaagataaaaggaaactaacgaactattcctaattaatagataacttgccatgccgcattctctttgaactcggtctcttctggataagctttctttagtatatcaatttccttaactgaatatagcaagaatccgacaactgacgacttgacaattctcatcggctaatctcaggacttcaaagccaatgctgactctaagccaataactattccgggcttaccaaatttcactgttaacagcggcatgcacgatttagatctggagcagtggcgaggtggctcgagcaccgacatagtgacacatgtgagagtcacacatcttcttggaggtgatgttctgacaccctctcggcctcttcctcattagtgcttggtagtgaactcttcggatgaaattctttgttctggatgccaggaattgcaccaatggcattctagatgttgcaaccttctcaaggatattgcattggaagtatcctattggtgtcgcgtctcgtgccagcatccccgtaggttgggtttggtggctatggcgatggcatgatctatatgaatgactgacttatagcttagttgctcttagtattttccgtgttggttcaacgttagttatcgactgtgatgatagcgaaatatgactgacaaggaaacaaatacagaacaaatgagtgtggcggttgccattttctgttgaactctataagagagtcagggagaccttttggaaaactacagaatgaacaaccacattatctctataattgtcatcttgtggtccaatcaatccatgtattttcttcaatattttacaatcttcagtgtttgcacttgaattcatcccatagttatatttttttccttatacattccctttttaatcattgtttcaaatagttgttctttaccacctcttcctaactttcacttgcttgtttttcatgtccacacttcccaactcattaaatagtttgttttttgaaagaaaatgcatatgaaagtttttttaataaatatattgatttatttttaagtttattttaactaataattaattaattatacagtaatccctccatcccattttgatcactctctaaaattgctgaggtattcccaaattgattgtcatctaactggtgtctatccatttacatgtgtaagagtaaatgtgttgcgtttctatccgtttatgtgtgtaggagtaaatgctatagttacatatccgtttgtttatttgtgcatgagtaaattgtattattgcatcctcacgtgcatgtctaacataatattttgatcgataaggtttaatttaagaaagaatgatgttttttttcttgatcacgataacacttatgaatatgatgatgaagaggtgtgtaaaacatagttgaagatgtggaaatgggtggttgtctctccctctcctcctttcttctccaagtcaacagttcctacgctaccaaacccgatcggacgcggacactgacagagccgacgccgacggacaccaaacttcctttcaaatcaagggttttagaaccccaccacccggttaaccttaagaaaaggaaggggccaattccgcccgcctctcccttgtccaaccacacaaaccattggcccctttcaacaacaacaacttaacttcttcaacaacggccttcaattcggcccccggctttttcttccggttccttcttttcgcgctgtgccggttcccggtcaccaccctcgtcgccgccttcttcctcctctcccttttcatgtacggcgaggaagttcgcaccctcgccgagctttccatcgacgactacctttaccccgacgccgatttttacaaagtttccggccttccccctttcctcctccccccggccacctgggaccttttccgcggccgaaggggaattgacaacaccttcctcccggcctacagggagaaggaatgcaccttcctcaccaagcaggtctcctgcctcgccaatggccgccccgacgacctatggcagtactggcgctggcaacccaacaactgctcgctccccacgtacttcccattccttctagttctagatctgccatttcatttcttccaaatggatcgatttgagttgattcgattgcaggttcgacgcgcggcggttcatggagaagatgcgggggaagaggatgatgttcgtgggggactcgctgaatcggaaccagtgggagtcgctggtgtgcctggtgcagcccatcctatccaagggcaggaagaagatcgtcaagcgcggttccttcaacatcttctacgccaaggagtatcgcgccaccctcgagttctactgggctccattcctcgtcgagtccaactccgacaaccccaatttccaccacatcgaccagcgcatcatcagccctgagcggatcgagagccatgccaacaactggaaggacgttgattacctcatcttcaacacctacatctggtggatgaacaacgaagacatcaaagtcaggtctgtacccaccaactttgatgttactacttcatttaaccaatttttagtttagctgggatttctagtgtgtttaaaatttctttcattttttttttatttttgcaggaggccaaattcaacttcttggtcagatcacgacgaggtgccaaggatcgagacctatggccgtgtgttcaagacttggtcgacctggctggaacagaatgttgatcctgccaggacttcggtgttcttcatgacaatttctcctcttcacaacaggtgatcataaaacttgcatttctgatttctctatctcttacctcctctctacttcctctctagttcaagcaatggcggttcgttacgaacatcaattagttcctccagggcagggcctaggaaaacttaatttggtaccttgaaatctttaatgttgtggaccactgtcggtttgcaataggacaccctacctatccctgataaagtggtttgttactcctaattacgttctgtacaagcaagcttcctcttgttccagtctgcagagcacagccactatgtcattgtccaccagaaaatgaggtcagttggacccgtttgttaggtttgcacgtgataaactaggaacaaatttgcctgactttctggggttttagagtctttcaaattccatagttcactagttggtcttggaataattccacactagttcactagtaggtcttggaataatcactcctgtatccgtatatgcatcagaatgacagaaagtatggtgctatgcacaaactagttacttcggaacataccaatgtctgaaatcagaaggcgtggtgctatgaacttactggattaacgcacctcattcctcaccttttatatatattatttccaaatatttaagaacaagtgaaccaattttaagtactttagtttggaaccactagtattatttcttgttttgtgtgattctcaaaggctctttgttcttttctggtttgttgcttgtgaagcacaaggtgccacaccattccatcacactatgcacgcacccatgtgaaaacaaccctccttttgttgttgtaccagatggtccaccaagaaatttgttgggttcttatattgtatatagacacacatatatatagactgggagtgcacccttggtgattcttttagtgagttttcatggtttcttcaaacaaaaatgcttctgtgcttgtgggtgtgggcaagcaatttaaatttcaaatggaacatttgggataggcacagtatagcctacaagattttgcatgctttagtgattctggcccattttgacaagacaattttcagcaaacataaaacgacgtaatgttcgaaatgttgtacctcaaggaaactgttcaccaatctcagagaaactgcaatgatgtggataactaccatacccacatacacaaatctcactattaaaaaatattgatattggctttgcctgaaagaagagtttctactgttaagaataatgatctgcaaaactaaatgcagtgtaaaaataggcttaatatgcttcttaaataagtctttgtttgatactccctctgtttcatattataagttgctttgacttcttttctagtcaaacttttttaagtttaatcaagtttatagaaaaatgtagcaacatctttaatacaaaataaacatattatcaaaatatatttaatgtttcatttaataaaactaatttggtgttgtaaattttgctaaatttttctacaatttggtcaaacttaaagaagtttgactaagaaaaaatcaaaatgacctataatatgaaacggatggagtacatgtattgggtagccatttttggaaagttgaatttgcaatcttttgagttaggttggtagttggtagatggcaaaaaatttgggggagtgttacttccaacaaaactctgatgcttttgctaggagaatttacatagaaagattagtctatgtcgatgtcacctagaccagccagaaaaaagaagctgtggtagtagattctatataaacagtaacatgaaactctcatgtatgctctttgatgtcaaaatctgatgtttgcagtagtaagatcggtataggtggccgttggttcaacactgatgctgtcatcaccttttgccaatttaatatagacgagccctgcagtgagcttcatagtcgcactctgttcagatccattgctaagacattttaaaaccaccttactgttgaagttagtgctactggaagtctggaactgtggaatatactaaaatataggcatcgtgtgaggtggttgtgagccttgtgcgtcatgacctgtgcaaagcaaagtactatgtgtactactagtatactttgtgaagttagtgtcggtgtcaaataatagtaatatttcatcttcatctgacatcttgaccccaatcctttcaaccatgagacaaagcatacatcatttggtgctttaggctttgattttattccacatcatttgtacagatattgatttgcaaatgatttgagcacagttgcttataaatcaagtcgctttcttgacatgttgggacatttacattctgatgcactcatgtaccggttgaaattaaggatagaatttaaatcaatcgtgtgtttgtgtcagcaaaagacctgctactgtttgttgttgtattgaactaatgatatctgctcttgaattaacattatggtacatgcatttctaatttatttacatcgctgaagcattttttcccctcttgtgatgctatcttaaaaacagcccagcacaatgggggaacccgaacgggatcaaatgcgtaaaggagacacttccagtcctcaactacaccaagccactggatctcaaccatgacatgcggatgtacgacctggtagcaaaagttgctaaaaacatgaagaatgttccagtgtcgttgatcgacatcacaaggatgtcagattacaggaaggatgcccacacatcattgtattccatccgtcagggtaaactgttgacaccggagcagaagggctgacccacagaagtacgctgactgcatccattggtgccttcctggggtaccagacgtctggaaccagatactctacaccaggatcctctccaaatcctcccctccatccacacatccctctctccctccacaatgacaagcagggagcatgatttttttttgccccatcgtatactatataggaaatgtatcattactattcaatttttttggtagtttggtgaagaaaatcaagctagagagagaaaggatggagtgggctgtttactggtggcatgtaaaatcgttcaattgaattgtaaattagttttgagctaaccaattgagcaaacagcactgttgtagacactcggtactctggactgtgaaatcagctggcaatacatatatacaggggggcacagtgattaatctgagatcaatttgttagtattatgtgttgatggcgtgatgcttttgtctgagaagagcagtcggtgtgagattggcccagatggccttccttttgtgtttgggccgtatgtgtgcatacgccaccttaacttccatttattcactcatcgaaataattaatttcacgtcgatcctactcctgagaaaaatatagctccttgagaaatcttttatgtattctgaagttcatgataaatcttgtctcagaaattacccatttcagttaaccgaagaaatcacctacaacgagacgataaatctttgtcttggaatcagctaactcctaacttatcagttgccattagcgaccttagcaaggtaatgtatttttaacccggagagtttaactaactcacaagaaaaaaaaaacagtcaacctcaaaacaagtctctgtataatccaaactatttctcctaatgcattttcgttgctctataagcaacaactcgcagcagcctgcctgcatctctttccagatcatacctacgttcacatgggcttaacagctcagcttcaccttatgcggctgagatttgctctaataagtgttatcagatctaagtgaagtagcagtagtagtgctaaaccaagaagatgaggccaactcccatgttgtacgaatacttaccgctagcatgtatctttgcagtggagcacccttaaatgttggtatttgcaaattgccctctaatggtagttggctagttgaagagcatagcagcgtcgtgctctttttttaaggcatataatcacttacaagccgaaaagtctaagcctaaatacataagcgtttttttcgtttggctttttaaaaactataagtcactttacactaacactattaagtcaaaagctatgtccggaaagttttttttggcttatatgagatagagatataactctaccactaaactaaggatttcaaatctatttgcttataaattatataaactaaaaaaactgacttaaaagtctaaacctaaacaatgagacccttatacatatgcttataagccaaaatttagtttattttacatcatttgcttttaatcgttaaatttatgcatataaaagttttactctcttattttttgcttgctaataagccatacggataagaaagcattggtgaaactatgagccgctaggtgttattaggcacaaatcattttgaaacaaccttttttctatgttcttttattcttaacggatttatagataaatatgcatgattttcgaacccttagacaatgtgactttgaaaaaaactttctatatatgaattttttagaaaaccatttaaacactatttttaactttataatatttaatttgtttgtttgtaaaatttataattaccacaaatcatccatccaatcagccatttagcacaaaagaaatctagcttggacaatatttagttggctacatcaatagtgacggggcaactctaaatattattgatggtagtatatcaccccttaaataaattaaacaatctagcttggacaacatttagttaactatatcaagaggcaccagaacttttgaccctttgaccatgagtttcatattataataactttagatgagaaagttaaggacctgtttagttcccaaacaaaatttctcacgttgtcacttcaaatgtttggacacatgtatggagtattaaatgtagagaaaaaccaattacacagttcaccaggaatttgcgagacaaatctttaaagcctaattgcgccatgattgacaatacggtgctacagtaaacatttgctaatgatggattaattaggtttaattaattcgtctcatagattcctgtgagtctgaaatttgttttgttattagattacgtttaatatttcaaatgtgtgtccgtatatccgatataacatgcatgggtaaattttttttgccaactaaacaaggcctaaaatgtacaaatccctttgagatgcttttaggaaactaataacttgggtgtgaagtagttaagggtgatttatgtcatcaagtaaacctgtgttagtaataaaattgatgggagtagtgggtgagagagtgaatacagggatgatggggggttattaaggaaaaagaggccatatgtttgttgcaaagcaatagagaagccaagcaggcagccactaaattgggttggggtgcctcctcctccctttctttctttcatctgcttcgtcctcagatccgatctctcttctcttgttctggggttggggtctcacgacccgccgcctttttcgtccccgtcgctctagaggggatctcaccgccagccgtctctcgccatggcggcggccaacgcccccatcgccatgcgcgaggcgctcacggtatcctcttctcctcttactcctccccgcgagatctcactcgtaaccaaggcggagctaatggcgcctgactcgtatctcttctcctcgctcgatgcagctcaccagcctggggatcgcgccccagttcgtcaccttcacccacgtcaccatggagtcggagaaatacatctgcgtccgcgagacctccccgcagaacagcgtcgtcatcgtcgacatggccatgcccgcgcagcccctccgcaggcccatcaccgccgactccgccctcatgaaccccaacacccgcatcctcgccctcaaaggttccttcctacctagatctacctgctatctactctttcggatcttcacttatttcctagcgatctactctcctactccctaatctttctactatttgcttaattcaaggagccatagactacctagcacattcattttgccatcctaccatagctggaaaccatactgttattcttaccatttgcttcatcttgttcaattcatcagaaatgtgtatgctaattgtggtttacctctataatttcgcgcacatgtataatttccagtaacaatatgttaaggactgacaaattatttagcttcgtgatctactatcaaaaaattcacgatgaatctcgatcaactgtgcattttacaacttcaagagtacttactccatagtaaaccaacagttttcatattctcatgctgctcattcctagtcacagtttccatgcccttgctagttgctactgactaggagtcgactatcatttcggttttcgcttatatttgtagccatggccacaacatcaacttattctcccataactccataagttaagcttaattttaacctcggattgggcttacatggatatttccacgctgttcttcctaattgaatacatgacgtacagatcatctggtcttgcacttgatgtttataatatatcctctccaggcaattgttcacttgttatactgtttcataccattgtcacgatttgttcatgcttcatgcttttgtatgtctatttttaggttgcttcagattggattcatactggcaataaatttttctaatgtttaccatcaccagtgtttgtctgacattcaacattcaatttaaaatgcctagtttatacattgacatcatggtgtctggctagcttactaattgcttacgtagaagcagaatgatatgtctttacttttgcaactttccagctgtttaacttttttttgttgctggaatttgcagctcaaatacctgggacaacacaggatcacctgcaaatcttcaacattgaggctaaaacaaaaattaagtcccaccagatgcctgagcaggtacaaaatttgaagttttgccaaagtatgcgtaaccactttgtttaaattgtatcctataatcttaatgtattctttgcatattttattttcttttcacaatcacaggttgtgttttggaaatggatcaccccaaagttgttgggtttggtaacacaaacatcagtttatcactggtcaattgagggtattgaactattgatctgaacttttgtccaattattattcgctgctttgcattatttggatcatatccatacaaaccaatgattttttttgcatgtatttgttgtaatacaggagattctgaaccggccaagatgttcgataggacggctaatttggccaacaatcaaattatcaactatcgatgtgatccatctgagaagtggcttgtgcttattggaattgcacctggtgctccagaggtatgtttgttaataagtgccgatataacaggctgcaatggtgtaaagatcaaaatccttttgggcatagtgtaaaagactacatatattttcgaaagttgtaggaaatatgctacacctatgctggagcagttcttaaaagtttattacgtaatgctttgttctatatcatcctaacattgatgtgctctctttttcacccatcagaggccacaactggtgaagggaaatatgcaacttttttctgtggatcagcaacgtagtcaggcacttgaagcccatgcagcatcctttgcatcatttaaggtaatgtccggtactccagttatatttgtgctggttacatattctttgttctactatttgccaaattttccttttatttttcctccacaggtcgtgggcaacgagaacccttcaactctcatctgctttgcctcaaagacaactaatgctgggcagatcacttctaagttgcatgttattgaattgggtgcccagccaggtttgtctctggaaattttcaagatttgttttgtttctattttcaagtttgtagcagagtaagaaataagtagaatgccttttatcaaacacacatttgtcatttagtgtagtcagtgctattctgcaaatggttctatattccaccccattcttctccttgtaggccattaacagtgaataaatgttcatggataaatcattcctctgttcactcgttcttcctatcatttatttcagggaaaccagggttttccaagaagcaagctgatctcttcttccccccagattttcaggatgattttcctgtggccatgcaggtgaatatcttgcactctaaaggaagtataccctgttagataccgcatagatctaatttttttaaattttctgtcaattacagatctctcagaagtatggccttatctatgtaattacgaagcttggccttttatttgtatatgacttggaaacagctgcagcggtctatagaaatagaattagtccagatcctatattcttgacagcagagtcttctgcaagtggtggtttttatgccatcaataggagaggacaggttttacatgccacagttaatgatgcaaccattgtgccttttgtcagcagtcaagtatgttctcctgcccttaaattacttggcttatgtgcttgctattatcgtttttaacacattttgttttatgcagttaaataaccttgaactagctgtaaatcttgccaaaagagctaatcttcctggggcagagaacttggtaagttccattacttctatgcttttgttgtgatgctgttacaattgcaatttacgcttgttacctatgctggttttatcagtggcatatattttcctgcaagatatgatagcgagtttaatgttttatattgcaggttgtgcaaaggtttcaagaattgtttgcacaaacaaaatacaaggaagcagctgagttggctgcagaatctcctcaaggtcttctccgaactcctgatactgttgcaaaatttcaggtgcatttctgctcttgattacagagctattaacacttcttcacctccattttacagctatttttcacattctgtactgttaaaagcttaaaattatgtgaactgatggatgatgcatcatgtttactatgctggccctagattatagagattagtgtgactcttaccatagcaatttcagcaatgcgactactatggtgacttctttataaaatcattgggctttatgaataaaaaaaatgttccttctgttttactgcataatggaaacacctggtaactacttaccgttactttcttgaggttttatttgataaatgcttcaaacatagtgaatgcattactattattattttcatttactttcctgtgttgggactgtacaactaatctttaaggcttaggttcttctgcttgactaagctttttcgtttctgtgctttaaaa

SEQ ID NO: 70211 - DNA, 671 bp, Oryza sativa
atctcccgaatgatttggcgaccaaagaacaagcgaagggactgtcatggttggtatggctgatctagccatccgccagaggtccgcttcccccatcatagccctagctatctccatccaaggtctgctcttctggttgaagacccggttgttcctttccttccagattatccatgctactagtgccgcaattgtgtcgaaccctcggcgatggtctttaatcatccttttgcgactgtcacacaaccagacatgaaaggactgctcattgagaggcagacattcagaatgaccgatagcagtaagagcaatccaccaaagctgccgagactccgggcatgcgaccaggagatgatcaatcgtttcgtcgcattgatcacagagggggcaacgatccgggtgcgacagacctcggcttcgaaggcggtccgccgtccagcatcggttgagggcgaccagccagaggaagtaacggcatcgaggaggggcgaagaactgttacagttaaactcacaagttctaagctagtagagaatggcatgcacttacatgttcagagtagcgagttttgtcttttcctttccttgcttggccatctgttgaagttcaacaagagcttcagtgagaaattcagaggaacaaattaaggaaggaagtgccactgcaagaga

SEQ ID NO: 70212 - DNA, 1065 bp, Oryza sativa
tatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcatcgagggggggagggatggaggtgagcaaggaggagttcttgaggcagttcggtggcgactatggctacccgggcgcgcccaagggcgtcgacgagatgcgcgccgccgagttcaagcggcttgaaggtgcgcctaatctcgaccttgtcgattccctttttgccaaattctgggaggaaaaatggaattctattagtgttttgtgagaacaaaaggatggataggaacttgtggcgttcggtcagatgaccgcgtttcttgctgtaact

SEQ ID NO: 70213 - DNA, 1639 bp, Oryza sativa
gagagagagaatagagagaggggaagaaagtatgacaggtgggtcccatattttttattaaatagaatgctgactggactgccatgcgtacgtcacgtagataaaatccaccgttgattgaaccgagggaggtaattcatctggtttgcatagttgggggtgaagaatatccggttttgtggttcaggaggtaattcgtactttttccggttggagatatgcatgatggttttgaataggaagtaatagtaaactaagggcattatgatgggctggatggaaattctgctgaaatgtttgacgaatacttgctgtctgacgtccgatacaatcacaaatattgaacgcctccactcaatgttagtagtacatgtgttacgcggtgattattttttcttgtgctcaggtgcacctacgggtgatgtatacgcttataacaactttattttaaaactttaaacaacttttttttttctattttacttatcttgtcaataatttgatcgtactattggatttgttacaattaaatctttacaacaagatctcactcaattatattctggttattttttaaaacttattctttaatgttgcgcatagttttactcagttgtttcaataagtatttcttagtgtttcactattccatttataaatgttacacatttttttcacacggtctaaaaaatgttttagcaaattaattattcttgtgaatatattatgtttcacatgactttttttaatgtttcactagttaggactaaacgtttcatgcagtgattgtcgatgttgcagtcagtattatcgaaatgttgcatctctttgaaacacatttaattacatgatgaaacaattttaatataaggggtgaaacaacgctcattttttttatcaaaatataaccatatgagatcttgttgcaaagatttaattataatgattacaatgatataattatatcgtagattggattgataaattattagataaaactatttataacttggtaaataagtatatataccaagaggtagtgagagagagagttgttagagaggcgtccgattttagtgctgtccgacgcgtaggcgtccccgaaatgtttgatcgtcgatgttagggagatatatggatggatcgataacagttgggcaggagaaagaaagcggcggtggtaagctacagtgggttggtactacgtgctcccgtatccgattcagccttattactgtgtttatatatacatacaccaacaaggaaggaagcctcaactgaacaaacatcaacaagaaaggaaggaaaagtgtcaggttgcgatgaagcggcggaaaatccccaaccgacagcgacggagcagcagcttgggcagatttacgtgttatcacggcggcggcgacgacgacaaccgatgcaaccacacgtggtacgacgaggcggcgcgccggcttcccctggacgacatcccggagctcgctgactgcctcggcgaggccggatgctgcttgggcctcgccgaccccgtcaccaacatcatcctcaccaccatcttaatcaccattactacatgtcagattctcgcaagaagtcctacgggtttagtatgtccacacctcattcagaggcctcctcgcct

SEQ ID NO: 70214 - DNA, 118315 bp, Oryza sativa
  unsure (1)..(118315): unsure at all n locations
cacccaaggtgccgccgacagggtagtcatgttgctagcggccaagctcgccgaggccgtgctcgtcaagaatttcgagcaaggtgagtggtccgtcgcggacaagctggccatttcgttgctgctcaccgcactacgcctcttcgtgtccaagtacagccgttttccgtacttcacgaggccgaagtcgacgccgccgccgccttcctccggtggccgcgaaatcaagcccgtcaacctgcagccggtgttcctcgtggaatgctcccaagcgatgctcgcgtcgctgctccgagcgcggccgctctgcggcgagcgactccgagaggcgcgcgccaccgccgagcgcgccctcgccgacgccgaggcggagggcgacgacctcgcggcggtcgacgtcaacctcctcctcgccttcctcgccgccagggacggggacttcgacgacgcgctgcggcggtacaaggcggccgtgcagaaagacccgtcggactcccagccgtacgagctcgccgcggcgctctgcgccatcaacggcgacgccgcggagtcagaggcgtggcggcgagacggcaagcagcacggccgcgctactgtcgctgtcgccgtcgccgagcttgagctgccagccctcctcgacgagctggtggtcgcggcggcgctcggctccgggattctgacgaccctcgacctcgagcgtgggggacgacggcgcctcgtgttggtcgccgcgtggagggaggtggacgcaaggctcgcggcggcggtgctggacgacgacctgacattgccggagcgcgtgcagctccgcctgctccgccgtttgctgcgcggcgagacgcagctattgctggacactgccagccatggactgatgaagaactccacgcgtgagagtgactgaagtttcaggcttgtcttctcgcttattcttacgtttatcagctaaattttaaaattttcattttagatttgattttaggattcttttatcgtattttattttttagccttggattctaaactgccaaaaatatgtatataaaaattttatttataaattatgtttcatttgcaaatacgtcagtttggtttgattggccgttggtgacttggtgccatacttaactgccatctttctagctcaaaattgtttttttttcttttatggctgcagaattgggaacgcgctggacatcttgattcgtgtctacattgttggggaagaggatgggaagttaagacagtgagaaataaaggtggatcagtatgagaatttgatttttagtctcaatttcttttaaattagcggtgggaactgggaagtgatacaagggcaatcataaccctccatttaggatggtgtctatggtattaactacattcacatgtaggacttttaacttatgtgtcactatattaattaagagagagagagagtgaagagagaaagaaactgggtctcatgcaagatacagtttcaacacgagaacatatgcactagacactatcaagttttgcattgggagaaaatagtgtcttcatagtagatgaagaataaatatgattggtaaagaagagagatgatgtatttattaatgacccactttaagaaatcatgggttgtgaagtgtagtttccattgtaatgtcttattgatatgtcaccatagacactgtttatggacactatgggttgagactgccctaagttggtacttcttcaatttgcttgtcgttctccatatgttacaaattaaatcgttgtggcaatttacatcgctaccgtattaataacataacaataatctttttaaggcaagtattaaaatttccagtgatgagtacaaatagtagtatggatgcattgattatgggtaagaaggaaagtatacatctcggaaaatgttttggagtatgagaacgaaaagtactttcaccaaaattttaaatgctagagcgataagaaaattgaaacagaggttgtatggagctaggggtggaaacgaggcgagccgagccaggctcggctcggctcgtggaagctcgcgaaatgccaggctcggcttggctcggctcggctctccaaccgagctgtacattaggctcggctcggctcgtggtctggctcgagccggctcgagctggctcgtgagctttgcaatagcagcagttgtattgccagcagcagttgtgttgctttgcaatgacttggttattcagataataactctcaagtccctacaaagataattaagtatattatatgcagccaacatataacaaattgatgggcttttttggttttcagccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagcccgagctatttgtccagccctatatggagctttgatagaaactatatctttgagaaaacagatgtttgagattggtctagacaacctaaagaggagcggctacatcggttctcctaataagtaaatgacaaagccaaaatttcaattttcaaacttaattttaaaattgattttaagatatttcaacgtagtttctttttcagcattggcttttaagtcgctaagaacacatataaaaagttttacctataaattgatttttcctccattcctaaggacccctaaatcttatgctgtacagatttgggttcaaccgttgtaggcgagttgtctggacatgcatgacttgtttgccgttggatagtttccaagcatgcagcttttgccgactttcaactactggtggataattcattgcaactaataaaagccaattgaaacgcagcacacatgccacacatcacaaaacgcatgcaacccgacggttacagggattgagaaactagttgaatagacagctccagtacagaccataatggtcatcatgaacaaacagcagcaatgaatgacttaaacacccaaatgcaaagggtccgtctgtgaagattagttagtaaattgttcccttccaacaaaaaaagttaataatctacagccataataccaggatggatcatgttatcgtttcagtatcagccatccaacaaacatagcctacagaatcaatgtattcatgagaatatcaacagcgtcagctgcaagtacatctatctataaagcaccataaatagcagcaaactattacaaaactgctaccatacgaaaactatgttagatggcatagtaaataacaagatgttaaacaactccaaagtgaaaaccacgtcaaaacgagtatgaaactgctgcagcagcacgaccaatgagtgagttgggcaggctttgcctcttgccatgcttccaaccaagtgtgctttgcattccatgcacccacagacaggcctcggtgttacagcaacagccaggtgccgcttaatggcaacataatgcaggagacgggagatccatggagaaacacaagtcttgtagatcaagagctctaatcaggatacagtggccactgggcacagatgattcaacgaaattcagttataaacctcagcattgcatgcatttcgcacctaaccttctaaaggatctttttcagccactaaacactttacagccctccccctcctataacaaatacaacctatacccagactgacaaagggaaggggataagaagataactaaaggcaacaaaagttttgcagtacaagaaccttcatgactacattgtgagcatccaaacaatgaaggctattattgtccatttccaacaagccagatcaagacaagaagataatccccataaagaaattgtccttctctggaggaaagcatttatagttgccaacaaaatgcaccatttcatatgtccaaaacaggaggggggactgtattgtgatactgcaaaatagtataaaatactaagtaaatctcagagcatgtacactaataacagtgattgacactaccaaattcttaagcagatgcgctacttgagcaaaacaagaaaacggtatttaactaataacatggcaaggagcagtagtactgacaatctcagcggagaaacgaatgactaatgaatctccccatcttctccaagttcaccatcttcaaggtcatcacgtgtgccatttctgcgggagctatctcgatcctttttgtgtcttttgtgccgattttcactatcagagtccgaagcatgggtatgctgcattaatagcattcataaaatcattacatgttctaactaagtttactcaatcagataaacaaccatgtgatttacaaaactgatttcctgctgaatacaaatatcaaacatgcaagagagatataaggtatagttgattagaaagtcaaaactttgtagattttgacccccaaaaaagtagttagtcaaattacaagtaaatttgcagtaagaaggttataccaaaagattcatcaagatgccaatagattcatattacatagtgctttcaaacaatagggagcactttaacaagattattgctggtacaagggctagagacaagatttctggttgaatacaaatatcatatactttatgcaagagatttacaaggcatagttgatttacaaagtcaaattttgtagattgtgacaaaaaaaagttggtcaaattataagtaaattcataaggtattttttatttatacttatcaaactttacagctttgtttggggggtgggggtggccaaaatacaaagtgcatttctttacctactgaaaaatactgtacaaaggttataccaatagattcatatttcaaagtgctttcacacagtagggatcaattaacaagatttaaggacatcctatgacattgctaataaagtaagcagcccatctaatattattagttcgaaggtggtatatatggcagtgttactttttgcttgaacatcctaaacccaattctcccatttcaccaataaaaattacagtattaaaataccaaattactttttggtagaaagcatgaagtgatggcaatgtcagcttgtaacggttcaccaaaagctgtgacagacatgtttgcagtgtcctacagccactatggcttttacaaacaaaagacgacttaaattttagcacaaacaaaatcatccaccaatgagtccaaataacatcacaagacaaaggcaaagcacagtctttcagttcaataaaagttggtaaacgtatatcagcactaatatttggtgagggtggaaggtactcctcaagggatggtggcaatgtctgctgatatatttagcactaaactggtagtttttattatcctagtaccggggcctgtatgcatgatacagtgccatatcagcaccaaatcgccaatacttagaagcttgatttgcacgaaagcacaaatgttataccttccttgatttcttgcgatcactgctatgtctacgagactttttagagtcatccttctcatccctttcagagctcacatcatctgcagtgtcatggtggtgtctcttatgcttcttttccttgtccttttctcttttcttgtcttttgagccatggctatctgcatcaacagcatcaatatccatctcatctttcctcgaccgatcctttcctttgtccttttctctttctttctccttgtctctttctttttctttgcgttctttctccttcttttctttctctttcctccgttctttctcttcacgttccttctcttttcttgcctgaatagaagatacaaattcaggcgaaaaaaacataagtcaatgctacacctgacaaagaaacagatgctgctgatacaacatacaagtaacgatgtttcaaccatgttatacacattctgacaccttcaagaaatgcaggtaaacaatatatcatatgataaaacagccatcagtacattaccttttcttcctccctcaagcgctctttctcttttaacctttctttcaagtggacaacgcactcttcgaaaagctctctagagtatgtttcgctgtccaatgccctaatgcaaaaaatagtataaaatcattcaaaacccaggtaagacataaataacataaaagtatgacagaaaacagtcaagcaaattcagtcattcaaggaacatgtattttgcaaaggaagctcagttaaaatctgattcaggcaattcagtaattcactgccttgcttgccatgtttgtgaacagatacaaaaaccattatttatagagaactgatttgccatacttactgcattggacacaaattttttttatgtgtgagctataaattgtattgagtaacaatgtaacatacagttagcacaagagaatctaggtcctaaaattctgcaatatgaattaaattatatataaaatggatgtgccacagtactctgattacaacatctcaagacttcaacgcaaacttttcttcgacccatcgttactatggccattcatcacgacaaggcgacccagcactctttatgatctaggcagaagggtgtacacagggtgcgaacgtacacaacaaaagaaagaagagagcaagaaaatgagaaaatatatgggtcaacaatgcgttcagcaagtcaccacattagcttcgtacacttaagtcagcggaagagcctatttaaagcccaccaattctttttcctcagctgccctagcatagtagaggtgcaatacgtactcctccctctcccatacagagtagcccctccttccctcttgtgcaataagctataatgtggtttgtgcagatccatggcaggatggaagcaccaccacgcagggtgagtttccactctcatttccctcactccttgcccacaagatggagccacaaaagttcctggatcacgaggaatggagtccatcttttggaacgcccttgcccacaagatggagtcacaaaagttcctgaatcacgaggaatggagtccatcttttggaacgctggttaagaatgcgggtcgagaacaaatgtttttgggacgacatccacgatgtacattcggaatgagagaagattggagaagacagagcatgacaaggcgtggaatcgaccaatgaactcgagcgatgctctgcttgcacaagagggccagacgttctcctatcactatctctttatgttgtgaactaggccaaatgggctagcgtggctcattaacatgttaaccacttaatcatatctgagaacctctgttctcttctcccacatagcccgcagcttgcgccctccttagccaccaacatcagtgcccccattgcgcgaccacctcttgggcgacaagacaacgcaagcctcggccaacgctatcaccagcccctcgtgcaagtcgattcgagggcatcgactgcacccctgtcaccatccatttctctcttctccacctctcccttcccctcttcagtttgttccccatctaatggctgaggcaacgccatggagacttcatagaccaagcagcgaccaattgacgcccccatccatttctctcttgtccactcccttcccctcttcagtttgttccccatctaatggctgaggcaacgccatggagacttcatagaccaagcagcgaccaattgacgcccgggacgatgatcaggcaacgacccatccacgatctatgatgcgtcacgacgacgtggaatgtgggctcgtcccgcagaccaggtttcttaggccttgccttgtggcttcagcgtcatctaaacgacaccttgaaatacatggatctaccaattctgattgcttccccccacaaaattgcaagattgaacccacgtatcctatttaccaccaggttgaacacaagtatcctatttacggaactaacttccttccagctggcaaagccagtacaccaaccagtttagtataaccaggaggcatggtaaacatttgtcacaatacagtaattttcagaggattgcccttacttgtactcttggctatcttcgaatagtgctttagaatcatcccatgttgaagaagctgatatttcctgcatttttttcaaagaaatatacatcagtacaaaaaagatcaatctcaaaagtgtagtctcgtgactagtctaactgactctatagataatactgaactatttgcccatgctgttgcacctggtgtaaagcaaagtgcattcatgaatgtaggttccacatgcaaccatttctcctaatgtcctccaataaagctttaacaaagtgccaaattcgtatgcctttacgatttgaaatgaatgtctatccatgatttatcaatatgcaacaaaagtaaaacaagatggacttctttattttggccagtttctgtgaccacattgcacacaattagaactatactagataaccttgctgtcacctttagaccaattttactgtacataaagtgggtaaccctaattcaattatcaattcctcaaaccattgcaagtcacagctataggaaatcatcaacaaaattagttctgacctaaaagctttcaagaatcatatttagtgagccataaaagctcatgattcatgcactccaacaacaccagtagtatttatggttccaactcatcaactatttttctatgcaaaaacataaataataccacatctgtgaattataaaagaatgttaccaataactaacaacttagttcaatgagtaccaaagtgcagccacttttccatgatatctttcaactacacacttcgaatttgattaccagttaccaaatacagttcattgccatgctaccaatcatccatataatttttaaaaaggaactacattgtaaattgattttatcagtactatatatgcaacaaaagtataaataaatgaataaaatagaaggcatttatggatcatgtcggcagcccaaaagtcttccaggctgttaaatagttctacactgctatgttaactttgtcctgaaaattgctggactttggataagcataacaggacaattcaatgtaggtaatcagcaatcaataggcatgatgtacaacaaattacagagtgtcataccttgattgagtacaaaagatctgagaaattttcacccagacgctggcgcttctttgcttcctttacctccttttccctgagcctttcaacttgatcatcaaaaataagctgcagcagatccagcaaagataagtaacaatatcgacaaaaattcttatcagtcctacaactgaacatggaaattgttaccgcaagaacagcatcaataatacacatatattatcatcttcatcaaacataatcaaattttcagggtgacaaaacaataataccttcatgtttatgtttgttattcctttcaaagtatcatcctccgtaacagcagtttcgaaatcctctagtgtccatgaagtcgtcataggaatctaaacaaaattaccttgtcagccagatggcaaactaatttctacaggtaaaacttacctatggagcaagcttgtaaaataaaaggtacctttccagacttcactgcttctttaattcgggctttgtcatcttgatactgagataaaaggatggtaggtacataagttcatgcataacaaaaaataacagatattccagaatttaaatggtgattgtgatgagatgaaaatattgtagactcgtgcttttttgtgacatgatggaaataaaatttgttattgtgttttacaaagcatgagaatggatagaattaacatctttcagcaggaccaagatgtaggtttttgccatagttgctggccacctctattcactacagattttacttgccatgataattgcaattccaaattcaggcatagaggcaactatagcacattgatgacttaatacattggataagcaagagtatactacgaattttaaaggccaacctgtttctcaagctcctccattacatcttcaaacagatcttttggcattgaaccacttatgttcgaggccacagccaagtacacagaggaatctttaacctgtaaatcgataattttatgaatcaagaaaaaaaatgttgtcattttaatcgtatttataaaaggtcgatttcaatgacctgggcacagtaatcacgccaacgagtttttgcagtaagcattccttcagctacatgttcttccaacatcttgcgaaattcatcacgatttttgcgctcttgcctccttacttgttcctgacagaattgacttatattaaacatccatagtggttcaagacatcgaacaaaaaaaaaagaagtgaacgttatgtgaccaaaaaaaccttatgtatccgcttgtgctcttcctcttctttctccagatcccttatatactcctggattgcacagaaatgcatagttgaagcacaaaataaagaaagtcactgcagatctaaaaaaatactaacttggaaaatctccagtcgatcgatcttttcaagtcgggaacagcgttcatcatcctcaagacgttcttgaacttttctccactgggtacttgtctgcagcacagaaatatatatgtttctcattgatgaagctgtttgcatactaattgactaaacagttaataggagtagtaatgaaacaacctttatgaattcacatgactcgagaaaagctctatattctgctatgtgccttttgtgctcttcagcagccctggctctttcctataacaggatgatcgtagatacttagatcttgatccatacagtcaagtcatgccagaaaaatctctagttttgttcttagacatactaaaaaaactaagaaattgcagaataagattcccaaaagtgtattctacaaacagataagcccaacaccaattaaaatttaaaaggggaacagaatttctataagacagaaccttcttctgtagttccataagatagctctcaaataagtcttcacgctcccttggacgctcaacagcactaaaccgttcatcatcctcaaacatagttattgctttactgcataacattgaacacgaacaaacataaggcatcctccagcacccccacaaaaagttacaatgtaaacagcaactagaaactaacagtttggtaaacaaaattgcatcgaactatcacaggactgttattatgtatgaatagaagcttgaagtcagtggcgcatacctccatcttgttgatgaagtaagctccttagattcctaaaacacatagcagaaagtaaaatagtcagtatagtcaagacaaatgagtattagtaagggacataacatgagttagatatcttacttctagcatagctaaaaaatcatcacgtgccttccgctgtttgatacgtctttcttctgcttcaagctttttcctctggtttagatactgcaaaaacaaataggcctggcttcagtgaaccactaagtgaagaataaaacaatgcaatagaagacttcaacattccatgtaattgctaagacagattctagctcgtacaacaaagagctaacctcattaaaagcttgcttcctctccccaagagttttgagggcaccataccttttgtcatttatgatgaccctcatagcctagacatattatatcagtgtcaagcaattcattaactgatatcgattcaagtaaagttacatacctgatcccatgtccaatcagactcaacatttgatgattcaagcagagctttgaacgcatttttagcttcctataagtcaaaagaaaagtgtacctatatgagcttaaaacttgaaatgcacagtcaattcttaatatgtgcaagtttcccttaccaacttattagcataggtcacaggttcttcttcactagttttgtcttctactggagtaacattgatcttccctggaactgccatggtctttttggcctcctacagagaatataagcagcataaatgtacaggtatacacatataaacacatacatacagacagacacacaaacacacaaacacgagagtgagatatatcaaatgcaaatgtgtaggcacttagaagagcacaactgtgaccgtcggcatagcccaaccctaagtaggcctaaatttcttctaaggaattaaactcaaattgacatgcttctgtcaccactcactattccctacgtcccaaaatatagctacccttgtagttcactgagggagtaggcaggatgatttccttatcccaactcacgctaaccccagaaaaaatatccaagacttgaaatgaaagaataaagatgtagcaaatgatatttctctatttggagtaaatttcacaaaattacagatatattgaccaagctatcgtaaaactatagatttaatactaaatttatcacaaaactacagatttaaggtggagtattgcaaaactacagatttagtaacaaagttatcacaaaactacaagtttagcgcatatttaatcacaaaacttggacgtttataactcaaacataacattagtattaaggatttaaaccataaaatctttagttttgtgacaattttattattaaacctgtagttttgcgatacttagtcttaaacctgtagttttgtgataaatttattgttaaatctgtagttttgtgatatatatcaccttaaatcaatagttttgcgataatttggacaaagtatctgtagttttgtgaaattttgcatattttcttttcgtattaaacaaagcatacatatccatgtaaggaaaaaaatcagtgtttgcttccatccgaattgagtcacaccttgggatttgtattacagcaattcttgtacaattgtccaccctaacatacgttccaagtaagaagtagcatgtatcatggcaatattgcacaggatggtgataatagatattttcaactgaaaattcaccagtgtgggaataatgctcagactattaagctacttaacatgtagaatatatccaatcaatcctaggaatcacagataaacgatactgttacggcaatacggggatacgaaatttttgaaaaatgtggatacagcaagtatacacatatttcaaagcaggaaaaatatggagatgatatgatattgagattacattgttaaaattacaagcaatggcatgagaaaataagtggtacatttttcttacaatctcatactttattaggttcttaaatgactattgactcccatagaagtatcggtgttaccagagtacaggatttatcagacgtaagttcacagtaattttgaaggaccagaacatatgtttcacattaattttgaagcaccaaaccagcttgagctatcctaggggatctttagtttctttcacgagattacttgttcagataagattttgtttctttcaaatatttgagattaaataagactgttagtgcttctctcatctcttttcatgaggatttggcacagttttgaaatcaatgaaagacaagctaatctatcgcctaactcccattttctctagtgtctactctcccctgcccatcattcaacaacatagctccaggcagaagaggtcataactcaattatcatacacttgcaaatattaagaactcaaactataagtctagaaccctgtgagaggacaccacatgtacctccaattcttcagcagatgctccattttgagtgtcagcagtgctagctagagatgggtattcgttattggctctgaacaaatcatataacaactatattagcaacatttaagtggtgactggtgaggaagcattgagtaaaccatcgacagttacctgctaatccctgcatcacttgcaactgatggaatttctgtgcttataacaggagtaacaacggtacttggaccaccattttgcatggcagtattagatgaactggaggtgttctccatattgtgcgaagggccagcaccaggaggaacagagttcgctgctgcatcaagtgtacttggagcacccataatcgttgtggaggactggttagcaggtacagaagaaggttccacagagtttgaagtgggtccagaaggagcaccagcagttgtttccgtttcttgatcagggcgtggatttgacgccttctctgctaattcacgcgcaatctaaaagggaagaaaaaattgtttatagatatacaacaatattcaataaacaaatataaaatcaaacatcaaagaaggctgggaaacctttaactcatctggaatcgtccatttggattgctttgtcaccttattgtaatagtacctggaatgacagaataataagaaccggcaagaaagtgatttgtttaacttcatacagatgtgatagcatgtgttccatcaagaacttactttcgaccctcttgtgtagtaaattctttccattcagtagaggcatcagctctctgttacatcaaaaaataaataattaagaacacgtaacttttagcatagcaaagatgcagaatcaaagataaagttgaagttgtaatacgctaaacgttccatacatcatttcagtaagaaactaagaacatgcattgtcctctcgtggaaagagtaaagagttcattctggaaatagaagtagtcaatatagtgatgaattccaattcaccccctttagactttcaagatggtccaaattgaataagcccctcaactttaaaatccagtgcagtttacaacctgatggtggaattggtagtagcaataccaatccaaatggtggctatatcagacaagtcagcaaaagcccataagccatgaaaggaagtcattgcacatattcaggaaattcatgtaaaaataaacacaaatctctctttgactattcctcctatatctctcctctttctattagatggattaccaattaatttagcaacttaaacttaacaagaccaagatgccatgtatgtgaccaacatgacagttgcttaggaaaccacaaccgaagagtgtttagtacttcctttcaaagtggagatgagtcagtaagcagttttgtagtgcgtgttaggatatggactattgtaaagtagatggaagtagaacagaccattccataaattttaagagatagacagaacaccctaagggaaatgtaacaagtcatgacatgtttagcatataaaaaattaaggtaaccgaagaatatatctacaaaaaggtaagtgtagatgacacataagcacacagcacaactaacctccaacggtgtcatcaactcagcaggtttctcccaacttgattgccttgtcttcttattatagtagtaccttaaaaaggagagaaatagagaaagcaaccaaataagaataaaggtgaaaacttgcaacacaacaaaagatactgagcaccaccagaaagttaataacaaaaggtaagtaggtaaaatgattcaacttactttttcccatcagctgaagtgtgctcttgccagtctgaagagctagtttcgctggaattgatctgttcatttgcaaactcaattattgcaaggtaaggatgtcatatttgataaagcacagtagtaaacttaatacagaaaaataaactgattcagaagagatcagtgatatttactgaaggcattgtagcggaagatgacatcggctgatgcccaggctgcacaagaggtacattctgacctggagctgtaccccaagattgcactatgggaggaggaacagatgatggttgatactgcagtgtagcctatactagtatcagtaacttatcggcaaggggtggcattcaagatccggcaatagctttgtgaaattaaatacatatatcaaatgaacaaatagaatccacaaagtgcaaggaaaaataggacttgccgtataggatggaggcggtatagggcctcccatggtgggcatatggcctccagagaatgtcgctggcggctgcagaggcccagatgacataggtctagctggctgataagccataggaactgcttgtgatgcaggtggaacttgaccagagtgaggcaagtgctgtgtaggttgctgaaaatgtggcatctgacctggcatgccaatattagctcctggcatggcctgaccaacaggtcgaaactgctgccccggttgcatgaactgaggaggttgttgctgatgaatcaccggcctaaactgaaattagagaacgagatgacatattaggaatgtaaaatatgattaaaatggtccatgctgtggatacaaggggaaaattcaatcttccagtttacctgcataggcatcggaggtcccagattttgtggtgggacactagagcccatcatagggggcctagattgctgcttgagagagagagaaagagagaaagaatggtaaaaaattagcacatcacacgacaaaaatcaaaacttcacactgaaaactgccatccttaaaacaaccagacaacatttacctgcggtggcccagaaggttgcatattacttgccatcaaagcacatcaaaatgtgatgcgaaaaagaggaaacaagtttttcctaatacagtggctgccaagtgacaaggaaaggaagaaaatgacgggttaggacattaaatgcttacggatcgatcctcttccgaagataactgcaatatttaactaaactcaataacaaacttgctctgccagctgcactttggcacagtatttagacacaaataacgctgtgttagtatttagtaaacagggtaacggataccggcttttggatccttcctctccctccctctctcagcgacagaagcgaaagaagagaacttaccgttaccataaaaacaaacatgtcttatatacatagccaatgagctaaaactagatatcagtccagtgacctactagcgggtatagattagacatttgaacacaactggtctcctaaaccacatgccctcatatacatatccatgaaaacagatttcaaattttatctaagcacgacccccccccccaaaaaaaaaaaactaagggaggatcgaattatcagaacaaaaccacgtctcgtgttctgaaaaaaactagggcagggacagatgattccgctaaaccctaaaacaactaccgggagcaaatctatatgatggataagggcgattggtgcctatcaacgagaacagcgaaacgaacagaactagaaaagcagagctagggtttcgttactcttaccgcggggaaggaaatcaatccaggtccggatccgcgccacttccagtagaacggaggacgacgacgacgccgtctcaaccacgggagaagacccacccgagagaagtaaccccccttcgattcggggtggcaggagcgcctcggcggaaggagacctagagggcggagcgggttccggcggcgcggggcgagggcggcaaggagcccggcctcggcgccccccctgcgagattacggttgccgcgcggcggcgcggggcgagagaccagtagcgagaagagagagagagagggagagatgcggcggcgttgtctccacacgccggcggcgagggcggtgtggggtggggttggggttttagggcaaaaagggggtgcgggcgccgagtcgggcaaagggcgggcggggtggggttggggtcccaaaccaacgggttaccgatacacacacccctttcctgtctgggaccgtgggacggcgcggggtatgtatgtgtcaatgtcatgtattgtatcggcgagggagagacgctgcttggcgttggatggataatagcaggcacgcgacgggagttttttgctttgggctttcggagtcgcgttcctcgcctcctagaaggaataagttcactccaggtccctcaatttgtcgccgagtcttgaaattcgcccctgaaccgaaatatcaggtgtacctcatcccaactcacaataccatgtcaattttggtcactcggcagtaaagtagttgtttttagctgacgtgatgagtgggacccaagtgggcttgtcagcagccaactcgtctccctgtccctttcccttttccgtctcttcccatttctcagatactcaagcatcgagcagggtagtcggtgaggagggggtcacatacgatctgtagtggtgaaggggagggacttcctcatcatcatgcgcgccccgactgtgcacggggagtccaccctgatcatgctgagctgcacctatcagagcatggtcaccatggagaccgtccacatgggaggcgacacggggatcgtccctctcatggtggaccccgtgaactacgacgtgttaccgaaggtcgagtaggagctgcaccatgtctaggccacggaggacatggtggtcatgcgcaccgccaccgagcagagcaacttcaagctggttgttgccgtcctcgaaaagcgtcatggcgtgctcaagtcacgcgcggaggagctatacgacaaaccgcggtccgtgacgtaggcagccgagctaagggagatgcaggacagggtggtgatgcgtcaggagatagaggactttggtaggggcttaatgtgtgagaaaagggataggaaaaggtggaggaatgggttcaccttgacgaggtggagttggtggcgcgaggtttggccaacggggctccggtgagggagatcgaccggcggcagcgtggtggccagacatggtagagagagaagacaagagctctaagagtttggttgtgggggaaaatggagacatcgttgtctcttataggcagcgaaaggtggttgcaatggaattcgctgatgaggacacggtagtggcggcttgagatggaagaaagcgacgccggcttcgtcttcctattggttgcccatggtggttcggtttggtgacaaacaacggatgacgtcggcagggtgactcacaactgaggttgggcagcggttagggctgtcaacgagccgagctcgagcgagcttccatgtgtaggctcgaactcactatagactcgagtcgagctcgagccgagtctaggtttgccacgagcttgaagttgagctcgagctcggctcgttcgagcttcgagcttttctcaagcctgtttggtgcggtggaatactggaacaattcattccattcaaagaaaaagctgacactgtgatgcatgattagacggctaaggccctgtttctttcagcttgggattattataatctagattattgagtcagattactataagctagattgttataatctatagtagaataagcggttagttgtttctttcctagattattgggtttgcaagtctaaagagagagtggggtggcatggtgggtaatttttcacccaataatctggaaaaaaactcacctaaatgagcttatcagattataataagctgggctccagattataataagctacttcaataagttgtctgtttctttcagcttactcccaataatctggattataataatcccaagctgaaagaaacagggcctaaaagtaatactagtgctcctatgtatactaatgcaactgtgcaagccgcacactagtactcctactctcttgttgggaaatgggacaacaaatgcatagtgctccctctgccctggcactgccagtacttgtgcagttgtgctactccagtactactagagaatttgaccgagtaagaaagagagagaaggggaggaaatacctaggagaaagaacatgagccagatgttgaggctcgccgagttattcgagctcgtgttggtaggctcgtgagcttaaagtcaagctcgagctcggtttgattcttagacgagccgagctcgaatcgagctcataacaaatcaagctcgagtagctcacgagcctcgagcatttttgacagctctagcagcggttgcttggcggcgacggcaagatggtgatagcagtgcgtgtgccacaggcacccacagggagtttggcagcggtacaaggagcccggccgtgcctacatgcccgtcgccatgagctcccactcatggcagacacccttcatggctaacatgtggggcccacgtcggtgtcactcgccgcgtcagccaaaaccggccattatactgctgggggactaaagttgacacggtattgtgagttgaaggatatacctggtatttaggttttgggacaaatttctgacccgacaacaaattaagggatctaaattgaacttactccctcctagaaagagataatgagaatatatggtgtggactggaccgagattagggtttgagcaggcttaggccctctttgtttaggcttagaccctctttgtttaggcttataagttaacttataagccgaaaaatctaagcctaaacaaacgagcaaccttttcatttggctttttaaaagccataagccactctaacactattaagccaaaagctagattagagaagcttttttggcttatgtgaggtagatgtatggctccgccactaaacttaggacattaatccaccgacttataaatcatataagccaataagctgacttaaaagtctaagcctaaacaaagagggccttataagtcaacttataagcctaaaagtctaagcctaaacaaacaagcagctttttcatttggcttttttaaagccataagccactctaacactatgcaaaaagctaggttggagaagcttttttgacttatgtgaggtagatgtattactccactactaaacttgggacattaaatccatcggcttataaatcatataagccaataagctaacttaaaagtctaagccaataaacctaaacctaaacaaagaaggccttagtgcatgtgctggtgccaacttgccaaatcttaacaggccatctaggatgaatttagatgattaaatgggcttagtatatataaattttatcttactaatgggccatctaatggtgaacaggatggttaaatgggtttagtatatgtgctatgtcctttagcacacttgccatattgtaacgggctatctggtggtgaatgggaatggagcgcactccactgggctcaactgaggatgatcttagcatgctaagcattcccagggtgaaaaataactcgtcaggttctagccctactagactcggggggaggggggcattgtcatcgctaacctcgtagcccgtaagcctttgtgagttcactaggcatccatggaaaaatacttgttggagctgctatggttgtaagtgatgcaaaacatgtgaagtaagtgcaagtgcaagatgttgaatgcagatcagcagtaccacatagagccatgtagcaacaagcttacaatattgtgagtctgctatggtaactgacgcataatgttgtagaattttttttagcaaggctagttgatttataatggagtagcttttgcaccgtagcgaataatatgaacatcaaatgggtaggaggagctcctcctatggcatttgactttttgtcttttgcagtagtgtgttaaatacatcccatttggaacatgttcgtctagccatcatgtcacttcagtgctcccttctaacaaatgagctaggttgatgcaaacctagctagatcaaatgatatattaacacgttgtcaccctttgccaatagtcgcattatatgctaaagtcaataatcatatcagatgtttaaatagttaatattgtggttggaggatatcaaatttatgatcattgtagttgttggttcataatcattctcctaccactacctattgcatatcatgaatgaaggccaaccaccactaactgcaacaaggttagttggagggaaataagaggaagaggcataaatatatagactttgtggtgatgacaaatatcatgaaataactagtacaacgtatagaagtttggttcgaggagaaaaaagaatacaagaataggaatgtaagagcttataagatgagaattgattgagcttaccggaaatttccttattatattattttcaagataggagttatgctaaacatagcaaataaagggtcaagttagagtctggtggtttctcggtcaataacttaaatatagtatcaaatacaccttaaataccctaataaagcatatcaaaacaataagcacacccattaaaggtagctctctctctctctatctatctctctctcatgtggaacaatagttatttcttcacaaaatcttccttgcgtgatgttgcttaggggtgttagtcggttgccattgccataaacatattgtggaaattcatgaaagaagctaacaaatcattatctaccaatctactttgttggagcatcacatgaggatatggcggtaggctcgtgatagtatagcacttttagacatactacatatatagttaacatcctagccattgttcttcactttgctatagttgtttgtgtgcccttcgacactattcaccattatcagctccacatcatcctacaacattgtctaatatttcacgtaacaagaccactaaatacatgtcttcctatgcttgcaagtatacccatcgcaaacaccaaggattcctcaccattccttgtgtgtccatgtattaattaaccccatgcatgactcacatgtacatttgagcaacatccatttattcatgtcttggtatggcacttgatcaatttagacacagtcaacatatacttatcaagtacacatgtcctcgaagcttatcacaattttgaggacaaacatattttgattaaaaaacatatttcataaaaggccaagtctagggtcatgtgtaacaagaaaataaaagtttaacaagattttgacacataaccgcatggatgcgcaaataagaaagaaggccaaagactagttcgatttagatgaggaggcatcaagcacgacagcaacatagcatatgttcttcattttaggctagctacttatttcattcaattatgaacagccatatgctatgctatacgtaaataacttcaaatatgaataaatttgctcttctattttatattcttttgtctttctagtttccaagtaatttttttatatggttgatggaaaaggacaatgaaggggaattctgtgtatcgtgtagctgctagagttcattatgtgagatgttgattaagaacttaatacatgatggaaaataaccttttttttgcttgtgatggtcatctcctattatcatttattgttttaatcccttaaagaaagtgtttcgtgttgcaaacaacaattatcactaacatcttattttacgcatccatatgattattaataatatacaaacctaatcacacatagataaactataataatattgtcgatgttttagatcacgactacggaatttgcatggtatggagattgttggtaccagagtatatggagggggtcgcagtcgccggtggtgggtgtcagggctagggctctccatccttgaataatgtcttcttcagtcagctcctatatatggcaattaaactcgattaatcagtggttgggtcgatttcgccttctcgtatagggatcagcctctatcgtgtttgctcccaactccttgctttccaagtagtagtactctaactcttcttccataacctctcccaccttctcaggcttgggaaggtagaggaggaagcggaggaagagggatttgttaagaggagagaagactcggaggagggagagatggacaggggctatgcgctggaagagaggatttccggtgtgggatgacagttgcgtcaccctttcttctatgaagcttgttgaaactaaaaaacatgaactctataaattggtatacttgctcaaactggtattaccaactacaggtggctacagcaagtgttgaaagggtgttctctaccatgaatcttgtgaagaccaagttgaaaaatagtatgggcaatcaagtcttgaatgattgtttggtcacatttattgagagagatattttcttgaatattagtaatgatgctgtaatggagcgcttctatgctatgaaaaagcgtcgtagtgataaacggcattagattgcattgtttctgctatgtaagacttattttggactatttgcattgtgttttaataatttaagacttaatttaatttgaactaattgtactacattcggataatttaagatgtaattgtacttttgtgcttgaggtttttgttttggcttgtccgccacactgcctccactacaagcaccatcgactaggccgcttcatcatcctagaccacacaacccctccccctccccccaccctccgtcatcgcccttgttagatccactgcctaggccacgacctaagaagatcgatggcctagtttgctggaatttgaaaatatagggggaagcaatggcaccaatgattggaaaagcagatatggcaaaataagaagatattagatatagaggggaagaagtggcggtggttggatctagtagagggaagagtagtggttgtcgtccccatgggtgtaggtgttagtcaatttctttgtgatggtggttggcaacaaatgtggaataaaaggtaggtagggagatataaatgtaagtacatgtttggcaaatgggcaaaggatcttgatgatttttttatggttctaggggctattttgcacatgtatttctgtaaaatcacattttaccaaattttgtgagctgaaatgctaaattatttacgcctaatcaaaaccactgcgcattgtgaagtaggatctcaaagagtacactcacccgatgccattccacaagaccggccactttgtattttctctactactataatagtggagccgttctccttccattccctctgaccgtactgcacatgcgcaagatgagagaaaaaaaagaaaagaaacgcttgaattcggtgctttaagctcgatctatactcccaacccattcccaattatatgggtcagtgcaacccaattatatgagcatgttactagtaaatgcttgaagttatttgcctagggcagtaatagaggtggcattacttgctaggtgagtttggtggaaagagtacaacatagagagaagcggatatgtggggattattgtgctcaaagattggctagcactccgatcctttctgatgactgatttgaaacttggtagcaacacctcatggtcatggtcaaatatagagtaggaaccttccctctcctatacatgtatatttgtttttgcatgcatttaactcagatttgctcgagtcagaggaagtaacacttgatcagatgaataacgatatgcaattttattggcgatcgatgctcatgcatatatattgcgcgtagaaaaccattatgcatgcatatatatgtcatcaagatggaagaccagaacaactcctttccataacatttcttactttaggagaaatcaacctctcctataaccttgaaatatttaaccccaagactagccaactggccatccaaatcaaagtagttaatctatggatgaaggaaagaatgagaaacacaacaacataatatctgttgcttcctcccctgctccaatcctgcacctgtagacacatatcatatcccccctaccaacaaatgcaaacatctgcatgacatatatgttctccctatatatatactagatgtagaattaattaagttatgatcggtaaggcacatgcatcatgcatgcatgccttttgatcagttgtgtactatatacttggagtatgatcagacttggagttgtgaccaactgatgagagccctagcaaagctacaaggccgtggtcttgtagtggtggtggtggtggtggtacagatcctgcaacttcttccacgactcctccctctgcatcttgagctgcttgtagaagttgccgatgaacgcctccgccttggtgaacagctcttgcttgctcatcatctgctcgccgccgcccccgccgccgcccttcgtccagcacccttcctcctcctcgtggacgacgacgtcctcgccgtccccgcccccgatgaagaagaggctcgccctcgacgggcacctcctcatcttcttggacttcttggccgccgctgccgccggcatggcaccgccggcgatgacgacgacgtccctgctgccggctgcagcctctaacgccgccgccttcggtgtcaaggatggtgaagcggccacaattacagcgctgctactgctactaccgttgacatggtgatgacgaccgttggtcgccgccgcagcgacgtcgacttcacctggtctattgctgtggctcagcctcagagctgcggcggcggcggccggcttgggcagcagcttgtcgtcgcgcgggccgctggagatggcggcgaggaagccggcctcgacgccgagggcgacgacgagggcgttgaagaggaggtagaggtagggctgcctgagggaggaaggcaccaaggggaggaggaggaagaggaggaggagggacgccatcttggccacctgggccagcgttggaaacctcttcttctccatggccatcaccatttgtagctagctaaggctactagagtctaggagagatcagagagagagtaggaggggatcgatcagggtgtagcttggtcacctatatatacacgtgcagtagtgtctactgtgccccgtgtgctctactgtgcaggacacaagcttttaatatactattttccttttggaattaattgaaaaaggcggcaaatagataagcttgcgtagcgtaggtggtaggagggggatagagatcggtgatagagatgacgcacaagaaagaaagaaagaaagaagaggaatttgtttgagaaagtatctaatcttgtgtgtgtgtgtggagttgtggggcaaggtcggtgagaatattccggtcgttttcatgagcaggggcaggcgtttctcgccgtggttcggtgagggggagggtggtggccatgtgggagatctcccggtgggatcgtccatcccccttctgcttaattttattccctgccatgcatgcatatgcgcttgcgcgtgaccggcggcgggccgacggctcgcgcgcggctcccacttgctgttgcggagggatatctctggatatgctgcctggaggtgcatggacaattggtcaattggactggacacatgactggaagtctggaatatggttgtcagggacgaataactgaagcattttgtcaaaaactgtaactttttttttaaaaaaaaagaggttctccatctagtcatcagttgcgtgaaaaatttattttccacccgcattcgatattttggcggtcgctatgacgtagtataatagacacgcaacccctggtgcctaattggctaactcggtgtgttttttgtcgattgcatcttggctcctctgttgttgcgtaaaggaaaaataagtgggcagcactcacggcttattatataccacctccgttttaggttataagactttcacggtttattatatatgtgtcaagattcattaacatatatataaatatgggcaatgctaaagagttttataatctgaaacggaggaagtagaagagaaactcccatgaacattttgtattacgatagttcaaacaactaatagtactatttaagaaataccatcatgatatatagtggccaagaatttttggttgggtagttctatttcacaagtaccggtgaagaagtagaaatttcattcacatcaacgtaccaaaattttctaacattgcaaatcccataaacaaatagaaatttaattagtttaaaagcgatagaattatatcttataccatcactaatcgactaattcaactagcaaggtcaaaatttacaaagataatttagattgataggagcaagaggtgcctcttgttcttgagtttgagcttcatcaaaactatcagaaatgatggtggttcttcttgagttacaggaagagggtgttgcaatcttctttgccctttgcagttctaggaagagggtcctgcaatcttctttgccctttgcttcatggttccgctagagtgatgcaattaaggccctgtttctttcagtttgaaattattataatctagattattgagtcagattactataagttagattgttataatctgtagtagaataagtgattagttgtttctttcctagattattagagcctaaattattgggtttgcaagtctaaagagggagtggtggcatggtgggtaaattttcacccaataatctggaaaaagctcacctaaatgagcttatcagattataataagctgggcttcagattataataagctgggctccagattataataagctacttcaataagttgtctgtttctttcagcttactcctaataatctggattataataatcccaagctgaaagaaacagggcctaatatctgcatttctattcatgcctcaccaattctaccatcctacgaactaatgacaaaggcactggcgaggggatggtggtctggcggtggatccatcgccttccctttaaactccaaccatgcgttgtctcccaagttaccactgtataccctctagattcagcatccctgaggttgtggtgttcttttctcctgaagatgaagatgaagatgaagattaagttttttacacaaaacgagataatattaacgtatgattgattgagttttaattattacaaacttaaaaaatagattaatatgatatttttagagcaacttttatatacaaagttttcgcacgaaacacaccatctagcagtttgaaaagcgtgccacgaaaatcttaattttcatctaactcttgctggagaaaagaacggaaccagttcattggatctaactgccctaacctcatggggggaggatttggagggggctggcagtggtgcttgggatgcatgcagagggcggaggtggccggccacggtgctctttttttgtggggtggaggggggggggggttaatgggaatttatttatttactattttttagaaaaatcacctatggttcagtaggttcgatagaggatgaactgtcataggtatggatattcccttgttgttgttccgatccatgtttcccaactcatctacgactnanattattnacccctcctccctcttcccccccccccccaacccccatcccaaattaagtcctaatcacccatccttttccttttgtcttctcccttctccgctttatggctccattgacaggccatgatatttgattggtacatattggagaacaaacaatgaaggaaccacagagatttcattcttccttgttccaatctcttgcaatcctacgagtgatttctattgggtgcttcacttcgtgagtaacacgagccacagccgctttagcgattttagtgaggaacacgagccacagccgctgaaagtacaccaggcaaagcaacttcagggagaaaaataattccagattggtttcattcagtaatctctagttttcaacttcgctttaaacaacatggtttggttgtgaaatcacataaaacaatgattgaactggtttttacatagttattctattttgatttaattgatcccgtgtttaacaccatgagagagaggaggcaataagagaaggacgaggaaaccaatcgagaagacgaatgtgacgtgtgggcccaccactgatgacatccaccggtgatcacttatgggacacggatcggaacagggaagctgcattctattatatgtaaatatgggtgatcacctcacagatgtgcctagtcatcattaaccaattaactatgaggggtgcctagctagcttatccataatacttccttcgtcccataatataagggattttgagtttttgcttgcactgttttgaccactcgtcttattaaaaaaaattagaattattatttattttttgtaacttactttattatacaaagtactttaagcacaacttttcattttttttatatttacacaatttttttaaataagatgagtggtcaaacagtgcaagtaaaaactcaaaatttcttatattatgggacggagggagtatttagctaggtttcatgcaattgtgagctagcaaaacctttgagaattgatattccttcacgagtaaatatttttgtaaaatatcttgaaagaaattaactgataactgccaactaattaatagtacaaccaatgaaactctataccaattaaaatacaatattgttcatgtattcagctctggtttcatgccgacatgatgtagtcttaaactaagacatatcatatatccagtatctaccgagtattttcgccaggtgatctcattgactcctcattcgtaaagaaaccaaagccaactatagcagctggagacagtatactgtgtcacatccaaataaattaagccacaggtatatttgagaatttgaattaggctccgataaagatacctatcctttatactttctgggcacaagtagctttttatcctcttatccatccagaagtgcgtatgaacatgggcggtttattctcttctttgcgtagagatcgctgtccttcagtttatatgagtgtagtaatctttattattgatgccagcatagcataaatacagaatagtaatctttatatatatgatcagtagattaattagcagaactattatagctagccctttcatcaaaaggtcgtgaagaattaatatacaaattttccgaaaaggaaaaggatgaataaaatatcgaagaagatctcagggcaaacgttcattccgtggccgggttcgtattccactactttaggagagactggataaaaagctgctcactagctgagctggaagaatgagaaaaagcacaagaaggttcctttaccgcctgatggatacaccacgttgtacaaacaccgtctttttaaaggtagcacataataatcgagcaccctatccattagaaaaccatctctaggtacagatattagtgaccgctacatctacgggcacatttaatttagttttgtacatttcacggtgagtgccgattaaagccttatttgtttgagctacgtcttatagaccagttccaattttgaactacggattataagttttggaattaatttatggtctttccttgttatttttgtcgtcatcacactcggacttaagttttaaactgctgaagatagaatcgtaaaagtcttagatattctaaactcattttcccgttgtatctgtcaaaaattgacttatataattaagcccatcccagaaaaatgtctgggaagaaaaatcgcgctttagcctttagcagcagagtggacggggaatatacgcagcagtgctgcgtcgtcgcccgatcttatcttttggctgagatcagtagaaaagggcggccggagaccggaaaaaggatatatgacgatgcgagggtgtttttgccgcaggtaggcgtcgaggcacagtgtgcacgcagcgatcgaccacagagacacacgtacttttttgtggcgtatgtacgtgaccgacgtacttagcatctgcaagagaccgaagtggtagatgacaccatgcatgcatgcatatatggagtcacggacgcgacccgtttcttcgcccggtatgaccggccggccagtcggtctcgtcaatagatgatctggtagctagagtgagcaactcataataaaaattattggaggttctatacatattaattatctaattattaactaatatactaattatataatatgaatcagctagcattgagtaatttaccaggtgcctgtgatcccggtaaatagtacataggttcaccattgggtagctataggtccgtgtatgtgtattagctagctgcctagcgcttactactctgtctaaaaaacgaattcctacctacgaacttggacacacatgtgtccagattcgtagtcgtaggtaggattggtctttttttttttacggaggggtacgtgttcaactgaataagaatgtgtacatcatgcatgcagtgcacaagctgttggttttttgctcacataaatatgctcaagctgttggttttctgctcacataaatacgcgcacacttgttcgtccgaacacacatactttcttttatattcacttgttgcctcaacaacctatttcttttttattgtctaggaggaaaatattagttcgaggtccacctatgctagaatacgacactagtacataactggtcatcgtgaactatggatgaaaacagatcggaaacgaacggaaattacctttatcatatttgttttcataatttttttcggaatcaaaatcagaattaaaaacctggatgtggaaatgaaatcgaatattatcgaatacagatacggaacaaataagacaacgaacatttgtcggtatataaaaatcccctcaaattgagtttccttaataaggaagagatatcgctcgtttttttagatcaatatctccaacatttatatcatcaatttgtaggagatcccacaattgtatgtgttcatggccattcccctaagaaacccacatgtaaatataattattcatttttaatcccaaatccttttactatatgtatagcttacttaccatatcacttatcaagttattgttgtataaattagagatgttatttattttattgttaccaggttagctagtgattctaagacacctctatacgttgaatgcaagtcaaaacacaccaaattatcaataaccctggacctaatgaagctaaagacaagcattagatggacagacaagagtttcacttaactgttgggtatattgaagcgtttgcttcataaggagaacgcattgctcaagatgacatatgaatcaaagcatattttgtgtctcttgggcttaggggttcatagaattcatgcttgtccaaacaactgcatattgtatcacaagcaatatgcggacttagaggcttgtcctgtgcaaggcttctcgatacaagcgaaagagaagttctgattaagggaaaaagtcaaagagggctggttcgacgaaggttgtgtggtatctatgttgacgatcgttaagtgcatattttaactaccaattcctgcgtaaaagatatcaattatattatcaaaacttagtataggactatactactaaccacttccactagttttggtaaatatagctatgcaggttatttaaggagaaaatacacccgacatgcaatgaaaatgaacccccgaccaatcacgtgcgagtacacggattgaggagcccacaagtcaacttaaaccgactcaaggtgaggccaaccacccgggaaccgactaaggggcccacctgtcatccaccgaccaaagtcggaggagaaagacggttgaggtggttcggccaaacccctgctggcgccgctaactgtcaccttccatgtgtcactccctgattggttcctgatggcggttatgggaggtcgatggccagaaaccgccatactcaaccatcattggacactataaaaggaggactccatcaaacttctcaacacacaactcttgagctcaagtagagtacaattcacttgtagttttatatttagtatgttagtttggtagagagtgacgggaagctccggaaggagtggctcgaaatatcggagttccttcgagaattttagggaggagtgccggagtgtcggcattcttccaacggagtttcggagaaagccgggattgttggccttcttctctcgcttgtacctcgaagaatgctttctttatcaagtaagtgttcgggtttatttatgtcccttaattagtttatttaactgagataagtattcttatcggtgtgggttcgtcgcttagtgtgcaactgagtgctctagcactaggactctggataaagaaggaagttcctacacaaggttagaatagtaattaataacttagacgtggtgtctaggttagaaattaacttcatttgttgcgtgctccatggaaagtaaggtaggtggcaggtggtgacagccatgtccgtccttcgtatctctccacgttcgggtacatcatatagctcaaggccggactcatcctagcagaccaggggagagccggtacccgaagcattcgatagagttttatctttaacttaattaactaattaaaagacataggaatcatttctagccaatttatcttaagttgttgtccttggattgaatcttgatcgtatattatacacacacgttccttgtgttcgatacccttggaatactctaagggggaagtgctacaacggtattccttgcgcttacggatttatctgtgatcataagaaatacgatcaatctacctatcgttgatcgtttcaagaaaatctttgctaatcttaagaaagtagagttatacccaattataagaacgtggatgaattcatcgcagggacccagatcgtgcacccaagaagtcagggtgacacaaacattttggtccatcaccgccgaggggagcgttttgaaagttcaagtgccattaatttggttttggtgattaatgataaatccaattacatgagactaatattgttataagcatttctttgtctactagtctcatgtggatatgaaagtggaatttgtgagaggtgattcctggacttcatatgagttgagatagaaacattcagtgatggtggacctaaatcacaaggatgaaatgcatggagatcaagctatatgtatcactctttttcttcgtgcacatattgatatattcatatataatatttttcatgtgattacgtaagcatgtgagactaatgttttgattgagccatatcttgtttaatctctttacattgaagacatggagatgatgaaggtatgtttttattttaatgtctatatttgatgaatgccttctattcttgtataggataagctctcaatgtttcatagctttttatgtatactcttgcttcacacaaatattccgtatgcatacatttagggggagcaaaccctatacgttagttatgcatgtatttgatccaagttattcactttcatttaattgggatctctacatttaagtatacaatcgagtatatgacacttgtggtgttgattaatactcaccacttattcatatccttttatatactcgatcggttagtcaacatgtgaaggttgacaactggatcattgggactaataattttattgagttgaatgagagaaataggtcccaaggattgcaaaggtgctgatgctcaagtgatatcattacacctaaatatactaaggatgaccaagtgaagatattgaagatgtggaatatgaagtggctactatggcaaaatggtgaaaggcaagcgatgcttggtcgggatggaccatgcatcgtgaagggtaagcaaggggcttggtgtcgaaaaaccaaatctagcggtgaagagcgagtgacgactttgtcacgatggaccgtgtgaggccatttgaagctacaagtaaccgcatcaatcatttgaagaatatatggtgaaacggttttggcgttgacgtcccttaagacaaagaaaggaagatggaaagaagtcattcctattgctataattttcttcctatttacatttgtgtcggtgacatgggaccgggagtatcatgacttagagacttgaggcagacacgatcacccacgtggcctaaccccctcgggggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaaatgcagattgataaactgacacgtggtcgacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaagtcgccgtctgtttatgaaaagataggataagtccccacaaaaaagagagagatggggcatgtggtatccccttgagatataaaaggaggaccttgcccacttagaaaagaaaaaaaaaacgatcccagaacgatcgggggctggctagcactttgtagcttctccatacacagatccaccaaaacacaggagtagggtattacacttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccgtcatctgacgcgccaggtagggggttctgcgtgtgttcttctaagctctcgcactttttcgtgtgcgccaagcttttcctgttcagcccaatggccgaacaagcaaaggcgcacaacctctctccgagtgttagcggtgacgacggggagccgaacccacgccgtcgagctcgtactccatcgccccctccacgccaaagtcctaggcgggaggaggcgctcgagagggtcgaaggatccgcgacttcgacatccacgggtgatggggaaggatggcgagatggggagcgtcgcctcctcgtctacggcgacggcagcacgccccagggcgcattccaagctgcgggcgcgctcctacgtcacccgcccgttgtccctgacccggagtctccagcccaacgttggctggacgacgtggctaacttggtcatgacggcacggcagcgcctaggtgctggtgggcggtcctccgccaccaagacctctggcgccgctaccactggctccgtgtcgtcgaggcggagggcgcggcgagcggcgacagttgctcgtcattctgccgccactccttcgtcagcgcctccgacccaggaagatcagcgtggggggccagatgcccgcatcgatatcgagcgccggcgtaatggtcggcgtgctccccacgcaacggagggcgcctcctcgtccggagtgtcacctcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaagccgctgggggtgatgacagggtcatggcgaatttctttcccatggccctgaagggacaggcgcggggttggctaatgaacttgccacccgcgtccgtccactcttgggaggatttgtgtcaacagttctccatgaactttcaaggcacatatccgcgcccaggtgaagaagcggacttacatgcagtccagcgaagggatgatgagtcacttcgctcatacattcagcggttctgtcaagtccgcaacaccattccatgcatccctgcacacgcggtgatctacgcattcagggggggtgtgcggcacaaccgcatgctcaaaaagatcgcctccaaagagccccagactaccgcggagctttttcagctcgcggaccgagtggctcgtaaggaggaggcatggacctggaacccctccggttccggtgtggcagcttcggccgcccccggatccactgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctcccagcaaggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggtaagtccccggcggttccttccggcaatcggcgaagtgaggccaagcagaaggcccccgccgaggacatcgatgacggcgatgatgacctaggtgtccaagagcctggggccaccattgccactgtcgatgggggagcgtgtgctcacgtttctcgccggagcctcaaggccatgaagcgagagcttctggccacggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtaaagctggggcgtgtcctcattgatggaggagcagccctcaacatcctttcccccgcagcctttgacgccatcaaggccccggggatggtgctccggccgtcccaaccgattatcggtgtgacgccggggcacacttggccgctaggtcatatcgacctcccggtcaccttcggtggatccgccaacttccgcacggagcgggtgaactttgatgtggcggacctcaatctgccctacaacgcggtcttagggaggcccgcgttggtgaagttcatggcgacggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttagcacatccgcccccgctgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtggttgagcaccgtcttgccgtgcggtcgggcgcaaggccggtccggcagaaagtacggcggcaggccccggaacgtcaagccttcatccgcgaggaggtggcgcgacttctggaggccggattcatctgcgaggtcatccatccggagtggctggcgaacccggtggtcattcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggcaagggaggatgaggaaaaaactgcattcattacccctataggaacttattgttatacgacaatgcccttcgggttaaagaatgcaggtcctacttttcagcgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggtgtcacgcccggaatttctatccaaaattccaaacgcttacatgtgtgtgaaccctcgtccaggaatcagccgaggcacacaataacaaattgataatagagtacaaatattactctaattaataagcgaataaactgtcattacagaggtagatagttcctctcaatcaataaagatctaagcagcggaaaaataaataaacggcgcagacggctccactccacaggcagcttgaccaaggctacacctaatcctccacaccatcagcctcattgtagaactcttcctctgatgaatgattgcaaggtgagtatatgacatactcagccagccacgcagcaaatatgcaagtgcacaggataacaaaggatagcataatagggttgcatttgcaaaagcagcatttagcaaacatttgagaatttgataaagcagttaagtaattaaacaattttaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccacccataaccgcgggcacggctattcgaatagttttactctgatcagaggtgtaccactgtacccacaagacacagccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgaatcattagttatcccataagtgagctaatgtttctaagcaaggctaagcaattatatctaatatctagttgaaccaatataaataaagctcaactagtcaaattataatatcccaaggtatcaaggaataaggtaatcaagaacaaaagggctatagcaaacaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatataagcagaaaagagcaaaatcaccaaaacagcacataaacaagcatgaacagtacatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaaggattattgcgtcagcgggctagggtttcggtggaccgggcgcacgggcgacggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggcggcgcacgcttgccggcgaacggcggcgctaggacgcaaacggagggcaccagcacgtagaggacgacgcggcgaacacaccggtgaccaaaacggcggcggaagaacaacgaacgacgacggcgacgaggaggaaacggcggaaaccttcgggttgtcgacggcgacgaagctccggcgatctccggcgacggcgaaggggcggacgaggacggcgacgacttggcgagcacaacggtggccttcccgagcgacggcgacggctgaaacgacggcggcgcacggctggagcggcggcgacgacggcaaagctagggcacacggcgctagagcgattccggcgacgagaggcgaaggcaagggtggcgacgggtagaggagacaccgggggtccttttaaaggggctcggaggcgacggcgaaagcccacggcggcggcaacggcgaaggaaagctcggacttggagagaagaaagccgatccgattcgaactcgaatcaaactcattccaaaccgatttagccgaagattccaaaggagaaaaggtagaggagatcccggagatcatttcccctctttcaattcggccggagaaggaaaggagcggccggatttggaaagcggcggcggcggcggcgcgctagggtttcggcccgaggaggacgacgatcccgacaggtgggccccacctgtcagcgggcggacgcgcgctcgcgcgcggcggactgggccggctgggtcgaggagagagaagagaggttttgggccgactttcggcccaaagccaaaagagactttttaaaacctttttcaatttaaattattccttaaatgcaattccatttattaaaaatacttccttagctcaaataaatcccagaaaaatctaggaattatagaattaagcaaagtatttaatgaaattttatctggccacattttatattggaatttattaattaaaattagattttctcttcaagacttttaaaattatttctaaaaattccatttaaacaacaatttataaattttaaattttcagggtgtgacacatggccgccctaagtcggttcatatcgaggctgggagagaaggcgctacccttatttaagctcctcaaacgctccgggccgtttacttggacggaggaagctgaacgtgctctcactcagttgaaggcgtatctcagctctcccccagttctggtcgccccggagccaaatgaaccctcgctactctacttagcggcgaccccgcaagtggttagtgcggcgttggttgtggagcgcgatgaggacaatcctcattccgcgcacccccaccctgtgccggcttggcccgggagaaagcagggaggagaggcccccgagccgaacgatggcccaaggcccccgacgaccggagcaggccctctccccgcttgtcagacgatgccaggtgcccccgacccccaaggtggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcctccgacccccaggacggccccgaggccactgtgggaaggccgcccctgtcgtcctccgaccccgaggtcatcggcacagaagaagagtgcaccccgcgaggccgcttggacaaagagcaccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaacacaccacgctatcaagagccaagccctcgccgattttgtggcagagtggaccccagctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgagataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgtgaagggagtgaacgcgtccagcgcatctccaaacgctacgtgctggtagaagggaccctctatcggcgcgcggctaacggaatcctcctgaagtgcattcctcgggaacaaggcgttgagcttcttgccgatatccatgaaggcgaatgcggagcccactccgcctcgcgcaccttggttggcaaagcctttcgacaaggtttctattggccgacagctctcaatgatgcggtcgacctggtcaggcgatgcagagcgtgtcaattccacgccaagcaaatccatcagccggcccaggccctacagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattatggataacggcacctaattcactagtgaacttttcggcgattactgcgaagacatgggcatcaagctctgcttcgcctcgcctgcccaccccagaagcaacggccaagtggagcgcgccaatgcggaaatcctcaaaagccttaaaaccaagaccttcaacatcctcaagaagcacggcaattcgtggatcgaggagttgccagcggtgctctgggcgaaccgaaccacgccaagccgagcaaccggggaaacgcctttcttcctcgtctacggcgcggaagcggttctcccatccgagctcaccctgaagtcccctcgggccaccatgtactgcgaggctgatcaagatcagcttcgcagagatgacctcgattacttggaagagcgaaggcgacgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatatgggagggtccgtatcgagtgatcggcgtcccccggccgggctccgttcggctggccacgggcgacggcatagagctgcctaacccgtggaacatcgaacaccttcgtcgcttctacccctaaaggggaatcgggtgtcaggtttcgggctcgggccaaccccgcacccccatcgggcgtgcagggttggccgggggctaccacatatgcatattcttgtttctcttatatctgtatttcaataaaagcattttcgatttcctaagggctgtatctgtgctgttgtttccttttgaaggatcttgacttgaaataggtcactcgtgttcaatcttgccctcgggggctcgggtcggctaaaaccgccaaacggggcccagaaccgagccgtgccccggggcgtggtgaactccgggggggaatcggcaaaaacccacaatcgggtcacccataaccctcagtcaccgcgctcccggcctggccagtctcgacatgtggatctccccaggcactagccccgacccgagccatttgaggactaggacctgggcacgagcccttgttcaagccaagacacgaaaggatcgcggcacagatatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggcgctcactccgatgcacccgggtcgccagcctcgtcgccactatcgcccactccgccgtcatcgtcctcctcgtcggagttgggggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaagatgacttaatcgtcctctcaagctcctcggggagccgttggagagtcccggctatctccgagaggcgctgggcgaggcccccctggttggcggcgtacttcgcagttcgcccgccccagaggcccacctgccggccggcgcggtctagacgggagacggcgtcccgaagcatgccgggccctacctcgcctgccaagcggagggcctcgacctccccggcggatgagtctagcgcgccctgcagatcggcgatggtgtgttcggcagctgcgaggcgggcggttaagtcgctgtcgcccatggccaccccgccgctgcgtgcccttgcatccagctcccttgcctgcgcctcgagttcagcggcccgctggttcagtgcggccctctcggcgcaggcactttccagattgcgacgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcgcaggcggcttcgtgcaccgccagtgtgacctcccgaatagcaacggcggcctcgcgatccgccaggtccctctccacggcgcaggcacgctcttctagcgccatggcacgggcctcaagggcttcctcgcgctgccgggatgccacctcggtctccgccacccgcagttctcgggcagcggcagcgtcaaggaccccccgggcggcgtcgagcttttttcctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgttgagctccgcccgctctgcttgcagggcctccacctgggcacttaacccgtccaacaccgtggtgtttgcgacggctaaggcctgcagaaggggttctgcgctcagtggagcaacggaaggcgtggggaagagccgcctcgaagaggatgccgcgcggctcggcccgccgatggacgtgccggactcagggatgtcccccagacctggcttgtcctgagcgttgcccgaggaagtgggcccaagcgatgcgcccgcggcctcgtcgcgagttgcctcggaagtcatcgccgcctcggcctggcgaagtctggcctcctcccgagcggcttcttcagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgaacggcttcctcggtctgacgagcccgggcggcctcccgagcggcctcctcggcttcccgaaggcgatccgcggcttctcgccggtcggattcccgcctccgggcctctgtggtcgccgggtcctcggcctcagactggccggacttggaatggcgggagggacgcgacgggatctcgctgaaacagaagaaataccagaagacaaacaagatggatgagtgaaaactcgtgttgagggaatgaatacggccgcaatgggcgtgggacgaacctgcgagggggtcggttaaacaaccaccttggaggggaaatgaggtttccccgggatggttctgtcccccccgtcttgcggagtcattttttcttccgctccccctcgggatgcgacgtcggcgtggccccctccgggcgcctgctgctggcacgggccgccccgccccctcggggaggagatgggggaggggttccttcctgcttcctcttcccccgggcgtcggcagggcggccgctccccgggcccccgacgcggggcccagaagcacgaccccctcccggggtagattgttcccccctgcggctcccacccgcgccatcgtggcctcgaggagcccgctcctccgacgccccgaccgcctgcatgatggtcaggatggaggcgcggtctggatcgctacagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctaggatcgcaggcccgccaggcgatcgaggacggcgtcatagccatctcccagatctaccggcgcccgccagttggaggcctgcgctggaggctggctcggaagtcggaggcgcgcttcgtcggcgaggggggtgtagaaccagtcgctcttccagtcatcccacttcttgcaaaggacgcagggaatgtagcggtttagcaccggcccccgcggctggaagtagcaaccaccaaccaccgacggcggcgacaccggctgtacgatgaagaaccaccggaacagccgaagggatgggcgcaccccgatgaacatctcgcacaggtgcgcgaagatggccaaggtcattaccgcgttgggggtgaggtgcgccatctggagatcgtaaaactccagaacatccatgaagaaagaagaaaatagcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagtcagggcgtaagcggcgaagacaaggggaataatggcgaaaggaaggaagcaaatctcttcctcggcgactttatacccttgccaacgctatgcccggctcctcgtttctcgcgcccactatctgccccctcgtttctcgcgcccacgcttccactaatcccattcgcccgtttgcggtgcatgaggtggatatgcggctgtggcagtcgagatggaacatctcgtgcgcgcgttaatcacgctcgccgaccgaagcgccatcatcatatctccaggaaaaacgaaccggcttgtcccgattcccgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacacccgaccgcttccctcgaggagggcgatcgccctggcataacgccgggggctactgtcggtgacatgggaccgggagtatcatgacttagagacttgaggcagacacgatcacccacgtggcctaaccccctcggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaaatgcagattgataaactgacacgtggtcgacaagaatgaccgatttgtgaccggtctgacactggtcatgtcgtcagcagacagccatgttcccacgtcgcgcctgttccggcggaagtggaggtaggtgtgggccgtcccatcagaaggtcattcggacggcaaccatacaagtctccgtctgtttatgaaaagataggataagtccccacaaaaaagagagagatggggcatgtggtatccccttgagatataaaaggaggaccttgcccacttagaaaagaaaaaaaaaaacgatcccagaacgatcgggggctggctggcactttgtagcttctccatacacagatccaccaaaacacaggagtagggtattacgcttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccatcaatttgagtataggaatgttgtactattaagagggatgtaacgtcgatgtgtttgtgtatgtctcattgctcaaagtgacccatcctttgagtggttttagacattccttttggttgatttgagtagttctctttgtgagctttccatagagtccaagatcatcaaacggacttacgagcaaaaagttatggccgttttgccatgtgtttttcggaaaatccgaaaaaattccggaaagtccgaaaatatttcggaaattccaaaaatggctgcgatattgagattgtcttctgttgatttttggatttgcccgaaatgcatttcggaaattccgaaaaatggaatcttggcctccaacggctagttttgagaggctcgggtattgataacaacggaattttgcatcagactcggagaggtagaagaaagttcgaagcggatttggtgcagaatcgagttgaattcagagtcagactgtgcatcggttggacatcatatcggctaaaaacagagcaaatgcttagcctagccgatatggcaagcaaccgatatggtatgacttggggcttggtttgggcctagactaagataaccgcaattggagcttgattaaggcaattgtatctattaattaggatatttatgtcggtttttgttagagatatggtaagagaccaccgtgtggtcttgtttgtattttatctttaggaaagtttgagtcgtgtctataatggactaagtttgtactcggggtataaatatgaacccgagatcattgtaaaaaagggacgacaaatgcaatacaactttggcgcatcgccaccctttttgttcttcttttcggcgagttctctcgataagaggtaacttgtctcgatgacttgtgctattggagctattatgtcgatttagatattttagtccttctatcatgaccatttgctatcatatgtcttaagtaatctagtcttagtatcccgatttagccctatcgactggttctcgctttagggttctcactgatatcgactaaatcatcttgctagattagattagcaaaggaatctaccaccctaaaaagtggttgccctatcggctggttctcgctttagggttctcactgatatcgactatagcaaaggcatctaccatcctaaaaagtggttaattacttgattgtttagactttaagtttctttacatactttgtaatagtactccctccagaaccacgtagccagcccaaccgacgggcgggcccacttacacataccaccccacttacactttcgtcctcgcttcgtgtaaaagggttaacccgggagtaacatggttggagggaagaggccttataagttggttccactcgtgctaaactagcaagatggtaataaacatgcgcacacagctcacatgggccacacaggcctcatcctaattgggccaggatgtcacatacactccccatcaaaggacccgacgtccccgtcggcccaacttacccagccacataggcaaatgtctaggaacacaccccctaagatcttagcgcacgtcacccccctccccctctaggcaacatcaatgccctttcagttttcaagcctaccccaaaaaccaaagtgcacggggtggatttggtggctgggcatgccaaagtccaagttgacatgatcaagtcaactgacctctagagatcccacaaaacgactaaattttgaaactgggagctacacgtgggacctttatccaatggcctaaggatcaaattgtcataaggatggttcctaagtcaaatgcaccacgagctccatcgcctatctccactccagctcgttcagcccctcctaccatcgaaggcgcaccacaagatgatattgattttgggtttgattttgtggaagctgacgatatggctaacattctcccctcctcagaaaaagagcaaggcacattcttctccaccagcggtatctagcaaaaaagccagtagagggaaaggaaaggaaaggtgacaacctcactcttggctgttaggaaatgatcggcagataaacgatgaagaacgacagatcaatcacagaagacacgagatttatcgtggacaaccctcctaaggcacgagagaaaaaaccacgggcgccagccagcaaatcttcactatataaactcaacatttgctcccaagaagctagatataggcaaggaggtatcagtttgtcctaagagcctagctcagagcagctacagttaggcatgccattggttggagaccacgagcttaccaagatgggtccaacgtaccgagagttacacgggtactacatagagaggtcgaactcaaggagaaagaatagagagatatagatattgggttttcatggcccagagccatttcttgggccatttggctatattttaataggcttcgacaatctctatgacctcttgaagctgcgagcggtggacacaaaacttcttaagtattacttgttgtagccttcggcgacgggcctccgcttgctccgaccgaagttggcctttatatgtgtgtaaatgaatttggatcacaactcaacattggctcccaagaagctagatataggcaaggaggtatcagattgtcctaagagcctagctcagagcagctccagttaggcatgccattggttggagaccacgagcttaccaagatggatcaaacttactgagagttgcacgggtactacatagagaagtcgaactcaaggagaaagaatagagagacatagatattgggtttttatggcccagagccatttcttgggccatctggctatattttaataggcttcgacaatctctatgacctcttgaagctgcgagcggtagacacaaatcttcttaagggttattgacatgattgtaagttaagttggaaggaggccaatgggcaaccaatttgggcatttgacaggttgacccaggaacgatgcaagttcactgcaaatgtgatacatatacaaattaaactccagtaaaagcatcaaaacctgggcacaaaaagatgcctgaatcgggctacattgcaagttggcaacgtattaaaagtagcaggagcagcagctagctagagaagtagcacagtttcaaagatcgagttgatacaggcctcgtatagattccaacccaacgtaaccactaccattctcgccaaacagactgcccgcgctattctgtaggctcagatggatagcgcactgttttctcttctcttattcacctctgtcatggtcatcgctgagccaattatcatcactgcatgagaagctagtaaagaacacacgggatgaaggtagggcttctggtagtcatagtggccaatctcccctggccttaaggagaagaagttttccgacatgcggaaatgtgccactggaaattttccattcttgacagtattgaagacggtttttatctcttggtccttcttgatgggaagttgaggttgggatttgattctgaaattacttgcaacctgcaaaagagtcaaaacttagagtcaaggtaaaataatgaacaatattgtcaggcctaagaattgatcatgaggaaaattaataaaggaatgttaattttgaaagacagggaacgaaaagtggactactggattttgatggaaataccctattgattccatatctatatggaattatggacaagaagtgtagcaagaaatgcagtttgtgcctttgtgggaagaaacaagtaaacaattgagaactggatcaaagaggtactacaacctcaattccttgaccaaagcgcaaacactagatatgaaaatgaaaataatgtttaaatagtttctaaggctactttgttatggcagattcactaatatatgactaggaggacagtttaaaaatagatgcacatcatattatgcttccaaacctttctggaacactagtccagtcttgaaggtttaaactttaattccactgaaatttccaggacaaccatgaggaatggccactgaagcgtccgatacttatgatattgataagaaagtcgacaaagaagggcatcttggtgtgacagaatgcaattgctcatacaaggtgttgcatcttcctgatatgatattaattaattgtttcaagaacaccggaaatgtgtatttttactaacaaaatatggaattgtggttacaataggattatgtgcaggatattcttgtgagttatttttgtccaggagataaacaaatggatgattgcataccaactaattaaaatcatgaattgcagcttggtaacctcactaaaccttacatatgatcctccttttaggccttattccttttgtttctgaaaatcatggtgtggcttgtaactcagaaagcagggcataggaatatgcaaaatacaatcactttgcaggaatatagccatcaactagtgcatattttctatttgcaaaatttatgaacataaacagatgaagtagtgctactgtgcttgatccaagagcgcctgtaatttttgaagtaacaactaaaataaaatgactataaaggcacactttagcctatcaaacaacacatgacatgatacatctaaaacagatattacctcaggttgttgctttcttctgcctaggacaccacattcttctagaatttgcagtacagtagcaagtcgatgattctaatttcttttccaacaacttccttgtattcttccatcaaattatcagtggataaaatccaactgaagtcctgtggtggttccaaacaagcatactggtgtttgtaaatggactccattgctcccaaacaggaatgcattgtgcatgtatctgttagagaagtaagatgatccaactgtaaaatctttgcatgtggatgtgaaatcaaataacaagtaaacaacagcaaggaagaatttcaagatacttcatgtgtaccagaatttccttggtcacgcagaagtgctagatatattttgtcgtcttaggtctcccagaccatgtgaattctttgcatacctaaaatatagggcaaaaataaatatgtgactgttacacttcttttgatggaaattgttacatattgtcattgtagaataaattgtgatgagagtaatgtgtgtaaaagcttattttaaataacactcgcaaataaattagcataatctggtttcacattacacatcagaaagatacaatttgcacatcattgcacacagggctgggatacaaacagagggtaaaattaagtttcccctggctctttgaaaagaaaaggttttctaacatcataataaggaaaaatcggtaacacaaaattttaacacttatttcatgctgcattgcaaatgccatgaaaacgaaccaaaatttcttctaacgggtatccttttttaggaaataaaaagaatatgtttccttttcttttacagtatataaactttacctggtgtatggtttcatttgaacttgcagagctagaaccatggaagtcatcagattcaagtgcatattttgattgacttgtagcgatagtgttccatttcaatatacactttcgctctatcatatcatcaactaattctctgaagactccccctctagcagatacactagcagcttcaccaaacatccacaaacagtgtctatatgaaaggaaaaatgcagccaatatatatagctgttattagaagctaaagtaacatatacagccgaatcaaattttgaattcaatatttttaacgaaccttgctttggtaattgcagcattgatcttttcaatctgaagaatcgtgttctcgtctttgaaaagcattgatagaataaccacttgataagtttctccttcaaaactatcagcagactcaatgtgcacattgattttattgtgagaagcatatttttgtctgagagaacttttgatttcactaatattgctgccacacagacacaggacaccaacatcaatcacttcagtatcttccagacctgaacaatttttttacaaagaacgtaaattaaggtctttatagtattgctgcaaaaacagcctcaaacaactacaagtgacagctatctagaagacataccttggaaatgatctcaagcatgtattggattgtggcaagctcaatggtgtttttctctttgcagctaggcccgtctgttccagtgacatcaataaagcaataattgggaaatttaagacctttgaattttttgttgtattcaggagaaatacagtcgcaccatttgtgattctcccttcataaaatttctcattgcggaactgccagattgatggatgaattgcatattgctcagtgagcatatgcttccgaaaacccaaattgagcaatcttttgaaaggactcatagtaaacctggcattttcccgtacctaaccatttcatcaataagatatatcatttgcatcagccagcattaatattgtctagtttactgtctagtcatgtaaacgaatacactagaaaatcagaaagaaaagattaccttgcttggctgcaaattgaagtcgtcgcctagcatcaaaatgtgtgtcaccagcaggcgcaatggaataatgaggtcgcattcgttgattttggctgcatcatctactattaataaattgattggttccatagctgcttcatggagccgaaaagttgactaagttgtagaaatgatgactttagcatgtttgatgcagaagtcctcaagaaacttcctttccacaaactttggtaatttgagtgagcttctgaaacttcgaatgaaatccacgcattgcagccttaaataattcagtttagaaggaactgaacttaatccaaatgtccactggacacgtttgtcgcgtaacctcccatgacataaatcctcaaaatccttcgacaagctcaacaagtttttgttatgtcattggcaatatcaacagacaaataaatttctgaaaatttttcttttagatttgtcaaccattcttttctcatgagaagcttggtaaacttgtccttgaatgaactcaatgtgaacacgagaagactattggtgctacatatgattcttgtggtctcatgatcacatttttcagcgcagtatggatctagattaagtagcactaacaattcatgcaaccatattttaaagagagaatctattctataccactaagtttagcccgtgtttagttgcaaaatttttcttcaaacttccaacttttccatcacatcaaaactttcctacatacataaacttccaacttttccgtcacattgttccaatttcaaccaaactttcaattttggtgtgaactaaacacagccttattcaagttcaacgatttgttatcgatattgtctctttctataatataccggcgactttatcaattgttctacaatatgccattgggctagaccttcttttcaaaaataaccaaaatacccttagaaacatacaagattaacaattgatttatcttatcagaagtttcaaaaaaatataatttttttatgtggcctccttacacaacatggaagtttgaatacaagtttcaaattttttctggtatatttagtttttagaaataatatttttttatgtggtatgagagagaatctgcttatacaagacataatagcattaaaatatcttatgtagtgtatgaaagatgattcataataaaaacaacaagaaaaacgtatttatatagcatataataaataagttatatttttttaaaaaaatagaaatataaaaagcttgaaacttctttcatacgctacataagatattttaatgctattatgtcttgtataaccagattctctcccacataccacataaaaatatttttttctaaaaactaaatataccaaaaaaattgaaacttgtattcaaactttcatgttgtgtaagcagtcctcataaaagttttcattttttaaaactttaaattagataaatcaattgttaactttgtatgtccataagggtatttcgggtatttttgaaaaaaatacctaacctaatggcgtattgtaggaaaattaataaagtcgtcactatattatacaaaatgacaatgtcgatggcaaattgttgaactcaaacaaactcggtggtatagattagattctctctattttaaacaagggttaattggatccatataccactacaaatatatcaaattaggaaaacgccactactattcatgatatcggctaggtgccactggaatttcgaaaaattagatccatgccactccgtcacgtttttcattcactccccattaatttcctaactccgtgccgttttccaacttcggccgagcggtggcgaaggagctcggcgaggtacgtgtccaccagccactacgccagatcagcccatctttgacgacctatctgtgacggaccaaaatatctcgtcacagatactatcacctttgacgggttaaaataaatctcgtcatagatgaggctaaagaaaatgatccgtcacaggtaaatactcacctctgacgggtatatataaggacccaacacataatgattgtgacgtgtccacatataaacccgtcactgatgagtacttacctgtgacgggttttaagtttacacccgtcaaaggtgagtaacctcacctcatatattcaatcaattttcacttataaaaacggaaaccccaacccttccacaccggccaccaccccaacccacccccaccgcccacaacccatctcttttctctcttctttctctcttatctcttctctcttcctccaccatcgcctctcccctcaaccgtgcgccggctgcgtcaccacctccttcgcccctcggcgtcctctaggagctcggggtcgccacctccttcgcccaccgtcgacctccaggaggtcgggccccgcggccttcaacatcgatgccgccgccacctcctgaccgccggaccgccggtcaccgcggggccttcaacatcgatgccgccgccacctcctgaccgccggtcaccagatccagccgccgatgccttctcccgcctcccggctgctaacgcgcgccgcctgccttgccaggccaggccaggcgagcgagcgcgcgcgtgtgtttcccctcttctctccaccacacatgcttcaagtggctaggagggcatcctcccttttaaggaggtccccttctcctagaataagcaaggtggtactaaactccacatgcatgccatcccatgaggtgggcttttgtgattttccaaagaattaatacttgaatgggccttagcccatctattaattccaacaatcccccaccaaatctcaaaatcccactgagatttgccttttccaatgtactgtttatataccagcggttcgatggagaccgattaaggttgaacatccatctagaacttcaagctacacttactcacaacttgaacaatggactacgccttgaattgcaagtcttgtgcaagcaagtttcactcagagtcttatctggtactagaccgtctgtagactacccctcgggtggagtgtataagtcatactcctaggtctttagtaagcttcctagaagattcacccaaaatcttcatagactgcgaccaacaagctcacaaaggtgagttctttcaaaaatgctctgcaggacaacatctttgctaattaaagccaacagaactcattaaagcatagccaacctgccttgcagctcacgagagtatatgcatcttcacttagagagggtatatattggtactctcctctagtttactgatggtttgttcttcccaggttctaattcacaggatctccaatcacatagaatgggttaccaccatagtataactcacatgggtctcaaacccatctccttcgatgcattgtctatcacatttcgtgatagtccctttgtgaagggatctgccaggtttctagctgtttggatgtaatccaacgttataactccagagtttctcaatttcctgacagactttaatcgtcttttcacatgtctagacgatttcatattatccttagaactattcactttgacaattaccgtttgattgtcacagttcaaaagatagccggcaccattttttcaacaataggcaaatccattaatagatcacgcagccattctgcctcaacagtagcagtatgcagtgccgtcaactctgcttccatggttgacctcgtcaaaatggtctgtttgcaagacctccacgaaacagcaccaccacccagtgtgaagacatatccactagtggctttgatctcatccacatcagagatccagttagaatcactataaccctccagtatcgcaggatatccagtatagtgaagccccaatgccatagtacctttcagatagcgcattactcgctcaagcgcacgccagtgatcatctcctagattagaggtaaaccggctcaacttgctcacagcaaaggagatatcaggcctagttgcactagccaggtacatcagcgagccaatgatttgggaatattccagttgattcctagcaattctcttgttcttgcgaagcaacaagctaggatcataaggtgctggagaaggcttactatcaatgtagccaaagcgattcaagatcttctccacataatgggattgcaagagtgtaatcccattctcacctctaattagcttaatgtttaggataacatcagctactcccaaatccttcatatcaaaattttgagacaagaatgatttaacctcatttatcacctaaaggtttgtcccaaatatcagtatgtcattaacatacaagcacataataactccctcacccccaccatggcgatagtacacacatttatctgtctcattgactgcaaagcctacggatgtcaatgttttgtcaaatttctcatgccattgcttaggagcttgtttcagaccatacaaagacttcaataatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccatcaggcctaagcttcttcttgaacacccacttgcaccccagaggtttacacccatagggtcgctctgtcacctcccaagtcccgttagcgataatggaatccatttcactagggacagcctccttccagtagtctgcatcaggagatgcatatgcttctgaaattgacttaggagtgtcatccacgaagtacacagtgaaatcatcaccaaaggacttagccgtcctttgtctcttactccttcgaggagcttcactgccatcctcctcagtgacatgttcatgtgtatattcagtttgttctggtggtgtgattgaactgggaattatttcagaaggttggctagaactactatgtgtatccttcattgggaaaaagctctcaaagaaggtagcatcacgagtctccataattgtaccaacatgcatgtcaggtacctcagatttaactattaaaaatctataggcaatgctatgatgagcatatcccagaaagacacagtccacagtcttaggtccaagtttgcgcttcttcgttattggtacattgactttcgccaagcacccccatgtgcgcaaataacaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctgagtttttttatctttctgtcaatttgattttcaacttctgccttataaattttaaaatagtctagagcctcgtctttcatttttaacaagtacacatagcaaaatctagtagcatcatcaatcaacgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttaaaacctttgacaatggaaaacttagaaattaaacacatgctggaaagccgagacatcaagccaaaattaatatgacataaacgtgagtgccaaacattagcctcatcatccacactgccacaaatatggttcacagacttattgtagaaatcagaaagggaaaagcggaacaagcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagttgcacgatctttcccgaagtaaacttcagatctaccgtgccaacaccatgaacaggagcatgtgacccattccccattaggacggtggaaccccgtgcaacctgataagaagaaaacaatgggatgtcagcacaaacatgtacattggccccagtatcaacccaccaattagtagactgattaactgaaaaaacagtaggtaaattaccatacccgcttccatctccagtattgccaatggtcacattagcagacttagaagtctgccctgcaggtgccttcatccccttgcgctgtggacacttcctagctagatgactaggttggccacacacaaagcaagtcctctcatcctgattaggattgttgttgttcttcttctgcttcttgaagttggtggtctgttgagctttgtatttccccttgctcttgttctgggccttgtgcacaacattggcactggactgcccaccatcgcccttagacgcggcgtccttttcccgagctttctcctcaacatcaagagacgctatcaacccctcaatggagtattcctgtctcttgtgtttgagtgcagtaccgaaacttcttcaagatggaggtagtttcgcaataatgcaccctgccacaaatttgtcgggtaagacacacttaaggagttcgagttccttagccatggtttgtatctcatgagcctgttcgactacagaacggttgtcaaccatcctgtagtcatgaaactcctccatgatgtacagatcattgctagcatcagtagcaccaaatttagtattcagtgcatcccacaactccttagcgtcggtcatgtgcatatacacctcgttccagacgatcgccaagaacgctaagaatgcatcccacaaagagagtagtggcttcctcgaattgcttctgctgttgagcagtaagaattccttcaggtttgccagtactcacccagaagcatttcatagctgtcagccacatagtgaccctgatctgccatctcttaaagtgcacaccggtgctgttgagcagtaagaattccttcaggtttgccagtactcacccagaagcatttcatagctgtcagccacatagtgaccctgatctgccatctcttaaagtgcacaccggtgaatttatccggcctcagtgcatcggcaataccagccatagtaaaatcacagcgcctataataaggtttttggattgttgagattatatgcatataatgatttaatatattccataaataaatcatgacattgcagatgtaaactagcatgaacgcatcattagatctacacatgtaaactaagagggcatcctcccttttaaggaggtccccctctcctagaataagcaaggtggtactaaactccacatgcatgccatcccatgagatgggcttttgtgattttccaaagaattaattcttgaatgggccttagcccatctattaattccaacagcttcatcgacggaatgcgtcggagaaagcggcggctccggcaactccgtcgctccgcctcctcgacccatcggctccgccgtcccccgcccatgacgctggcctccatgcccttggcctcctggaaagagtgacgggaaggacgggaagaatgacgggaaacgcgatggagtggcatggattcaatttttcaaaattttagtggcacctagtcgatatcgcgaatagtattggcatttttctaattttccatatttgcagtggcatggatctattgatccaattaacccaacccttagttaaaaaagaggagaggcgcaaggaaagcccgatggtatgcatagggcatgtgacatgcgagggctaaggattcgcagatttattttttaatagatagatatacatctaatagtctacgataatgagtccaccgttttaagtgaaaattaaggatgtgatgttttgctttttttttctcagaatttataggattttcttaatttaatggtgtgccatgtagcgaatgaggagtgtttgtaggagtccatgtggtggcttagaagtgtttataggacgtttaatggaattttagtatataatagatcacgagtttacctccagtttcagtccagaaatgcttgtccactcgaacaatcgtcctttgtctggatgagttgggttgtaacagcatgcttgcatttatggtgtaccatggtcagcaaggaactgaatagagcagtggctgctagaggaacgatttctgtccagtggtttctgtacatgccctttgaagcatggcatcagaatgcatcctagccatgaatttggtaacagctaaacatgctccagtgctatcgatcagtagtagctgcaatctctttctggatcatcagtgcaagacatactcaaggcaataaccaaattcaaaataacttgcaccaaaagagagtaaggtggatagacttacctaaatgacattaagtggaagtactgtaataattctattaactttcttgttcagaatgcaaaatgcagagattcttcgacatccataaaagctttccatatcatctcagaagtactctaattattctccataaaaattcagagatgatatcaattgttaatactttcggatgtcggcaatatcataccaattgccaagaatttcagtcaattggttgaggagcatgcctgcctgctctttcactaacatgtcatcttgctcaaacagttgctgttttcaccctttacacttgcttatccagtcatagttgccttaccagtatggcaaatagaggaacaaaaattcagcacgcatgcaagcagtcgagcacttctttctatgctttttatataagcattcgtgtatctacctgcatgctctgcaacttaacatcatgttctgaaaggcacctcaaccatgttgcacatgtcttcctcctctccactaatattaaccaatagacagatatactatcacagtatatatactctcactgagattggttgtcccctttatatttcaacacagcagtttgcagttccatcttgaatcaagacaaacacaatcaggagctagaggctctgccctctatctccaatgcctattcggctgcatatctttgtcaattctgcaaggcatgccatcaactcatcggcattcatttgtcggttcatcgcataccatcttagcccgcttttgattcacttatcctattttcttatcattgatatacttggttttgtttccttggtggtgctcaggccaagcaaccacaagtacaatcctcgctatgttgatatgtttttcctatcgacatctgcagttacagtcataggattagccaccatacaaatggaggatctttccagctctcagatagctatcctgactctcttgatgttcttagacagtaagatgttcctttcctttcttggccttgtccttgagtcaagcaagcaaaacaagcatgatcctgaaaaccgtagagtcagttcagttactgtgtgcaagcaatcacagctagaagaggcgactccccaaactccatccatgaactccattgatatcaagaagagatgcctcaaatacttagtgtttgtggtgctggcatacatgatcattattcttgtcactggttctctattggtgttcatgtacatagctcatgtttcaagtgctagagatgtgctaacaaggaaaagcatcaacaaagctctcttctcgatatcggtcacagtctcctcattcacaaatggagggttattgccgacaaatgagagtatggttgtattctcctcaaacaatggcctcctgttgctactcattggccagattcttgcaggcagcacactgttccctgtgtttctgaggttggtgatatgggcattgagaggactaagattagcaaaagctgaagagcctgacttcatgatgaacaacagcagcgcagtaggtttcagtcacctgctgcctaacttgcagacaatatttcttgcagttgtggaggttgcttttgtagccatgacagtcatcctcttctgctgcttgaactgggattctgtagtgtttgcagggctcagctccctccagaagataaccaatgcattgttcatggcagtgaatgcaaggcaggcaggagaaaattccattgattgttcccttgttgcgccagcggctttagtactattcatggtcatgatgtgagttcctctctttcaagttcttcacagtctcaggcaacaatcagaagagataacataacatggttgcttacatttcttaggtacactccatccttgacaaagttgttctcagcatgtcaagatcacaaacgaatcggcccagaaagcgacgatagaacaagcaaggggaaaccattcctgaagatgatggcattttcaccactcggcttcaacaccacagtgataatgctggtctgcatcactgaaaggagatcactctccactgaccctctcaatttatccacatttaacatcatctttgaggtgataaggtaacaaataacacttgcacacacacaattcttctcataatgttcttgctcacctccatgactattttgagttattcatcacccattgcttctgcacacagtgcctacgggaacattgggttgtccactggctacagctgctcgaggcagctgcagcaccaggaggggattgcctgccatgagaaggcgtacaacttctcggggtggtggagtgaaccagggaaactgattcttgttcttgcaatgctctgcgggaggctcaactcaaaggattccacaagcgcacgaactaggtgatgatgatcagaagcgatcagtatgcgatcgatgttctgcaagaatcaagaatgcagtgtaccatcccatcaaaaaaaaagaaaagaaaaatggatgccctcaactatgatctgcccctatgttcaaatttcaatgatcggcgacggcgcacttaccactggcggcggcggcggcggagggtgatgcccttcgcgggagtgccgcaccggagctcgccgccggcgaacagacggcgccgttgcaattcctgcaatttttcacaaatgcagacagtgaaaaaagcccctccttttcttaaaaatttaatggattaaaaaagagcacatttctccccctttaacctttattatatcaattagtaaattacattaatttaactgatcaatcacagccaggatcatgttgcatgcaagtatctagacgatgaacaggggggaacatgttctcaaatgaattgatagatgagaacaagtgaatgaacaacatatctaccaatgcttctgaagttctgaaacttgctacgaatgcattcatggtaaatgctagtcatcttctgcaaaccaagttgagcttcttcttgccaacatcagtcgcttgttggcgttttttatatgtgggcaaggcagctctggctttaaagcatctatttttgtattaagaaaacaattggtgttcatcatgctggaattatgctgatgaacaccaagagataaaatgatctcaaatctcttgcaacatcctgatacaatgggcgtcatgctcttaaatatataaagaaaatttgacacacgtgacttgtagagtagtgaagcttagtgcatacgaaaatgaattgtcctataattgctgctgcacaattacatatgaactttgacagaaatcataatgtcatggtgatggtcacatggtatatattgcttcagccaagatgaatctgtttattcgtccagaaaccagtgtcgcatcaaaatgaaaaaaaaaacaagcaatctgtgattgtatatatctatctgcatatgtttgaaaagatcccagaaatctcataaaccattcccctcaaggaactagtactgaatataaggagtatactataataaagatgaatcataatcagctataatatcactatttacagcaagaaataaaataataaagaaatagaacctaacaaactctgataagatcattgtggtatcctaaaaataacaaccaatccctaaaaaacaacaaccaaagtatccacagactgcaagcaaaagggaagaagctaactttgtgaaagcaaacccccactgtaccaaaacgatatgaacaccacaactcatgcaaaactacaagcatggaaagcatcaaagggcatcggtacacatcctgaaactcattttaagccatcactgcagtatattataaataaccatcaagtccacataaaattataataaaaaaagatatcttcattaaaataagacatcggaatacacatcacctatactatcaatatcactctagcttgcattcacccataaagcagttctggttcatgcctctcaatgtcactctagcttgtattcacctttaaaatgtcactccagcttatattcgcccttgaagcagtccggttcatgcattgggcgaacttagcatctcgggtaggatcgaaatagatataatcgtccccacacatgcctactctattgcctgcgcacttcccacaactaatgattcttgcattggtcagcttatgagtgccatgcgccatttctatgaagtccatgtcgccaccacaataattttcaatcggatgcgcaggatgcataatcctggtcccttcatattcacaataacaacaacgagcttctccaaaaaagacaataccaaaaaaaggttagcatcaaaatacaagaaagaatcattctataaattatatttaagaaaaggacacaatcatatatcaaacataccgtgttttgattttcttgagacggtacagcaaaaggatacatcatcatcatcattactgaattcagcaaagaataacttaagtccacttccaacttttggtcttgccaaaaagtttacatgtgaatatggacatttgaagtccaagaagttcatctggctgcccacacgctcatttgcaacacagattacttgaagatcatatagatatccctacaaccatgaaagaagtgaacttgtagaaaaatggcaattataatgacattatgaaaaggacaattacacactaaacatatactcttgttatcctaatcaatagggaagaagtgaacttgcaaaaaaaataaactacaatggcattatgaaatgggtaattccacaccgaacaaatcctttcatcattatcctaatcaaatcattagggaataagtgaacttgcagaaaagtgcaaccataatgacatcatgaaatggataattccatgctaaatagatactaaaaccaggaaagaagtgaacttgcataaaactgcaattattaatttataatgacattatgaaatgataattcggcgataacagatcctttcattatctcaatcatcaggtaagaattgaatatgcagagaagagcagttataatgacaatatgaaatagataattctgcactaaatatatattttcattatccaaatcaatagtctaactagagagcaatactttgaaagtagcacataatatggaatggaaagtactaacccttttccttagtgcagcttcaatctttctatgaaaaaaaccctgttgagtgacaaatttttccttgaacgctataaacatatccaatgcatctgtagacagatcaacaattgtctccaaagatttagcagagatgcagtttgaagatggcaacaacgtagctagctgaagaacatcattcgaggaaagtggggtagaagcacgcaatagtgatttaacggcagcctgcaccttaggtagagattgagtggaaaactgtacataagcttcgggctcaggatgaaacgatgcatccgctgcagccttgtaggcactgacatcccagctggatttccacccttccgctcctgccatttcaattgctttgcgaactttcagattattctttagcagatatatcatggcatcatgctcagaaatctcaggaatgcatgtaagcaatagcttgataaggccacgaagggaccgggactccacacgaacaaaggtggaggtgcagatcatgtccacctcaagtttctccatagcagggaaagtagagtcataccagagagtgttgacgatgatgttggtcacacaactgaatgggccatagcagtaaccaccgttgacaagggcacggtggtaagtggtaacgagcccgaacatcttgcataggtaatcgagagattgccttgaggtacttggcatgaatcttgtcaagtagaacagcccgaagtgatattgtcaaaccacctggcaccttctcacaattagcatcaccactagcattagcatcggtatggcagttacgaagccgccgttcatcagcaaaaatcattggattgtcagacttgtcaagcatgcgcggcttcttcttcagcattccagacagcaacaagatcttctcaacagacaatacatagctgcgatctgctagcacggtctgggtgacgaattcaagatgagacgccagcgaaaacgaaccagcaatgaagccgtcgacgtcaggctgcctcgccgatgatgctgcgcatgtaagggcagccctggcagcgtaggaggagatgtggaaccgttcatccttggtgttgtagcagcgatcaagctcgatgaggcggacggcgacgaggaggtcggcgttggcgaggcacaggtagcggagcgcatcccaggtggggaggtagcggaagtaagatgtgaggaaggtgatgaggccctccagcgatcgctcggcgatggttcgtgtctccggcggaggggagggggcgtcgccggcggcatccgacctcgctgctgccgatggcgtcttgatgcttgccttgcgcttgtgcttcttggcccggtgatcgggatcaggcttgtcggggaggaaggaggagagggtgttggcgatgatgttggtggtagggtcgccgaagccgaagcagacgccggcgccaacgaggcgcggggcaagctccggcaagtcgtcgagcggcagcacggcgagcgcctccttgtagtagccgtggatggtgcccaaaatcacggatcggttgtgggcgattccatccgaattgccgtaggaaacatccggcctcccgctgcgccgccgtcggccatccatcgccaggcggcgattagggtttggcctcgacgggggatttgatttgatttgatcttttctttttttttccttttcttttttcttttttgtcctttctccctcgccccatccggcctaatctccactcgacacttggacagacaaggtaaagtatgacagagagtgagtgggcctaaactgggacagattcgaggaataggagttctggatgggaataagttcactttgaacctcttaactagtgactgaatctgatccgtattctttaattacaataccggatatcttgaccctctaactattaaaatcggtgtaatttaactccctcgatagctttggagaatgatttcgctgacgtggtgtctatgtgccagtattgacttggctttatgatattgacatgacgcttaggtggcactacaattaaaatgggacatatttgtcattaaaaaagaaaaaatgtggggcccactggcatgtggcccccttgtcatcctctcctcgatccttcttcctcctcgctctctcccttctctgtctgtatctttctctctctttcgatcggtcgcatcgctgcctgccaccgagctgcgccgtgctgccgcctgttgctgccctctccttcaccttccgccgcatggggcagcacgtggatctcagcggcggcctgctacgggagcttgagctcgtaacggctccaaggtgtggcggtgctacgcgctcgtaacggcatgccaggaggactgcgactacctccactacctgctcctcagcgcccggatggccgacgagctccgcgcagcacgagattgacatgtacacctgcctcatctatctcatctctctcgtcgacagcagcaacaataatcgtcgtgtcacagtataaagcccttgtttcaacctcctctagtaataagataatttgggtggttcatctcaaaactgaagattatggcgtatgaagatgggcgagcaattactaatctcttttatgatgattcatctgatcgaagcgatatgctcaagtgatcatgtcaatgtttctgttgtgcacttgtacttgaatttctcctttgacgggagtgggctccatcacacgacggtgtcgagcggctctcccaactccatcatgttagaaaatgatagacacataaaccataaaaaacaataaatcaatcataaagacataagatttaacatggaaaacccttctaaagtaggagagaaaaaaccacggtatcccaaacctccggcgacgggcctccgcttcgctccatttaaagctggcctttattcgtgtgcaaatgaatttggattacaattcaacacttccatcccattaactcaatatttgaaactttttactcggattggaaaactttcaaatcaagattttaaaacttttaactcggatttaaaaacttttgactcaagatttatttaatctttgagttaatgtttttaaaattcgagttgagagtttcgaaatttgagatgtaagttttgcagtttgagttcaaattttaagctgaaagtttcaaatagaagtttttaaatttgagataaaagatctaaattgtaaaatacattaaaaaacagaaaaaggaaaaacatgcgctggagattaaaaaaatcatgaaaaaaggaaaacgcaccggaaagttggggagcgtgcaaaaacagcaataaaaaaggaaaaatgcgcagggtaggagcacctgctggcacgtacacgctagatagcaatcctctctcctcatttagccaaatcgcaagcataaacataacttataaaaatcaacattggcttcatgtacatagaaccaccaccatcacgagataacgttgccaaaaatattgatacagattaatgcagcaaaaaatacttatatttcagatatgaagctagagttttggagttttaaaaaagtaactgcaccctttgtattttgtggagtagattcacccatgttacttttaaaaaaatgtggatatttggttcggttcctacttcatcggataaacatgccctcatgtggtagatgcggcaggagtaaaaaaagaagaagtaaaagaaaaaactagaaaatgcagaaaaacaagagcagattattatgaatcttgacgaaagcaagggaaaatctaaaaaaaaaaatcatgaaatgatgagcatacatatactgaattttgtcacgaccacatgtccttatctgaccagtgggcccacgtggcatagagagagagagagagagatgcacttctttccgcccgttagacagattccccccatcgttccaactccctcaaaccccttcccattccggcggctctccccgaaaatttgaaatcgccgccgaaaacccccccaaaaacgaaaccgactcaaaaaaaaaaaaaatcccccaaatcgacattcctctccgcggatcgatcggccgcgaagatgccagccgccgaccccgccaccgcgctggcgccggcgccgaccccgccgccggcgcgcgggacggcggcggggccgcggctgctgctgctgcagtcgccgccgcccgccttcccgctcggctccaacgacgaccagctcgagcgcgcccgggcccgcgccgccgcccgcgcggcctccgtccgccgccgctccctcgccgcgtccctcgcccccagggcggcggcgcagcagcagcacgacctcctcaaccgcgaccaggtcatggacctcttccacaactgcatcaagctcgcctccgagaacgtacgcgccttctgtaccttaccccccctcgtcgttgttcttccccaccgccgcgccgaaaccctagggccactcgcgcgcgcctcgtattgagttcgccttctttgtgtttttgttttttccccctcttttccgatggggaatttgagcagaaaattaaccagaagaacacgtgggagctggggctcatcgaccacctcagcgagatcatccaggccggggaggaggacgacgacgagaccaatttccagaaggtgcggctgtgctgatttcttccattttcgaccttctttctactactaccgtgggaggagatttgtgacctcttctgacttcgattgagaaatttttttttaaccattttcttgtgaccaggctagctgcacgctcgaggcgggcgtgaagatttactctttgcgtgtagattcagtgcactctgaggcgtacaaggtgcttggaggcatcaaccgtgctggaagaggcgatgaggctggtaaatacccactagagtttcatagcgctttccaatttttactgtagccattcgattgtaattcgattttattcatgtgagtcagcttcgagttgcaaaagtattattagtattctgggcaccactaaactgtttcagttaaattcaaactaagtcaacttacatgatagaaatttggctttgtaccaaaaaaaatgtccatctataaattgatcgaacaataaatagaaagatgttttaagattttttttaagaaatcaagtccctgtgagaaatggccttttctgacttttggttcattggagcactcttcagttttcacgatcatgctactactgtatctcaaaaccttagatgataaatgatgcacgaggattagttgaattgcatttgatcatttgttttatttgttaggccgtgtttagtttcccccctattcccaactttccatcacatcatatcacatcaaaaactttcctacacacataaacttctaactttttttccaaactcccaactttcttcaaacttccaacttttttcaggaactaaagacacccttaaggtaaaagttaggcagtaattctgcaaattatcataaatacacctttgttgtgcctatagctttcccttggtaaatgcatgctgcttcattatgatgtcctgatttggtgttttattttacttaagattcagaagaaggtagcaatccaaagcattcacaagaaggtacaaacaaaaaggatgcagataggagggtatgcctatctgaattggttactgttcgtttttccacttaagttctgcttggttttttttctaatagcctagtgctgtttcatatgtgcagatatcacccacatcaactttggagtcctcatttgattcgcttaatgtaaagaagtttgatggtaagctccaagcagatcttttaaaaacttttttgctttgtgcttctgtcgggattactatcataggaccaaaagtttaaaattgtagagtataatattaatttattgcactttctgctagttgccttcacggttgatcctttgtaccatcaaactaccgcgcaatttgatgagggtggggcaaagggtctcttgtcatataacctcggagtatatgacagttgccgtgtgctctttgattcgtttgaagcacctgacaagtgcatcttaagtgatatgcaaactgagatggctgagttgattggtctttcatttgctaaaggtatgattgtcaatctgtttctattctgctgtctatgctctgcatttttttatttccatttaaggttttgtaatggtctactcttaaacagagcaaatcgagcagatgataattcatatgcccctctgcaatgatatttctcctaccttgagcaatatagtttatcagtttgatgatgaaaaccgaagaccacctcatgaagcaatttctaggcaaattccagtgatggaagatcaggtggttgacggtaatgatgtggcgaatgatgacatcacacaaaatgatatgcaaaatgattgtggaacttgggattttggaggttgtgatgatcaagagagcgtgtatgatgaacactgtgacccaatggatcatagctccatgaacggtcaagaggtacttcctgcaaacagtaaaacctagacacattttgtgtgtggttagagcatgcattttttgggggttgacagcttttgttcttttcttctttttatttcccaatgtttccaattactggagttttctgcgcagtttaaaaatctatgagaattgacattaaatgaatgtgagaaaacattgattaatcatggtatcaattaatatttttttaagataaaagtcaaattgagtaactttgtaggatgcaatttgatgcctattacttatccattcattcaccatccaatgacatttctttgattgaaatgtctgaagtactcagttcaaattatggtttatttgtttgttttctgaagtataaatatctgagggtatatttttttgcaggaaactgatgagtacacttttgagtctgctgaaggtcttgatgtaaatgaaagaattgacaaaattgcagatttcttgtcatttggcatgggattctctgcaaaaacaaatgcctgggcaggacctgagcattggaaatatcgaaaagctaaaggtactatgggtacatagtcctgttttagttttgtttcaggcaggcttgtttaatctaacctttgggcttacattcaactagatttggaccctgtcccaactaaacctgatgattcagacgccccaaaaaagacaaagaagaaaagaggcaaggatgaacctgacattgatttcagcaaagcattggaacatgatatgccaaatatctttgcacctcctaagaattcaaaatcattgctgctgccggcaaatagggctaccagcaataacaaacttccagaggattgccattatagacctgaaagccttgttaaattattccttcttccggatgttttggtaatggcaatttcttataatttttttcttgatatggatctggggtggttatagtaactatggatctttttgtagtgtctggctcggagaaggaaaaaaccacttggtaagttttctatgttcttgcattgtgtatttcacatgaagttttcttgttgccttgttattatatcttgaagtcctgttgtaaattctgaaggttcttaaattatttatcacatcttccctgttcatattacctgtgttactttcctccagctccttttggtatttgatatatgggttaattggattcatgccattgcaaatttaccgtattagaaaaataccactactattcgtgatatcggctgagtgccattataattttgtaaaattagatctatgccatcaccgttatattttctgtcagactctccttcctttcttctcctctcctttttcttcctcttcttcctctacctgctccttcttctcccttccactgctatttctgccactgctcctgctcctgcccaggacgtggacagcgaccaccaccagcagcagctcatcttccccatctctctccactgctattgctactgctgctgctcctccccaagaggccaaggcatgagcggtgaccaccaccagccgatatgacgaataatagtggcatttttctaatacaacaaatttgtaatggcatggatccaattaacccttgatatattggtaagttcatattgctacttaaatacttaaacgaaacaatctgtgaatcgtatgatgttagagtattattatctgaaactgtggaatgcaaataagtataaagttcaggactgggtttatttatagagaatgctctgcacaactccaagaaaggtggtaatgtgatacttatgttggctattaggtagcaaattgactttcccttttcagagaagaactttactattctcatactagattatgtctgtttgctaatgtgtggcaagttgatgtatgtatggacagcctttgttcttgttaatgcctttctatttatatagaattgttttcctacatttgttaaccacagaacacctttgttctctagtaggtggttcaagggagaatactgatgacttcatcccatctgaaccttgggatggtgatgatttttgtaatgatcatgtcgatgaaggaaatggtgataccgatgtagaggatgcagtagatcttattaccaaaccaagacaggtgcgctccttttttcttttgccttcccttgttagacattttggttttgtgtgcttatattggagtctggttctgtattgatatttcgatgggcgctcgtacaaagttgcaattgacaccatttgaaatactaaagctggttagatctgaatgtagtaactaaaaagcactataacatcagaataactttacacaaaagaaattgtgtaaacagaatgcagagataatagctacctttctagttttctagttcttgaactagacaggtagctatattttgggatggagggagtaattaattcaagctttaacattatgtatattgatgtctgtcccataaactttaatttgtggcctcctagaaagcagaatcacatgcccatcaatatatgttaaatttatgccaagtcagtgcagatttaactcttatactttgggtactgaacagtccctagagttctgttatattttctgtacgacaaatggtgttttgactcccctccaaaaaaaaggagggcgttttgactttttgcaaatgtatagggtttacatgcctgatctggcttgacatgagttggctgttcgtagtggtggacatctatgctgctgatttttatggcacaataaatgtatccaaacaaacgataaaagtgtatcttgcaaatttattatgcatttacaccttacctatactcaggagcttctattcttgtgagcttagaattgctgacctttcgacagagtgctctgccagaggacttacatgaaaaaactagtgatctgaataaattattgtaatgtgtttgagtttttaagatgaccttgttttttttttaatgttactaacttacttggcctggtaaagtctgaattaatacctgtttccttcctaaatcaaaggtcaacaagattgatatacaatatgacaaggtatcaaaacaagtcgatgttcatgccttgaaagaagtgctctggaatcacatcaatacatctgctgacactgatgacctggtaatatcttctgttattgctaaaaattgctatctgaataacactaatacaatattgttttcattttcgtaaatagaatagcttaaaatgtaatcaataaaacacgtatgtttgttatttggttaatcttacccgtgacatatatgattgacaaaacttaaggttttattgtgctacattatatagtacagggtttacacgtggcatactggcatatgctttacaacatctagggacttaaaacggaatattaacaactatgctgttatcatccatactgccacaaccagctttctggaaactatttgtttatattcttttggtaaagtttatttttgatgtcgtgtttgatattttttgtaatatataaaatgggtagaaattaattaccagttgcaactgccaggacatggataatgaggaaatgattattatttatacttgaaacttgaaagtcaagccagttttttgctagtttctggctttcctcaagtataactaataacattgtgcccacccaccagacacaagtttggaacttggttaatattttgataattcaaaactaatacctgtatctgtttgctgaaaataagtttgttgcaaattgaaatgtttcaagagccctttattgctttgttatcctagtttaatttgccttggaaaattttcatgaagagtgtctaggaggatatttgtgaactgtgatactaacaaacatgaaaaatttgctttaaaaaaaggaatatctgtgtaattttctttgaatatatcgaaacatcaatatgatagacttgatactctgaaattcgaactgaacctttctccctaatttctgttgttctatattaatatgttaacaatattgtactcggttaaaatttgttcagcaggaagacaaggacacagaatcacccctgtgcctatcgaaagtattgcaagatcttccaagctgcaaccctgatgctgcagcaacagaaatttcaccgcacctatatttcatttgcctcttgcatttggcaaatgagcacagcttgaccttacgtgatcgtccaacattggatgaaattgacatatacattcctgcttcatctctcgtgaagtaatcctgtagttcaatatgttgtgcatgtttgttttattttttgttggttagggacttctcgttctcggtgtattattagattgccttgtatgttgaagattatgtattatgtaatgagcagcagattattggattgcgctaagctaatatataggtaacctatcatttactctagttgacctaatgaactatatataaaaatataaagtagagaaaatggttgttttgccaaggtgattcctttgtgacagtactccaatcatcactatttgatgtttgtgataaaatttggttaaatctgtacatcaattttattttttttctcgaaaacgtaagagaattgcatttcatttcattagggaagaaaaataaaggaaaatgtaaattaagtacatcaattttatatagaacaaatttacaagatctaattacttcatgatgtactaggacttttcgaggcaaatgtgcctgtaacatctcttttatttctaaactaactatttgagaaattattaatagtttaaattttaaaagttgaaccaaatcttattttatatatcaaatattcttaattggatggagtatatttttttttataaccaaccgctggcctaagtatattaagaggagcaggaatttacagttttgcttagagcactgaacaacagagcacctacaacttatatccagggtttaccaaaccttatagggtataaggtgaggttaccagcatcccacgatttagcggttatcgtgaaaaccatgtggttaccacaaggtaaatcgtgtttttaaaaacttagaaggttaccgcacgtgataattacgataactgtacggttttgtaaaccttgcttatatcaaagatagctttctaggtacacacaaatgaaagctgccccgatgcatttcaaagcgtggcgagcaggcccaccatcttccaagtttcccgttcatcctcgacctcgatagtcgcacacaatcttgctggtgaggttgcttgtccttcgaaaacacgaactatgacatttctaaacgtcaaacaaaatgaaagattgacatgctacatccagaacggctgaacagaagaacacacgttcgagaacagaaggaaactgatgtctagccagtcactaactaattaatatatcctgacatgccgacccttggaaatataccaacgtactgcatttatgttaattgcttactacatatatatgccttgttctaaagaggaacaaacatttatactacagttcagatgtaccggctactatttgtttgttcagaactatttaaaaaaggccctatcaacgaactagccgcccaaaatcgatggttttttcgtccaagcgagttcaccggaggagacgaggccaggaggggccattcatccattcattcattcctctccaatgtccttttgcccggcgaggatccttgagatctggaggccacggctgaaggcctggttgaagagcagtcgtgtctggaactcggacacgaaggggaaccatgacaagaggccgatggggaggaagaggacgagtcccatcaggttctcgtacgacctcccgagctccatgatggaatcccacagcattgccttcttcaccaacggcgaacatgcctgcccaatctgtggatgaatgacaagatcatacaaatcatttgggtccagattacgatgaacgctaaaatttatctttttattgagaaaatggacagggttttatatttgttcttggaattaagttttatgcttacaaaaaaaaacaaataagtggtgcagaagggtttcactcaccagaagaatgcaccaaccagtaggcatgaacccaagaatactagcaaaaacatccgaaattgtgaggttacaaacgacgaataatacagccatcacagagacaaaaccaaggaacaggaggcccttgagaatgcggaacataagctgcagatctgttccaaacttctgtcgcccaatcgaaaccatctgtatggaagaaacaacaaacaacaggtaagattattaatcatctgaggtagtataccacctgacatgctgtagctttacctttagaactactaggactgagagcataaccagccatgacaatccatatacctagatattgaaaagaggccagtaaattaaggtatatatcctgcaatagtaggaactatgaaagtagcaagcagaacagattgtgtttagatgaggtaccagaatgcttttgctgcggcgtgctatgttcagatggtacacaataccgtactgatagatcaagaagcggagcgaaagaatgatttccaagaggagagagcgaatgctagtcttcctaaggtgctcctgctcacttatccaccaagcctcccagctttgatccacagacatgccgatacccccacggttccccatccacttcctccaatctgtccagtcatcaactgtcttctgccattcgaagcatgacggattgaagataaagggtgcgaagagccaagatgcaaccaggaaccatatggagaaggtgacaaataggtacatgcttgagctgcggtaggaacttccatacactaaataaaccaccagaagtatcaacagttcaagtcctttaacaaagtggctgcgggagtacatgcggtaattgtcagcaaactttgcatggtagacaacaaatccacgacctgtaggtctgtatttagccccgccatgcagtattgttcttccgtagtagtgcgttttggtgccaagctggaatgtgaaaaacacagatgccagctgaagctgcatgataacaaactctcctaatgctgtgcggaatcccttttctaagccaacttccattaccatagggagaacaagcagcaaacctagctggaaaaaagactgcgaggccagtgcgttttcaagaggcttaatgttctgctcgatacgtggatccagcaaaatagacctttccagaccactcataactagatataacctcccatatagaaacacataaactgtaagtactgtaacctggataaaggaagaaggatgtcagtatcccaaatgccaaagtgaaacacattgtaaaaccatgcctatactctcaggctgaccaaaatatacttcatatttatatactaaggaactacagcaagaatggccaaacaaaatattttctttacatgaaagactttccaaatcttgatgattttcaatatactggtgactggtccatgaagaaacaaatggctccacgttagaccatctggtagaggaaagatgtcctttttgttcttttgtaagtaactttctacaattttagtgttatacaatttttagtagggttgattctcaaggaagattatgtttagtagtgttatacaagacagaaatacctttttaggagctatcaataatataaacttccaaatgaacatgttcaattaatattcttaccatgctactaaagtaaaacccaactgtagtaaagtagaaggatagcattctataaaaatcgaatctgcgccccagccgatagatatcacgactcaatgtttgttcaccattgccatttgccaccttagcttcaaagcttgaaatttgattcattcccacatcacgccccttaccaacttgcatatactcatgatgtgtgacattcccttctctcattgttgaattaaaacctataagaaaattgcgtttcagtaactgcatgctaggtaatggatttgtaaacatgtatgagatgcacggcttacctgaaaatatatcttcacttagatttatagtctttgaggctttacttatgccacctctagtaatatggaagagtctatcgaaaatatcaggatgaccataatggaaccgaaccctgtattcatcttgcaataatgagttgtagacataaaagcacaacatgataaaaaatatacagtcataaatcaatgttaaatgaaacaatatctaaccatgtggaaactactcaaatcttagtgaaccccgctccatgtcataactgtttagttacatttgtagaatgatttccagaaagctaggtctgactttatttttatagttgtgtaacaaattatcaaagcatatttggtagtttccttttccagttcatactaacacgggcatgagccacttatgatttccaaacatgcaataaggattgtgtgaaccaattgacaaagctatttgcgatcaaagtaagagtaactccagatacttatcagtgttttatggaaacaataaaagattttaaaacaattttcagataaattgcagttagcaattaggccaaaagtctactctgtctaggaagatgtggaacttgaatactggtcatggtctcatgggtataacagtcatgggctcacgactagctctttttatttggtcaacttattactaacaacacttcacaagttttgttttaattagaataatgagcttcccagttcaaaaatcctttggattttttcacagcacaggatatacattctttttgaataaggctgccatgtgcagaaattacaatgatggttagttgtttatttagctttaggaggtaagtggctagaaataagacgactggtcctttcttcttgaagttttgtgccatttgggttttgggagacgatggtgtaatttgctatgccttttgctgtcaacctcttccacaagagttttggtgaatggagagcccggccaggacattgctcactgtagaggcctccggcaaggtgaccccttgtctcctatcctttttatctaggttatggacgcgttgaacttagttgtggcgtgtgcggatcgtggaaatctcctggagcctctcactatcccgcgacagcacaccaggtttctctgtatgcggatgatgtggtcatgtttttgtgtcctacaagtggggacctatctcttatcaagcagattttggagttttttggttagatttctggactaaggaccaatatgatcaagagctcttgcactcctattcactgcttggaagatgatctggaagtgatttctaatgagttgtcttgtgaagtggcgagcttcccttgctcttatctcggacttcctcttacaatccgtaaatcaaccaagacagacttgttgccccttgtggacaaagtggcagataatttaccgagttggaaagcctctttaatgaacagggtgggtcagctaataacagttaggtggtcctcttggctattcctatttatgcaatgatggcgttggatcttcctaagtgggtggtcaaggctatagataaaaggtgtcgtggcttcttatggaagggaagagaaaatactaatggaggaaattgtttgatctcttgggatcgtgtgtgtcggcctttgtcctatggaggccctggtatccctaacctagaaaatatggggtgggcactacgcctgaggtggttattgtttcaaaaaactgattttgctagaccttggggcggtttatctattcatgtgtctcaatgtacgttctcttttcaatgtggctgtcaaaactatagttggaaatggagaaaatactgaatttggagtgataggtggctgcaagggaaaacagtagcagagctggcgcctaatctctttgccttgatctctaagagcacaagcaagcaacgtactgtggcgcaggctttggagaacagaagatgggcggctgacataaatgggggctatctgttcaggttcttaatgagtacttgcatagatggccaaatgggctgcccggcccagcatggcccaggcacgaccgtgcctgggctgaggtaagtcgggctggcacagccagacctacatgtcgagccgtgccgtgccaacccacgggctgcacacggcccaggcacggcccaataagactcgggccgtgccgagccgtccgaaagcacgacaacccatcattcttcttcacagaataagtctatttttgctcctcaactcattgggctgtgtctatatggctggaaaataagtctattttgtattcctattctctttgggccttaccttatatggttgattaagtctattttgggtctctcttactttttttcttcattcgcgccaggccgtgccggcccatcgtgccgaggaagcagcctaggcacggcacggctgtcgggccgggccggcacgggcatgaccctagtcgggccgtgccatgcttgggtcgggccaaattgtcgtgccttgggccgggccattgggcctcgggccatatggccatctataagtacttgaccatttgggttttggtagaagaggtggttctgctacaagatgtacaagatcagcatgtttggaagctaaccgccgatggatgtatacttgtaaatctatctatgaagcttatttcctgggatcgatcaagtttgctccatggaaaaacatttggaagagttgggctcctcttcgctgtaagttcttcatttggttggccgtcaataagaggtgttggacagccgaccggcttgctaagcgcggactgcagcaccccacggcctgtcccttttgtgatcaaagtgaagaatccgtccaacacattttgatttcgtgtcttttctcgccaagtgtggatggcactgttcttgaagctagggttctctgatgcagtgcctcaaccttcagccgatcatttttttaggtggtgagccaagctacaaaagaccggccaaaggacgtgcgaaaatggctcaactccttggtcatcttagtggcttgggagatttggaagcatcgcaatgactgtgttttcaatgggcgccaatcctagtattgcgacggtcttgcaggtggtagagaatgagggtaatctttggtgtttagcgggggcgcctgccctccaaaagtttcttaataggtcggcaaacctaagcagctagagcttgctggtgttggctggggcgtgtgggtgtgttttttcggtaggagggctttggatctcctactttgtatatttttttctttatttcttccccttaatgaaatgatacgcaattctcttgttttttcgagaaaaaaatagattttttagatataagagtttgagatgtttggtttaaggatagagttagagatatgatttattacttcctattggagaaagttgttaggggataaacccctataaaagttagagacgagccacatcaactattcacattaagcaaagaatgaactaatctagttacatgctcaaatcactcatcccaatttatagtattccctcttcacatgctagcaccacctggctatcctgttagtggtgtctatcaatgaatgaagggccataaaaactgacaaaatttaaaacaataatattagaactatcaaaactgttcataaaaagatagtggtttctggtgactgctgtgggcatagtgatgtggtcatgtgactgaggctgaaacaacttttcaaactagctaatgactttttttttatttgatctatggattatttgttacttagataaatttgctacaactgaaataaaatataattgaactgccaaaagagtatttctaaacaaaaagaagccactgtttatgagataattaaattttattgacctctacaacaaatgtacccaggttctatatattccattgtaaatttagatttttagaatattttgatatcatttactaatttttaaaactcaaaacataccccaaggctaacaagatatttgcatatgtaaaactattaaatgattcagatcaattctaggcgaattctcagttgcaccatagattatttagagccaaaacaaattcagccattgcaaaggaaaaaataaagtctatttagctgaggtaaaattatttttttaatcattaaacactatttattgccatagaattatactttaattcacttggatcaaatttatcaatgttataattaccccatagagcaaatgagaatttcttttgaagtcattcattagtcgttgaaattcagaaatcaaaagtagttttagctttacatcatgtcccgcctgaccgagaaaagtttaagaaatgcacggtgttgatagttcagggttgtttctcagactgccgtgacagttcaaggttgtaaattgtattttttttccttaccatttgacattttgtatcaacagagtattccatccatactaggttacaattacttttgacatattaagaattgggcatagtacttatccataattgatctgttttgtaaaatacttatgtaaggatataatggccttttatgcatgattgcctcaagataaagctgaaatgattttaaaatggttctcacagtactagttaggtaaaaggaaaaaatatcatcaaatactttttaacttttaaatggatgacgcacccaattcaaataggttaccattctgatgaaatgcatcagaaaaaaaaatccttaaaaaatccttctaacacaatgttaaaatgaagatttacatacttgagaggattagccaagactcgttgcccaatggtaacaaaactggtctcttggttggacataaaccaagcaagtgatgaaacactaaaatagaaaacaaaatacagaaaagggttactaatagatggcataaacaagatataattgaccagaattttggatagatacacatacctcccagtaaaaatgtgctcacggaggcctaatatagtgggttttctctttccatacttttcactctcaaactcctccagcacatttctcattttaaatgcctcttcgaggtaattatcctacgagtaaaggaacaatattatttttgtattgtacatgtaaaaatgtgtgctagaaatagtttaggtcagtcccagctggtccaacgcagttttgtacagtttgtacatgtatatattgatcatttgatccatgactaagactactagtgtttctcccccatatctaatatagtaagaaaatcaacatattgagttcaaaattaagctagcaaaatttcaagacaccacaatgtctactagcaaatgagcatgatttttttatagtgtttccctttttgggtatatgaacatgattctgtaattttcttgggcagtgacacaattttgcagtgtgtgtcagcaaaaaccaacaaaatgcagtgtgtaccatagccattgtttgcaaaatattatccaaagtgggtcataggggaagaccatgtatgatcccaatatacatactttgtccatatggctgagttgagcctgggcgtgaggggctgtatttatgactatttgtttacatttctcaacaacttcagtgaaatagtcaacataaagggtcttgaaaaataaaatgcggaaatgagtatacctgattcatatcaatggcctggagtgcctctcccctggtgaaaacaatggcatggttttgattttcaggttttccctctccaatatctgtaggtttgccaggaagcttgatgcgataaatttcctaaatcaggtttaaagcaccatgtatgaattatgccatagaactaaacacacagaacagatatagtgagctgttgaaaaatgacgagtaggtattaacaacttaagaagtgcgcatgaaactacaaacttcaatagaagtgaaaaactttatatatggtgctcatctagaaaagggacatcaatatgaagtcttctaccttctgaaaattttaattgaacataatctttgtaaacatagttccacaaacgcgtaaagctctctgttcaatgggggtacctcatcatacttttcacctcctttgacaagaacagaataataagtcttctctgttgtcccattaccagctggagcttctacttcatcaatataagcaacacgtaacgatgggtacctgtccaatttaaatgtcagatgggttgtagtaacattattatttatgatatagctttattaggtcacaagcacttggtttttatacattaacatgagattaaggatgtttaaatagcaagctttgtctttgggatccttggatgtcttttgcattccatagacttgacaagagacaacataggtaaatttgatatcagcaattgcccgtgccatatcgaaactggcccacccctgttgagaagactctactgttctacgatgttccagtttaactgcaaaatgttaaagttgagtcaacaaatatatagatttacaaagataggaataaaaacagagaattaaacgaaccaatatcagttttgtcttgaatacactgaatctcaagtgctctgcggtagtacatcattcctcttactagtaaagcaaaaagtaaataattagacagtatgttaatatgtagttaatgtgccacacaattgcatattggtgatattaccagttctggtgagtgtttgccccctataagatgcccagggccggatttcatccatctttgttttcagtgattcttcatccgttggttgaaattctatcctctcaagaaaattcttccattcatctgtagcatgcaacaggtcatgaatgatttactgagagactttgctccaattgtgagatcaaacacgtacagatacctggatatattttccgtagatagaacagtatggatattccatcctcattctttttataaaggtcttctgctgaaaagagcacctcctctttgaagtagggagttaaaacactgatgcaaaagcagaaaggctgtcaatcaaatatacttttcagtaaataattactccctctattttaagtcgttttagttttgtcctaactccaacttttgtaacttatatggagtttatagagaaacgaaactgatgttgtagatgttggtgcatttttctataaactcgatcaaagctacagaaattttacttagaacataactaaatgacttaccatatggaacagagggagtagtatcatagagcagaccaaagaaaaagggtacagtctattttgagcccttgaacttctctcaaaatccatttctcaccctgaactacaaaactggtgttttttttcaagtcaactttcaaaaccggacaaagaacacttcgggacatatattttagtggttttatttgtaatggaggtggtttttgtagttcatacccttattatgcataggcaaatgtcacttagttaggtccacaaccatgaaacttacctaattgaagttcatgctagcaacttgatcaaaacgactgtgaaatatgatttagggtgctatatgcttggttctgaaaattgggggtggaaagtaactggttttgtgttcagggtaaaaaatggactttgagaaaaatttcaagggccaaaaatggactttaccccctcacaaaaagaaaactacattgaccttggcaaataattatggagattggagagcacttatgtgccaaaaagtaaaaggcaaaagacattcggcaacactggttggtgaaagaagtggagggagagttcggtttcttacctaaaggacatcatactgcggacctgtggagcctttggcattttcatgaaaagtgagtttgcaaagaaagtgatcctgcgacgagcatccaagtttgtaggtacatatattgcagattctttcgttgtcaataatagttgaagcctaacacactgttaacacagaatcccaattcataatgagaggacatcagtacttgtaaacttatggtagaaaagaatattcatattgaaataagttgcttggatggacatataaccttctccttccaagttttatcttttactgaatccagatttatatttgcaaacaattgattgtttctgttttcatccttcaaaatactgcatgattggcaaaatattggtgaaaaaacaaaaaaaaaagaactcttgactatgcacacttaaatatagatcttacccttgtccattcttcataatatcctgtgtgatgatttccattatatcttgtaacaaattggcaatttgtgtctttatcggttcaatgtcttcatcagttctctgcaaacgcaagtgatcattttttggagaagaaagaaaatgtggtacagagaacatatagtcaataggatacaaaggtatgttatcagtaccaacaatagatttagcagcttatcaaacttagcacttagctgaggaagttcatccaatcggaactcttttacaagtgactgacgtcttatgctatcttcaatcctatcatgtattctatcaacaactctgcgccaatgaacaatgcaatattaattaaattagttagactgataaccatgctaaattaattttctcagaataaacatagactcaaacataataagctgaaaaaataaggaaaggaaagactactcacttcttatcactttgttccacaataaggctgtctagaatactaaacaatgtctggtagcattctactacagcataataggtatatggatcctgatttatcctctttctcaattcttcatccctttttttgacactattagccatgtcaagtgcaattggaatctggaatatcgtagtcatgagcaacacagtactgcctctccaagaaaatttagtagttaaataagggaatatttgagtagtgtaccttactagcgagaaggaaaggaggccactgaaaaacagtagtatcacccatagatgatggaacaatcagtaaatttctctccctagaaacaaatcaaacacagtactttaaacatttttgcagtattttttaaaatttttaaagtgtcaaagaaatggaaaaaacattaacaccaaatgcaaacctattgcttattaagtcttcttctctcaaagagtgaataaatgcattccatatgtcagagaacttgttaattttgtcttcctggtgaaaagggttatcataaaaacaacagcagtaagtaagctatcaagtaaactaaaaaaaagatttctagtataacgttttgcagaactgaacctcatgctcgtgtctctttggttgactatcatgtccaggcacaagatgtttgccaaatgctattggaattgcctcgaatcgtgatcttaacattccaagggtccggatctgcaggaaggtaaatactctgcaagcattagtactcttaacagcaccagtactcaaactgtacaaacctttatatgctacaaagtaccaacctcacccaagcggctgaaggcaccattcactccaccacatattgttgaaaaaatggcataccatatttgtgtgtccatgaagtatacctttataagaaatttaattaaacagcttggtaatgacatcgagaaagaaaacccccctaaaatgcatgaactgatacgtaccatgacaattggtgcccatacagtaattacaacacctaaattatgctgcactgggaatattcagcatccaatcagcacttaaaacatcgttcaaaagaattacatatcatctgtgtactattacataatcttacagtatggaaagaactcatgccatgcgtattgccctcgtcccaagaacataattgtcctcgttggtccaacgagaggataaatctgtgaacagtaatcacaacgcacagattatacaaaatctcacaagagaatatttgaagtttcacaagagaacaaactacaggcacataacaagggaattatagaaaaaaaaaagtgttagttaatccactagtcctgatcctgctcctgcctagtgcaacagataaatttagtctaaaataccatttagcttcattaactggagtaatcagttagcaatagatgaaggggattaaatgaggaggcttatttcaccttttattattttttcaagtcttggttaagacttacagaaggataagttgttttctctgcattaaaataactaggcctaattggtcaggcctcacttatgtgtgacacttgttgggaaatgttcttttggtgaggggttccttgaccccttctttggaaatatttctctgttcttagtgaaatgaagcgcagttctcctgtgtttttgaagtttttactctacactattacataaaagagaaactctacactacatgttaattccaaaccaaacacagcgtcatgttttcatcctcaggcctaaagtgctaagagaacagtgtgttctcaaaacacaacaaataaacagtctaaaatttcctaaaaataagtctaataacaacattatctagtcatgtccaaattgagatagtacgttacaagtcccaacctaatgtcgtcactcgtcacctcaaataaaggacacatgtgagtatatggaatcaaccatacatgcctatgcatccattattaactagtatatgtaataccagcccattagacactagtataggcctgtgtggcccatgtcatgtagcttttgtgggattagttccatatgagctaagataggtgggtgccatcatataaatccacacattccaaccatagcacctcaagtttaccctttctttacacaaaacgagaacaaaagtgtaagtgaggtgcatgtatacatatgagcccatcccataagggctggccggtgaattttgaaagctgggctgttacaatatatggacccaaattcatcatgttccatatatctgcatattaatctaccaggcatctgagcagcagagttggcactctaatatatctttaacacacaagatacatccaaatcaccaaaagaggtaactgttatctagtgaaaaacaaactataaataaactggggaattcagttgagcaagccatgctcttgaattcacgtgcattttctcaaagattggactgaaaaaatccactattggaatagaaattcattcggatgagtaacaggcactcgcctatagtttcagtcacctctttatttagaaaacctacccaaaatcaatccttttctcttttttattttattttttattctagtttatttttactataaagcacagcaagaaaagggagttctttgaagcagtagttttggcaaaaagaagttacatgttagtcaataataaatcatataatcacccatggaaacatggtagcaaatctgacctatacttaaattagcagagaactgtaatgttcagattataccaacctcaacatagaaactgaaggcgagcttgcatatgagcaatagtatccagaataatgtatacctgttttcatgaagagaaaaaacagctttagacagagataataagactcaaaatctaggtaacaagaaagtctaggacttactttagaagtgaacatgtatcctcatacatgcctcgggcaacatatagctttggctgattaataaaagatatgggtgagaactgacaacaacaaatagctctgctaagttagggctaatcaaatattacctgtgtccaccacaaaaaaaatctaataatgcgagaatttgaacgctccaatacccttcgaaatggtagaaatatgaaaaacaaagcactgaatatgtttggtaacatgtaaagagcaacggcaaaattatatatcgattcactctgcagatttccaatccagctgctgaagaacttgataaggcccgtggaattttgaatagaactcatatacgttgtaggaagaattatcaaccaagcaacagctacaacaaatttcaggatatatcgtatcatctgcgagcactccagactcctccaagctttccagttaagaattatctcaagcgtggctgaaaagttcaagagaataatttcataaattgtgcacaagagtacacgagaacaattgcccaaataattacagtacttgattgggtagaatcattgtaattttgcttctcttttatgtattctttgtaattcttttgtaaatattttatatttataaaagtaactgcatggaattttttaacccaaaaaagttaagcaagccttacttcaaaaaatttggagtaaatacctaaggaactatttgggattatgagggtggtaatgataattttgtttggttgaatcactttttgatacttgagtgtttggatatctgccctccttttcctgatcaagttgtacatggataattatcatgttctcaatcatatgagacgaaaagatttaagacaactattggggtaaaatggtttatacgattccaatctggtttaaaaacagaacattaatttttttttgttgatagaagctttaagaatgagcatgatagaacaaccacaagttgaaatagctaataagttcacaagatacttaaagttcataagttccaaacttaaaatgtaccttgcaggaagttcagaaatgcagccgttatgaatattgtcaaaacatttctgaaaacagtaggatcaaaaatagcagacggtaatccagaagggctccaagcaacaattaccatcgcctacaaaataaaacgaagcatggtatggtcaatagatagaagacatagaagctttgtatgcaagacaaagggcaatagatatacctggaaggctaatataaagaaagcccacattcgatcaaaacttctgaataggtgcaaaaatgtacgaacttcaacaaaatttgttttgggtattctccgtctggtaatcacacgatcatgatgctgcataattcaaaaattagttacattatcttccaatatactttcattttgatcagggatcatatcggtaacatacacagtaccaaacatacatctgttctttgggtgactttgcatgattgtacatctaattctttgttaaaattaactgtgatggagcatatgttcaaatgacaagtctgggaggatgtggatgcatggcaagatattcagcttgtgtactgctagcagcttgagcaacacgtctgaagaatctacaaagtgcaatgcatcctttgctattagcagtgtggaaggcaatgcagatggcactccgctacgaaagcagtgtggaaggcaatgcagatgcctcaagagagttaatggaaattctctttccatctaaaaaagatattccagcaatggtttcacgtaattagttcacaaaagaaccgagttttttatgttcaacgagagttttatccctgtctttttcgtcgatatgcattgctagtttgttcaactatgcttttcactttcttttccttcactgccaatatattggtattattatcctttacacttactcatatttttattagctgctaagtgtttccagttaccattagtgactgttctatatccaggaacatgtacaaaccaaagaccaaattatgctatattgagtttctataatcccttgcatggtactgaattttcattttgattcactatttgctcattctgttagttgaccgtcagaatttttaatattcaaccaaatttcaagatataataaaggagggtggtgaaaatattcaactaaaaagaagatattttcaccaagtatttgaagacaaaaactaatattttttattttggtaaatttcaaacagattgttccattcatttttttattcatactaatgttttcaattttgggtttcaaatttggttaaatattgagacttcaatgatttaggtaatatcacatcctctgaaaaaaattatatagctgaatttttttgagggtttatttttagtgcagaggcttattgattatggttgcgggcaagggcttcgtgatcattttggaaagtgtaacagccaactcatgctcaagttaactcaagggcatgaagtcgatgagcaaaattcaagggtatgaaagggaatgagtgaaatctcaaggccatacaggaaattctctcatattatgacgttgatgtatcctcaaagcacctcccacattttcttaacaagtcccatcgtactataaagaataaagtatgtaataactatactagacagaaatcgctacatcaaattgatgatatatgctctaacaatattatgtcacatgatgtaaaatcaagcaagaatttcttgttctcatgccagataaaatattgcattgttgtaaaaaaacaaaggatcaactgctaacctcttcagttttaattttcagaggaaccgcaaaaaagtcagctgctgaatccatcggccatttaagctgtttgaagcatctctttgacctgaaattgtatagggttatgacaaaaaggtgacagataaagcattacctttttcctgaaattatagtacattagaacccactgaaaactaaagcaccataagtcaataacgaactattaagaacaacttaccaaaagtattcattcaggtcatcatagtttctccactttgagtggcttgtcctaccacgtttattcattgcagcttcctttcacatcaaatgaaaaataaataaatacagccagagaacatggggctacataggatataacatatcagcacatacctgcttcataacactgtagatgggttgaataacaagctgtagaaaggcatcatcactcccctctcgccgaaagggtggatcaaaatcttgtcttctatcagatatgatgtcatacaaatcccttgccatctaactcgtgaattagggtgaaaatgattaataaaagagttagtgtatgtttagtgcatatgcacggtattagtctagcggtctgtgtaagaaaaaatttataaaagaatagaaaagaaaaacatacatcattttatttgtcaaacaactggtgggaatgtcttattttgataatgttaagcttgtttatggggataatcactagtggcttgaaacggattaggtcattagggtattagaagggagaggtagacattgattgctatgagagaactagttgacacatagcaaatagaggcatgaagtatatttcttgattagctaatggtgattacatgctatccatttttgtaagggtgactcaactttgatcccaaggaaacaaacttgaacttattattccatttaactactgccagccataacattagcttctatgcgcactggcccagcggggccatgtccacaacttttatacacttcagtctttaaataggttctcttggagtttatgcccattcctaagcagcttacacatgttccatgaataaacacatgggtataattgtgttcttgtactgatggctctgaaatatgcaataaatgtaaagagttgatatatctgcaattgcatgtagcatcactttgcacaagatggcaaaagtttatatttcacattactcagaagtaagaagttaatttgtttttctcattactctagagtgacatggcatcataaccttaaggtttggatgaaaacgatacttctcgacacgatataatcagtttatacatagacaaattagactggcatgatacaaagagcagtacagaaaaaaaaatttcatatgcacgcagtattgaagcagagaagccaacatagctctaatgctctataaaccaacaatatttggcattaactgccttgtcagtattactgccaaaagtgcagttacaaaaaaaggaattgatcataacagattttcgataaaacagagtagagccacaagtgaatgaaaggatgtatcataaattgaatttacctcaaatataatagaaaaaaaatcacttacatgatggaagatataacaaatacattcaggcataaagcgaacattagaagcttcaccccagatcagcaaatacaaccctatgtaaagaatctcaggttgttgtgtggaggcatcgtttggaattctgcaatgtcaatattctcagttgacaaggttgcagattttgagcaccagatgtgcaatgatcattagtggtacttactttatgtttgactccaaatgtaaatatcggcaccaagaaatgtagttttcaaagattttcctcatcaaggatctaactgtatcactatgcatctgcgagccatactagaagttcatgaatcagtttaatattcttacatttatgcggactgagaatgatgtgtgaaaaggcaacaagctcactcaagattagtgatattaaatgaagcttcaaagagaatgtttaccacatgattgtgtctgtcactttggtaggcattagccccttttctcatatcaatatttgcaagcagcaaaatcaaatgctccttctgattctcaacattgcctttctgtaacaacaaatcaaagcatgtatcaaatactaaacaaacagggtaggtgttcaaagataaacagtggtgtctagccatccaactcaaagccaccacaattattgtatctacagcatgttagagacaaaaaatatatttcccatgagtgcagcaatgataggtacaaactatttagttaacactgccatgtaattaacagatgtttggtgcattgcataaagaatttacatgaaggaatttactttaaatatgatattaacatcatcaatgaacatggttcaggaataaccaaaattgtaagtcttgcaagaattattatatgatgtgaccgcaccgtgtatgttttcatttccatatcattaaaacttctgagttacataaccaatgaagtactcaatatttatacttcacaaattgatatcaataactggtttagagaaaaaaaagttctataaaatggaaatagttcagaaaaaacgaatggagaatcagaaggttccagagcacgcagtcgtgcaaactaaacttagttccatacccaatgaagtactgaaacttttatactttgcaagttgatatgcataatttgtttaaatagaaaagttctaaaaaaggaaatagttcaatgcaataaacttttggatcatgcaatcatgcaaacttttggattaagttaagtaattgagtacgattgaagaaagtgaaaaaaaggcattagtttattttgcacctgaaatccaaatgtcagccagagccaatcaaacaaatcacggacagtaggtacatctgtctctttttcagcagaaactggatcaagccttggcatcgggaggccgtctatcttgcgaagaaggtccactgctgctttaatctgccaattttagagcagatcacttttactacttatgttatttatgaaataaatgtggtatttttaaaataaattttaaagtacatgacctcaggaatttccattactggttgtcgctgaccagaaatattaaggggtagaatgttgtagtgtgagaaggaagctttctccttttcaacctctttagcatatatatcaaactgcaaccagttgttcaatattatcatatttcatgatttacagaaactgggaaaatcaataatatcttgcaattatttgtaattactggatgcagaatgcagaacctcagcgtgaaatttttcaggtgtcacggtttttagcacatcatataggacggacgcaatctgatagtgtctagccatctcctccctaaggcattcaaagaatagtatgagaacattgataaagtctgagccatttgtagttttgcaccgagagatagttaatgcgatgcaacaatggccagtcttacggtttttttgtcttaagaccgtccacaagattttttttacaataatgctcataaaaccgctgaatctctttcgcatctgttcctgcaagtctgcgctgtgtctcgtgttcatcctgtgaaataacaaacgtcaaaccatgcaatgcatatatgttgaaagtgaataggagcaattaacatgctgaagcacttctaatctgagtaaggaagaatgttaaaagatttggggctttatattaatcttctacatgaaaactttattccagtttattccttgtggagttaattataacttctcacttcacaatggtgttctggaaaataatggagactcatttctttttgcacgaatcactattgcaagcttaatagaaatattgtctccactagtatcaagacaagctatcaccggtaactaactccaacaaaaacaggacaccaagtgatacctggtttgggagaaattctagacactgccatgcgaattctagtgggtaacggaactatgggattgtgaaacctctgaccgtatggtaaaactgtaaggccagttggcaaagtactctctgggggtcacataaaatcaggcttttggtgctttatgctgcaagcaaggactgtgagaaagtaacattttgtaatcttcaaaaaatcatacttgattagaggaattttttttttctgaaacagatggcagggccacagaagctctgcccattcctctgtactaatataaaaggaacaaatttaaactacatggatgctataaagcatcatggccattcatcctctagtttggaaagatgagatataaaggtgggtccttactctataattaatcatacacaattaatatgcaattaaaatagagactctccattactaagatttgcagtgcaagtgagaataacttcaatagggaaaatatctacttaaatccctcaagtgtaatggtttatttccttagcaccctgaacactaggtatcgtaccaccttaactaacaaaaaccagagcaaatgtaggcgtattgccagcatggcagatcaagctggcaacatgatagtgactcagcaaatcaaatatataaaatatctcttgcacagtgggcccctatgtcagtggtatactcttgttctttctcatctttcaccccccccccccctctgtttgttatggagaaaaaaaagagcacattccccgcatctctgccatgctgcttgtgaggtaagagcatagtgaaaaaaaccagaccggcccggtgtttggaccggaaaaaaccggaaccagaggtcagcgcggttcggttggatggaaagactggacatgtaattgacccgctttagaccgcttgaaccggccagttttaagtgaaccggtgataaaccagcctcgatcggaccggcctagacatctgaattgcttaaatgggccggaagaaggcccatttaattcgaaggcccgaaataactagatatttaggcaaaaatgaccaagaaaaagggaatggtggggagtcaaaccctggtggtgggtttgaagttgactccggtagccatccaagcattaggttgttagttctgatacgagaatataaagtaatttttatctagtagcgaaccacggttagaccggccggttcaccagtcagaccgtcggaccagtgaaccaagaggttgaccgggtcactcactggtccagtcttttcaactatgagtaagagcattagtgacatattcctctcaatcatctcagggcttgcaccgagcctgcttcccatgggcatcttggcattcctcaggttcatagttgctattgccgaaagcacaaccgctctgaccgtctattctaagaccagacttagctccgcaattctactgacacatacttcatcaagtagctttaagtcatcttaccattttaacaattaccgatttcctcgtgactagttgagaacatacttttggtacgtggtaggatcgaaattgcaggagatttattgctctcatagcttgggcgcgatattgttggtatgaaattgtatcaatctctcaccaccctgtgtcacctgttgactctgattagacccttcttttgcacatccagatctcatcatgctaatagcatatgaggggagaaagagagagcatatgaggaagcttaggtgcgttgcaccagcatggatcagagactgttgatggaggcatccatggcggtaaccaggaggtggcagaatgagacagagggtagaaaggggaagaagagagacttcatagagaaagggggcccacattcaagacaaattttacacattgttgagtcatatccatgctgctggccgtgttatcctccacagtggcaatactgccacggaactagcccagtgggttctttttcttccttttatattacgtggtactatactttagggtgtaaagtagacgaactgctacatttcaccttctaaggataacattgcaaactgcatatcgaggtgcagaaattttctttcggcgcaacagtctctctcaatagttaaattattcaggcacatcattattgtttatttgtgtcacgattccaggtgcttactgcaatttgtttgcatttccatttcacatcataaaagttcaaacagtttaacaccatcacaagaaatacacatgcacttaacaacaaaagctatgtgattcctgcacgtagctactttcaaacacttacatgccacttgggaaagacgtttgttacgtgtgctcattgatagataggtggaggaatagcaggaaaagcagataccttctccagcctatgcaagaggtatgttttgaattgccgaactcctcgtccacctgagtttggatccatggtgtgagccttctcgaacgcggtaaaccgaccttttagcaagcaccaagccaccaaccaaaaaccacagtcaagtcatcacaataggctaagttcaaagcagaggtatacaagggagataaacatgcacatttcttacataaacagaaaaaaaaataaaaataattctgcaatcgatactatagctgcgaaatgagattcttccaatttccaaggctcactggctcagaacattcatgatggcactagactacctaaatggtgtggtcggctgcgtccgtgcatgtaatacggagcaattcattagagtatgattaattaagcatcaactaaaataaatttgaaaaatgaattaatatgaattttaagcaaattttctatagatttttttaattaaaaaaacaccaatatgtgtcaacgagcgagcatagctgcgcatgcaggcaacagatagcgaaatcataggagagaagtaaaaaaaaaaaagggaaaggggaacgcagagcacgcacagaggtaggcgacgcgctggttctcctcctcgatctcgttggcggcgcggaggatggggacgatgggggcgagcgagttaggcaccagctcgctctcctcgctgtactccccgccgtcctccccggagtacccctccggcctcatggtgaacgccctcgacaagccccgccgcagcgacggctgcggccccgacaacccccctccccccgtcgccatgcctcccccgccccgcggcggcgactacgacaacgacgacgacgaccaacgtaccccctcctccctattcgacaacgatcgagaccaacgccgcggcggcgttggcggcggtggcggcggtggtggtggtgaggatcggcgaggaaggggaggaggagatgggggcaaggcatcttcttaagcgggagggaggggggagtgtgagtgcggagtgcgcgctttttcgcttttgccgctttggccttctttctttctttcttcgaggggaggagaagggaggaggaggagattgtgcttcgctttgctttttttttttttctttctctttctttttgcggcgcagatgcggatcgagcgggggtggccggcgagggaagcaaggaattggaatttggaacggtgctgacgtgtggggccaggtaggcagggacaggggctttgttgaggttttttttcacttccctaattcatctctcgtttttttacgcgcacgctttttaaatttctaaacggtgtgtttctttaaaaattttctatacgaaagctactttaaaaattatattaacctatttaaaaataactaatacttaattaattatatatgctaatgaatactccctccgtactcgtaaaggaagtcgtttagcacaatgtttaagttaaaccttgggaatataaatcataaataactatcaagttgttgagtttaaaaatgtaaaaattatatgaatatatttgttttgaaaaatactttcataaaagtatacatatatcacttttcaataaatatttctatagaaacaagaagtcaaagttatgtttcggagaccgtatcgctgtccaaacgagaccgtgtcactgtccgaaacgaatttctttacgagtacggagggagtacacccattttatatggacagagtattagggcatgttctctttaatgcaaaaaaagacttactaaaatttggcattgccaaaattttgacatagttgccaaaattatatactcactaaaatttgacagcaaactaaatatagctacttttttgataactttatcaaaatttggtaagatcaaaaatgacatcaaagtgaacagagccttagtttccaacaggagccgaacacagggccgggctcttcgctttctttcgtgtgcgcttttctttatgaggtaaaaaacgaataatgtttatacctggtttcctggcttcaaaatgtctgtgtttcatgtcatgtgtaccaccgtatgtcggcgccgtactgcagagggaatgagaggatggataaaggtacagctacccgctttcgaattatttgtcgtcttatctaaattaaccattttaagttcgatcattaatctttagaaatctatttgtgtagtataacgttatactcccttcatttcataatgtaagactttctagcattactcatcatatttatatagatgttaataaatatagacacatatatatatttaaattcattagcatctctataaatatatggacaatactagaaagactcacgttatgaaacggaggaagatttatgcttttattcactacagaaacaactccatagtcgaactaatggtcaagattaaagcaatgagtataaatggaggggatcaatgagcatcggtaagctttgctttcctatatatgagtactaagttctaatgttttataacctcgtagagtggcagggagtcgttaataatttcttctttcgctttctccaaattgaaacttgaacaggacaggatttgaaaccggctctctccggatctgttcattgggcgatcgttcaattatgcacgcaaaagagagtgctttaatcaaataaaagatacagtttgggcacgtctcaactctaaagctagctatcactagcttcactggcgtgtttagttagcatcaagtggcagctatatatatatactcagaacaatctagcatatatattcaactggattgagatcctctgacataacttctcactaacttggtggctgacatgtgggcccgaaagtggtgaggcccacatgtcagtcacggcgaacattagaggatcatctttcatattctactagtgtggattgcatggatacgggactaccacgggtggaactacgtacacctgggatgggaatagctaattatattgcctcgctagggctcagtttctactgttttttttaggaaaaaattgctataggatactcaaaaatcgtgtaattgtctaagagacactgtaaaaatgtgacactgccgatggacagtacaaaagttgtgtagtttaggacaccaaaggcattattttataatttctgggctgaaagaggggagagaaattttgaaatgatgggaatgcccctgtactccttattcctttctctcaatgcagccgacatgtggacccacgctcagtgtcgtcatcctcctctcgccagcgcccaatgccgaccgacgccactgcatcccttccaaaatccgatcgattcggtgagagagtcagcgatgcccaatccggtggctacaacgaggcagtgcctctcgtcggccgccgtccctgcccacgacgccatcgtcacctccaccggccaccgcgcccacgcccagaccacctccctccacctcatctcctccctcctcaccgcgacgccctcgcccgcacccacagcgccgcctactccccacgcatccaactcaaggccctcgacctctgcttcgttgtctccctcgataggctcccctccgtctccgcctcctcctcctttgcctctacgccgatgaaccccccgtctccaactccctcatggccgccatcaagcactcccaggccaaccagcgccgcaacccggacaccttccacttctaccaccaggccaccaccgcccaaactcccgccgctgtcaaggtcgagctctcctagcttgtcctcgccatcctcaatgaccccatcatcagtcgtgtcttccctgaggccggattccgcagcagggacatcaagctcaccatcctccgtccggctccacccatgccactcctcggccgcctccccacgtgcacccacccgccgcctctcttcctctgcagcttcgccaccgtggatgacgttgatgtcccttcgccggccgggaaccttgccggcgttggggaggagaactgctgccacatcaccgagatcctctcccacggccgcaactctcactgccgtcaaggtcgagctgtcccagcttgtcctcgccatcctcgatgaccccatctttgctcgaattttggaagggaccagcgcggccaaggcagcatagacgcacgccttcaagacgatgacagaagcggtgagcacgcagaacaggaagatggacaagcatacaacggtgaagtcatcgacacttggggggcaatccggacaattcaataaaaatctcaccactttcatctcgaaaatgataaaataatgtgttcggtgttatacggccaattacataacttttgcagtgtccatgggcagtgtcacgtttttgtggtgtccctcagccaattacacgtttttttgcgtgtcttgtagtaaatgttttctctttttgagaaaatccatgaaatgccattgacaagcaccctaatccaagaaatgccattacagccaaactgttgttaacttctctccgttaagttgtatgaaaagacaatattacccctgggcaaacatttgctcactcatcattctgtattgtttgcccacacaacattatttttgcattgatgcatatttgaattcagacataattattttgctatcaatcaaattatttcaaaattaaattcacaaattttgccatcaaaattatttcagaaatttcgctatcaattatcagggttgtgatatgagcagaaatcaggctatcaatgattttagaaattttgttatcaatctgagctaaataacaaaacatggtttcagagttgagtacaataggtagactgcctgacaataaaatagagctaccatcaatcatttttcaggcattgaacgtgcagactaataatcatgtcaaaattcgatactactttcatgtaacccacatcagggcaatcaacacacaaagtagcaattatgatgcttaagcgaggatttgggcctgaaaaaaaccctaaagcggatggagagagacggggagttgagcatttgagcatttgctagttgagcatttgctgtctgggtacttaacataaaagaacaaatgtaatacagagcaaagggacatgaaaaacataggccaagtttagttttaaaatttttcttcaaacttccaactttccatcacatcaaaactttcctacacacataaacttccaacttttccgtcacatcgttccaatttcaaccaaacttccaattttgacgtgaactaaacacacccataggctttccctcaattcagcctgcatgcgtgctccatcgctgatggatcccaattcccaaaacccctgccaccgccggcgtctagtgcccggcgccggggctcgggccggagtccatgatcccgccaagcatgtcgaggctgacagacttcagccactgcaggccaccgtcaccggcattctccatgctcccgaccattgcctccaaatcgaccgccagcgactccaccgcgtccccgtctttctccatctgcttaagcatctaatactcctgggagcgccgcatcgccgctgagggccgccgcgccaccgcctggggccaccgcatcgcccctgtcacccatcgtgttaggtttagggctgtcttcttatttttccaatttcttttcttttaacggattgagatagtataatttggagtgagggcgatttagtcatttttgtaaactttttttgttctaacagtgtggactaaacagtgcgttgactgtgatggcatttctgggacaaataggcttgtataatggcactttcaggaagttgtgcttgttgacggcatttctgggattagggtacttgtcaatggcatttcatggattctctttttttttattacacggtacacacaccactacatgcgcaatattacactcacatcccctacgaatgtgcctctaacgcatgcttaaagagacgaaaaccaaatgcacatccttgatcttactaaaatcatgttaaaaactcgcctataaatacgtaatattcgtgggtacaggatttaaaccctgatgaataaaatcatgcaccatgactccgccatcccaacactaattcttccccacctcattagacttgttaaccagctcttgcacattatgtaacaaaacaatatatgctaactagtaaattatactaattacataaaaaatagttggaagtaatttgtaggacaaaatactacttaggtgttaggagcagtaaataaaaaaaagactggactttttctttgctattttaacctttttagaaaaatattttacaaatcgacccttacaatttagaaaccttattgcacatcctcggtcctcggtatcagggacgttggcaccaaggtgtgatgtctcgacgccagatgagctgacaccaagggatgggttttgatgtcaattaggctgtgttcggcagcctatgtttccaactcccctcttcgttttccgtgcacgcttttcaaattactgaacggtgtattttttgcaaaaaaaaagttctataggaaagttgcttaaaaaatcttattaatccatttttcaagttagttttagctaatacttaattaattatgcgataataagctattccgttttccgtgccagagggataggctccaactggcacaaatgaacgcagcctttagtttggcactgacctctcccatctagatttttttagggaaactctcccatctagatttcctctaaatctatacattttaaaactaaactattcaaacaggacgaaacacccttcccctattttagctagttttgacatgagctagcggtgaatataagatgaatctcataagttggagttccacaaaccaaactagcagtgaaactgcaatgacagaataatctaagcaaaacccaaccctaattcaacaacggctactgaataaatagattctagggttgaccaaggacccatggacacgtccctaatggatgccaacatatttcgatgattctcgttgacttagaaggagtgttaacatgagaccagatccattggagagttgatctcgttagctttccatacatatgtagaaagtaaaaaagtaattcgaatgagatcttggcgatgattttggtgcgagcttctcctggattccaagatggattcaaacttaatatgaattgggcctccatctccaagcctctctccaagtgcttcctagccctcgctcatacacatccaaagcagtgatgccatcatcagttgctgccctagatccatgttgcgatggtcaccacactcactgccgtcctagaaccatgctcaggttcagctcatcgggaaagtgtgcaatgaggaggaggtcggcatgtgctcctagcgtgtcaaggagtaggcagcagggaggcgtgatcagggtcatcgtgtgcatggtatgaattgtctaccagagagacgggagagatgacagggagtacatggcatcatggagacttaagcaattaggcacacacttttatcatagcatgcaatttttatctgaaaacaatgcgatatgaaaattttggcataacatgatcaagggaagggggtaatgtaatccgcactagtggtcatctgggttgcacatgggttcctcgttgtataagtagccagctacatggatgggaacttaatttcaattagaacataattaaataaatccataaaaattctaaaaattccaaaattacgaaatcaatcttcttggatagacctttattttagatgaatttaagtttaagttccactcaatttggagttaaactggctgtgatattgcctctaaaagattcaaatttaaattaattgaaattattgcgatatgttacagtgctacccttttcatttctccatgagaacttggaggagtctgaggcttccgctcaaacttcaatcaacatggattcgtggtgaagaaaatgtggggttaagtgttcattgcatagtctagggctctaggcaaactcccgaagtggccttcgcatccttctattgtggtggttagatgacgatgcagctgacgaatggtggagagtatcagggtcagaaaggagggcatgtggaggccattgtgagaaggtgtaaatggtggctaattgcatgggccaaggttgttggagctatgcattaccaagaacatggtggaatgacataaccgggtttggcatcggcatcatgtgtagggttgggtgttcagtttttccggttaaatcggtacggtttctttggttatacctaattccattttcttataaatggcagaattctagtttcttataaatggcaactgaagtaaacgataaaataaatgtaaccacacaaaataaaccgaatcacgtcggttcgattcctcggtttaccaagacaaccgacctgctcaccaagcacgcgttccagatagcattgggatagctagatgcgatctcccttgcggccttcacggagcgaacatctcccacaagctagttagcaacaaagttaaggtaatgggctttggcctattgagttaagtgagcctttgagactttcatgttggaaacaccagggaagtactttggactagtaatgcatgtacctagatcagttgttcggctttgttggttaagccggagattgaacacaagcaaaaataaaacgaagaaaaaaccaaagataaaaaaaactgctacttcggctcggttcggtatggttcgctccggtcttcggttgtcggtattattgtgcctacccctactcatgtgtccatggggctcaccacacacctgcatccaatgacatttaatcattctaagcaccatgcttacatttctaaataatgtcagtaattctcccacccttcggatggataagttaaaactagtgcaatccgttaagatcattggaccgatgtcgtagcatagatcgactaatctaaactgtatagtttatgaaataagtataaactactcataaaccatataactgacaaagcagtatatgaattaaaaacataattaggtagataagatatttctattattgagctcatagtattacaagaagagtacattactaaaaacatacccgaatctccgagaagattgggaaattgaagaaatattctaatcctaaactccactaaactaaagagtatacaaaatgtagaatagagagattgcttcttgagtgtgtggagtgaagtgagaagcacccataaccaccatcaggggccaacggagagctgccatagggaaggcggaggtgagaggggccatgcctggtttggctgacccctggtttagccaaaccagggcaaccgtctctctccaccgaccttctcccagaggctgccaggtgggcccctaggtcagtgcacgatggattagccctgaattaagtcggtttggtatgacttgtgagccctccaatccttgtgctttcacgtgattcgctagaggtgtgtttctttgcaagccgacacatttctccttcactttattgtataatccttacatccatagtatttctccaagacaagtggaactacattatttataactaatatgcgtataagaaatgctagttctccttttattattgagctaattgacacttgaaatcggtatttaatgaccgtcaacacccgtgaggagctagctagcctatagttgtgggtgacgcgggcctagctggcgcaaggaaaggtgaggcttggttgccctagtgggctgactagctagctcagttgaggttgtccagtggggatgggtcgaattgggggcattgtctcgagcctactaagaaagtatttcctatttccaacaaatttattaattagttgaaaatttttttcgaccaaattatttcatatttcatattcttaactcagatgtttttcttagttaaaggaattttatttaagttggtgagatggctaacaagaaaccgccagaaccatcatggatgcaggatttcagaaaagatttttgacaattcaaaattttgggttccatatttttatttcataaaattcaggatgttacatccgggctgctggatctcataatagggaggtgtagagggctaaatctgaccacacacaccaccatggttgtctcgctggtgatgcatgaagtctcgtctatgccgctgggagctcctcttcccttccattttctcccccgaggctacccccacttcctccctagttccatcaatgtcgccacaccatctcccttctaacttagaggtgatggatctattctccactagcatggggccattgaatctgaccactccaaacactagggccaccagatcccaccctccaagcttgggtcacttgaacccaacggtagggtggtgcggtggcacaactaatggcattataatgggtaaggcgatggcacacaatggtgataagtgctatgatgggaaaggtgatggaaacaagcatggggatgtccataatgataatgcagcaatgactacaatggtagcatatcaatgactaagcgaggagagcaagaagcatgagatgatcatgaaggcagtgcggtgacgaccaagagagcggactgagcggtggttgtaagtccctcctacgatgatggtagtattattttattttttttattttttgctgaaaacatgcaaactgacgattgggctcttgaacaaccaatgatactcattattgaaaccaattgtgatactccaaatatctcaattggttcaaaagccaacaatgaagtttgttatgaacaaatgttgatggctgattatgtactactgtatttgcaattgcataagggtatttgtgtcatgaggaccaatctttgcatttggtggaggttctgcaattacagtaggcatttaatactttggtagacattttatagttgcgggtgcttgatagtgttatatagttgtgggaaggcatttactactttgggtaaagtgcaatttaccccataaactattgcggtactctggattacccgtgaactacaatacgagacattcttctctcctcaatcgttaaaattttatcccttgagtaagaataaaagtggttttattattgcgtgccattgctttgcccttgtggcattggaggccacctatcaaccattgcttcatgtttccttttgtttttatccttattttttctcttctattgcttctaccaccggtaacctcctcctacttccttggtgacaatgctagcgaccaagtagcctccttcactccttcagcataggcgctggctagtcctcatttcatccccccttttctatttacccaccattgcaccatggaggcgttggcatccattcccctccccatccttgattttgttgttgtcaccgttgaggagcaaggaggtgaacaccaaacgaatgagtgttggagaccaacgatggttggtagtggtcagggtctaggcagtaagcaaggggatgcggcagaatgaggagccagcaagggtgaggtcaaggtcgaggcctaggcaatgatcaatggggctcttcagctcaatttgt

SEQ ID NO: 70215 - DNA, 2071 bp, Oryza sativa
taaacttcttacaaacgttttcaaactgtcacgtgatgttctacaaacacttctagacgtcatgtggcgctctaattaaaaataatctaaacattgatttttcttcaaattggtggaccaaataattttaactattagatcttaaaaaaaatctggctcccccacctccacccccaccgtatgtgaccatgcatgtacatgctccaccctcctactctcctctaggatcccattgtcctctcctattttctagctaacacaaaaatatataaaaaataacaatagctaaatgatgatgattctcaagttacatgtacttttctcaatttatttgatttcttgtgttattgataattaaatacataatccaagagatatattgcccatattaactatataaaagttacggcctcatcttttcgcttatgcttattagctaaaatttaaatttttaaccttaaatttggagttaattttgtggttttctatctaagtttatttttcaatatttgttttttgatcgctaagaacatgtatataaaaatttttcataaattattttttgtttgcaaatatgttgtttaacatgggaccgttagataatttggttgttttgactacaaatatttgagcaaaatagcactttaaaaacaatgaatgaattcaaatatgtgagtctaaagtccaggttcaatcaccaccaaggagcttggaaccatgatatatactctaaacccgatggaagcggagctacaagacattattagccagatagacaccgacgacagcggtagcattgacttccacgagtttctaggcctaatggcatgcaaaaggacaagtattgagaggaggggcagagggagatgttccgagtcttcggcaaggagtagaaaatggcttcatctctaacgccaagctcagtcacgtcatgtccaatgtatcaggagaggctcactaatgaggaggtcgacgagatgatccacgagaccgatggtagcaagcgtatcaactacaaggagtttgtatgtaaattcatagcaaaaaaaacaagcaaattgattaaaatatacactaaaaaatcattaaaactataaaaatacaacaagatttcatgtagaatataaaatatcaagagtccatataaatagctaaaatttggaataataaaataagtattaaaagaaaactccaaacacaacacgatacacactttaaaatccctaaaaagacaatttagaataaaacaataatttgatttgaatacatatttgaaattagacttaatcactaaattcgaaatacagtaaatatttttttaagaacttttctatctctatgcataacgaattgcatatatatgaagcaattgaagatagggttagcagggtgggaaaatatatttattatagtttgttgatatttcttcaaaaaaaaaagatgcaaggaacactcaattaaaaatagaaaacaccttattttaatttcaatttattttgttagaactattttcaaaacaaactaatacacatgcccgcgcgaatgcgcgggctatcttcctaattactcactccttcccaaattgatcatcatataatgaaatccaaaatttctcaaattgataattatataaccgcatggatacggattttaatggaatacaataaatgtagtaagagaaaatgtgtacatgctaagcgtgtaattgacatgttgttttaatcgatgcatgtattgtgggagaatatgtacatggtgtcttgattgatatgatttaaattattcttggtcttggtgtataaatatatacgatgatcaatttaggatggagggagtatataaaaggagacaataagccaaagtgataaattaatgcagtagagagagattggtgttgaagagcggatagtttactctatttaatttattactctattatattattgtgtatgtagagaatagtaaatagttaccatgaaattggggaggaattgaagttgaaggactccatgtagagggagaagagatggaggagagaaacacgtgagaattattatatcaggagtatcca

SEQ ID NO: 70216 - DNA, 1301 bp, Oryza sativa
ttgagtctaattatgtcatgattttgacaatgtgatgctacagtaaacttttgataattatggattaattaggcttaaaaaaatcgtctcgcggattagctctcatttatgaaattagtttttttattagtctatgtttaatactctaaattagcgttcaaacatctgatgtgacttgggctaaaaagttttagccccatctaaacaccccctaagcaaatccggcgacttttgctatctcgctgttctgattgccagcaaatttgatgatttggagctgctaagcaaatccggcgacttctgctatctcgctgttctgattgccagcaaatttgatgattgccactggttgcatgttgtttgctattgacttgatttgttgttggctgtgggatgtgaatccgatcgtcaaagcagtcggtttcggtgacagtcatagcagtcggtttcggtgaataatagcagtagtttggaaaagttttggctataggaatctttgcatgtcaatccgtgtgctacactgtttcagtgaaaagtagtagtatttttatgtcgtgctatgagtagtactccctccctccgtataagcatattttcaaatctgaaaattctatgaaaattctatttttgataagcatatttcaatttaacaatctatcatcttaatgactttctcggatttaatgtatgactctccattcttctatacaagattggctacttgagcatcgtgaaatgtaaatattaatgaatcgcatgtttacgaagaatgactaggagcatgtttaaatggatggtaaatagaattaattatcattggtctgtgtgccaagatgaaataagagctcccaattccataaaggctatagaaaaccgtgtaatacaccttttctacctttggacttttaaatggttctgacttttaccttgtccgacttgtccgatttctgctatatactctgtaaaactctgattaaatctttaccgttaaaatctagatctattattatccaatcgttaaaatctttttctttttttttcgattaacttgggaatttattccccacatagaacgtggtgtctcctttcaagactgttttaataatataatagatagatagattaaactgcttggggaaatactagtgatgtgatggagacgtggtacgtaccttgctagttttcacaaatattccgtacatataagtaggttttaaatagggatttactttgatgagagatgtgttgctggtttctatctcttcgagagtgtgttagggtggaaggtgaattcacgggtg

SEQ ID NO: 70217 - DNA, 1364 bp, Oryza sativa
ccgcccagcggccgccctgcatagagagagagagagagagaggaggaaccgaggaagaccgaccggcctgcacagaagagaagagagggagagatatgccctcatcgtttggcttttcttttaataagccaaaacggcttattagagaataaaaataaatttgtaggtaaaacttttatatatgtgttctcggtgacttaaaagccaatgctgaaaaagaaactacgttgaaaatatctcaaaatcaatgtcaaaattaagtttgaaaattcaaaatttggctttttctttggctgaataggccatccgatgggagccatagatgactcagcctaacatgtagggtccacatgggtccatgctgactcagccgccacgtaggataaaaccggggtcaaaaccaccgaagaatctactgtgaccagttttaattagttgagggatgttcggtatctagttttaccggtatctggttttgcggttgagggacgattttgtaactcgatgacaagttgagggaccttcggtgtactttttccaagagatattctccaatagaatattcttctcctctgatcccacgaggaacgttctctagattgcttaaaaaccatccaaactgttatgaaaaattctaaagaaatttgaaaacgcttatacaatatatttatacaactccacaaaatcctaggtctaaactcaactcgcacgtcaagataaaaaaaagataaaaaagacaaatttaacgtatgaatagcaatgtactattcacatctaaatttatctttttttctcaacgtgtaggttgaatttggacatgatttttggtaaagcgatagatattattataccctatattgctaaaaaaatcataattgtttactactatttgtataaaatttaaaagaaaaggtacacgagaggatataatcccgaaggattagaatccactcccctctcattttcgctttttttttagaattggtccagaaattaagggtcatttctgtacgaaaacgtaaaaataacttaaagttacattaagtggttaggtcgtcatatcgtcctaatgaaattattgcgtactccctccgtcaaaaaaaaaacaaactctggtttccgtgtccaacgtttgaccgttcgtcttatttgaaaaaaatataaaaaaaattaagaagataagtcacgcataaaatattaatcatgttttatcatctaacaaatatgaaaatactaattataaaaaaaattcatataagacgaatagtcaaacgtcagtacggaaactcagggtttgcctttttttaggacggagggagtactggttgggtcatcataacaactcattcccactggctgcagga

SEQ ID NO: 70218 - DNA, 5917 bp, Oryza sativa
gccgccgccgccgggcacctccctgtacgcctcctaccgccaccacgcctaccctcctcacccgccgccgccgcccgcgtacgtcggcgcgtactacgaccacgcggcggagccactgccgccgcgcgacgagctccgcacgctcttcatcgcgggcctccccggcgacgccaaggcccgcgaggtctacaacctcttccgcgacttccccggctatgtctcctcccacctccgcacctccggcaaatcctcgcaggtttccccactcttctctcctcaccccccaacccttcaatctcccctgtgctagggtaattgggtttgcaaacttgtacgtattccttctctcgaacagtatggtgagtagcacaaaccctgactgtttctgcgttgcaggcatatgcgttcgctgtctttgcagatcaaccttctgccttagctgcaatgagtgccacaaacgtaagagctcgcttcagcattatcaggtttctagtagtattaggttatgcttttctgacaaaccattactcctaacgaggttatctacatcagaagttacagctataaataatctgtttagagttctcaatggttgccatttctgtggattgtttcttgctgcagggaaggatatttgaccttgagaataattgcacactgcatgtagatcttgcgaaatctaattcaagatcaaagcgctccagaacaggtgggcgattagcctgcaccttgcaatctttgttcctactgccacatattgtggttattgtgtatcagtattgttgattgcacccttttacttcaacagatgatgttccgtcttattcctctgagaaaaaagctagaaatccgaggggatttcctgattcaggtatcattcaagttgacaggagctagtacctgcaatttttttgaacagttcgttgtatacaccatgttgatctatccactaggacctgttccatcgtagtcacatgagcaatagcagaccattccaaatccacagtttccacatccatcagattgatgaaaatggtttccctctctactaagggatacagttgatcctgagttcctataactttttcctagaattttctgtgttcatatcctaaccatgacttcatatccactcacgttgatgaacattcttgcaaaacactcaccttgcacatctttggcacactttgcgccctatcaggtgctggaagcaatattcacatgtctggaatgggtaattcttcacacagcttgaatggttatccttctgcacaaaggttatggcgcactacttgagcacagtttaattatgtgttttttaggaaaatcagcttaagatgtccagcagctggtgttagaaaagagatatccaatactattgctgatattactcctagaaatattttaattctaatcaagatcattttcaacttgcagttacacgaactttgagcctgctgctttcagcaaggtgagttttgtttgtgcatcttgatatatttgtccttgtctagcatcagtgttggtttatttctatacaaatatgttgtttgataaatgtttgcagtatctgagatggaaaattggaaactacgaacaattgcagcaaagcttaatattattaccatcttatgacatatatcacatttgcaaagctgtttgaatggttttagttaattccatttgtatatggaaaaaagagggctagcacatttataatattattgtaccacaagtcagttctgctttcagagttttactactagtacattatcttcaaggtagaattctattaatcttgtatagtaggtaaatctattaacttagtcacaacaatggtagtttaactagtattataaagtgcgattgagttacaaaagactaaagcgaatgacttcaatggcgtaactggtactgcaaagtatagccacagggattgggggctgccctcatgatccatgaccttgatgaggcatctcaaatcatgggtcactaccagggcacacctgcttccactctccatgagagcacctgatggttggccactggatctttgtgcgtgtgggttgttgcccttggagagactgctgcctattgctggtggttggccattaatttgttgcttgttgccagtcccaccattgccaccattgcagctcatctgcttgacgatgaggagcagcagcagacgcatgagatggttatggagaggggagcatgagaggaggttgaggagatgactaggtgtgtgcagctgtggaggaaggggaggcagtggaggctactttgtgaattgtggacgcatgttgacttgtaagttggagttgcggggctagaagatagtgtgctatgtgagatgttgggttcaagtgggatattgggctgaaccaggtcatctatcttctcatctcctttctctctgatttatgtgtgctttatgtggctgggctgtaatattctgagggatcgccttcccttcttctttcattcttattttacaaacttggtttggttgcatatagcaactaattgtgcaattgaataaatggctcggattcattgggatcattatgaacaaggcattcgatcttgactcatggagtgagccatattatacagctgatcttattggatggaaaactaaatgaagtaacccatggttttactttacataaataaaaagatcagaaaacagcacaattgatttctgttgttgctaaatatcaaatatctatattttggtaggcttattggagagtatgtaatgcttactcccttttgcatgtccatttacctgcaggacccagcagcgtttgcccctcaaaacaatcctccttgccctacactctttgttgctaaccttggtccaacttgctctgagcaagagctaatagatgttttctcaaggtatttccaatataacaattcatgatgtgagataaataaataaacatattttttttacaagtttcttctcatggttagttgcgcgggattcataaaggtgaagatgcaaaacaagtttggagctccagttgcatttgtggatttcaaggtatatcaagtaaactattctgctgcttattattaattgtctaggtctctagctattatgttggtctattgtggagagctatctgccttttgaaatctgtggtaaatcttcagataatggatgcccatttcacttttcgttaaaaaggaaaacatcgggtagaagtcaaaacaaagtaaacaagaaaataaacgctcttgatttcatcagtggtgagataacatgaaactatgatgatacacttacagagacagacagtctgtaaagttgattcttttctgtaggttaaatctagtttatattcttttgtttcatgtgtttcagatatcaaaaaaatgatttcttgataaattttactagttaaccctaatatttgtggtgtgaccacgggaatctgttgcgaacattattaacaaagtcatatctgtattttttttctatgtaagtgttttttgtatccataaattctatagaccagacaaccaactgctgcatacacaggcatcagtaaagatagtcgaattaggggttcttgtttgttgccacatttaacatgcaatggagatatgtgttttgaaagatactattgtttctgtacttgcattttcctatagagtggatccttaagcattttcattaccgatgatttcaatatgtttgaatttattttcaaagttaatcccaaactggagttgctgcctgcaggatatggacagttcaactgaagccataaaccgtctccaaggagttattttgtattcatcaactggcgaggggatgcgtttagagtatcctacatttagggattatttaaatttcctgctattatatctctcttcaaattcttcttgcagggtgtatttggagcttatagcagaagctaaatgcgatctctacttcctgaccatgcctttttaacttattgatatagctccttaacatctatcagatatgccaaatctcggatgggcctgcgtaagcaggataagcgccaatagatatgatagacgaggctgcagttgtttctcatacagcgcaactggcagtggagcatgatgtttcctgactggtcttccaagtgctgtttagtctgatgacacaatgttttgttcagtgaaatgttttgctcatgatgttaggttatggtgcatcggtggtctttcagttccataacattttgtaattgggtttggtaacttaagctgtacctgtgtagttgtcttaccttctggttcttttcaaccctatactttctaggctgttcattagctactgttgaagtcagcatacccatgtaatcatgttcaaacttcaaacaatcaaactagttgtaacttttgaaagatcaaatggttcggtgccaaattaactgtacttggtcattaatgacaacatggtgcctggtccaattgggggttatcattgggaaaccttaatgagtgtaccatgggtggtgactgtccaatatttaaggacatcattatgacattatgtgtttgatacggatggtttggttgtatggatgatgtatgccctcatcaggccgacggccgtagagactcctgcaggcaggtgttgatgcttcttctcactgttgtctgcgtttcaagtacataatgaaagggtatatctacctttctggtacgtttatccaatgctagctcatttgctaatctgatttgccttagactattagactaaccaacgaaatgcagagctcaaatgacacctctgcctttcaggtgcactgtcttctttacgctagtacattatagtatataacagctgtgactgggaagcaaagtagttgctcatattgattgatttgttcggcatataggggatattttgggtgcgtgtaacaatgtgaaacagaaagcgaacctaaaaaggcatgcactggagctgcttctcttatcctttactgtaaacgctgaaacatcatcttggtgcattttggctatttgcaggatgacctaccatccgaatacaaagtgctatatctaacagtgatggttctgctcagctgtactgtatctttctttctcgagatagtgtcataacttgcagttgctcgagaggtgataccctttatcaacaaggaaagctatgggcactgaggtttagaactctttaccagttttaagttgaaagttctgcgagagcatggtcggttgtcaattatttgtgctcgcttgcacacccaccatcaacttgagtaaaattccagaggtcatcaattcattagtggggagggtagaaatataaattcagaatacctctattttgatggatcgtagtactgatccgtcttcaattcatgagggggatgtgccccagctagtacagagcttcaataaagagttgaaatgtacagtaactttctgatgtccagcagcaactgcaacgtgctggtgatgtgcgagtgcgacagtatgagtagtgggaacaatgtggtatactagtacttcaattatggtttgcagtgatcagtctcattgtttgcttcattttagcatgctgttactgctctaactcaactgtttcttgtaaaatttagcactgtagatagggcttgcaacgaaaacttaatttttatagggaaattaaaaaaattgagggaaaacgaacactgaatcactgattcgccctgacagctatgttttgcagcttactggctgtttagcacctgttggaatctgtttgtacttggctgtgaacttgtagacagtaattatatacttttgtaccgtatttagtctgagaaggtccagcattcgtcaaatggaagcatctcagatgtttgccttttgccttccaggtgagctagctcaagctttaatccatcctctgaagccaacc

SEQ ID NO: 70219 - DNA, 1884 bp, Oryza sativa
gatccatgcactgaatggatatactccctccgatagattttagatagacaacatctgttgacattagtagtaatatgaggtgttccttaaatctaaaatctcttatgctttatggcgattacgcaacaattttgatcgtctgcttttatgatcaatggttcacactaaatattatagtaccatttttgtgaacagtgctttatataaaatattatacgtctcattatctcatgcgtgcatgtgaaacttgattcaattatataaataaaaatgtgtagcgacgattagtcactaattcttaataatattctaaacctagtccaatagagatatcattgttgcattatcgtatccgccgaagagtttattcgaaaataagattgaaccatgaatctctatacaatccaaaggttggggatttaattagtagtatgtgatgtatttacaattatgtataagatattacacaagaaaataatttgttagttttgtaaaaataaaatccatagtccaatctttacacaacaatggcaacaaaacactcaagaaaggcaataggcataggagtgggcagaaaaagactaaaccgaaaagatcaagactgagaccgaaaagactgagatcgagaaattcggtccagacaatgaaagaccgaatttcagttcggccaattcagttagtctcctcggttaaccaaatagaccgaataacaaaaaaaaagtctaaatgcaacctacaatccactgagttcaatatgattaaactatagttttcacatccctacttcttctaggcatgcaacctaataagagtctttattcatacgtgcttacgaattttttttgtgatttttgtgttgaaaatttctattatttctttgcatatatgaactattgttgaatttcggtcaggaccgagaccgagaccgaatttatcggtcctgatatttttgttttgaaattcgatttaactttttaaagactgaaagattgaagttcaagaccgattttcggtcagaaccggatgtcccctccctaaataggcatcattacccataacaaattcacacaacacgggtcgtgccatagacacgaaacgctagccaccacgccaagcgcccaaccccaactccaactccaacccgtcgtgctcaccgagaaaggcgaaattgaaaaccaccccaacccgagaaaattgcatatctaccatcgcataagattggcttcgcagaaataccatcacttaaatcggcttcgctagaataccactcccaactagaacggcttcgccaaaatgccattttggacaaaaatgaccctgcatctatctcttccacctccggcacgagcaaacgacaatggtgcgcggcgcggtagcggcaggtgagatgaggagcgaacgacggtggtcttctccggcgagttcgtccgcctcacctagcctcgcggcccccaacgccttcagtctccgcgacacgccgcctccgtcgccgacgagttcgacgaatcatccccattgccagtgagttcatctgttgcctcgacacaccacccccatcctcaacgagttcttccgccgcacctcaacgcgtcacccctatcgctggtgagttcgtccgctccgcttccgtcaccgatgagtttggccccatcaacgttgatgacgtcggctatggcctcctcttagcgcggcaggcatgatgaaaaggtggggacgacgaggagggcagcgcccccatcgtcgccgacaaggtggcactggtggctgccgacgagctcctccaacattggcattggaggaagggagaagaaccagggttatttttgtccaaaatgtcattttggcaaagccgttctagttgggagtggtattctagcgaagccg

SEQ ID NO: 70220 - DNA, 2180 bp, Oryza sativa
gccatagggatgggctcggcgctctgcgatgggcggtgggcacggcgccgcagaggcgtgtatctggcaccggccccacgacggccggcggcatcgggcggcgagcatgggcctgtcgggcaccagccacgcgacggccagcggtgggcggcgtgaagctagaactgcaggcggcgggcgggaggctagcgtttcgggattatttttatttttatttttttcactgaaaaatatcttcgcatgtggttggctatataaaccgtatggaaaaattccttttttgcatacggttgcgttgcccgcatggagaaatagcgatttttgcagacctttccgtgcatgtgggccggctaaccgcatgcaaagatcgattttgcctgcacgcaaagatttctttagtagtagtgtgcttgggtagccgcagcgagaacgacctccgctcctcgagcgagtcctggagcgtgtcggcgtggtgcgcggcgcggtgaccgttgaaggggtcggccaccgagtggtttggggagagcgacacggacggcgtcgccgcgggcgctcctgcgtcatgcccgccaccgccggagtcagcaatggagcgcggtggcgacagtgtgaggcagagaggcaacggcgaggagaggaggaggatcgaagcggtggagagagagagagagcagctgcgtcgggagcatgttctgcaggatggtgaggaaggcccagcagcgaccatatctacgatccattgccgtgaattggagctctaagctctgagctgtgaactcagctagcttcttgctgatctactgcctgagctgctaagctggacagcagcgggactgatgccatcgccatcgccccgatgccgagctgcttgctgctgctttggctggccatcgggagaggaagggagggagaggagaagaagaagaaaatatatacgggagtggaaagggatagaaaacgtgatggcgatggtattgtttaaatttgataaaatactaatggtatcaaactaatatcatgaatagtacctagtaaaaaacggatcggaccggcgattcaaccgaatagtcaatagtagtggtattatttcaatgttttttttatattttagacatttttaataaataattttaataaaaaaagcttgcagtaacttattaacttatttccaaaaatgaaccagccacaccattgtaatcggtgtggccaatctgaacagccatgccattggtcacgcgtggcatgtcaaagggtgcctcatggcagacgttgtcgttgacaagatcaatctggcgctgacgtggcacttctgccacgcctagctccttggcgtggcaggtgtagtctgccacgcccgacttgttggcgttgcagtgcatctagcccaattattttatatttttgaagaaaataattatgataagaaatttcatgtgttaggaatatttttattaatttcatgaccattgtggtttatgatgaacatgctaggtttgtatttagaaaattgatactaaacgggtaaagatcggataaagtttttccggtatttgtgaggtattactagaaaacttcttggggttttgattaagcaagagatttgatctacctagcattcgccaaattaacttcaagacgataatcatcatggcaacaagtttagaactaggcaacacttcaatatattttgtgaacaaaatattcatgaaatattggttgccacacttgatgaagatattctccccaaattcaaaggtatttatattagcaagcatacgacaactgcatacgtcgaaggacgtggttactcaacagttgttgggaacaataaagtgtattaattcaaggatttttcttaggatcctccctttacatggccctaggggtctagttatagtcctattacagatccccctattagggtttagattttacaggggaatttacatggttgcccttatgaaagggacacttgtatgggtatacagtgtaattgagatacatgggcctctaacgggccaattagcgaacgctggcccactggccaatgggctagagcggctgggatggccccttgggcctccttggagctggggttgaaacggcgaagtcatcctccttcggcatgcacccttcgccatttagtcttcgcccaggacgcatttgggggctgcaggaat

SEQ ID NO: 70221 - DNA, 694 bp, Oryza sativa
accactctatctattgcatcttacataagttggttcatccaattgcctaattcatcagttaacctagatttcttagtctgaggctttcactgtctcatgtcacactgtcgtagctgtacttttatattatgggcatcatatattcatgttgattaacacttaagcacataattattacgatgggtcgtttattgattattgtattattgttccttgcattgctaactcgatgtgtatcgattgcgtacacacgtaacatccgataaatttaatccgttaccgaactgattccgcaccattttcgacatccgaaacaatctgctccgtatccgcatccgtacactatccgcacccgcttaaaatatatggtttaggatatggtatgaccattatcgtccgaatccgctccgttttcacccctaaatgaaacaacgcccaatttttgagaaacaaatcgggcgcccgatttgtaattgctttgaagtttttgatagctggcccttttatttccggtaatctaattgtgggtctcattttgttgagagtaaaactaaaaattccaatttggctcccttaattataggtcaatctaattcatatccctcaaccataaaaccggatataacgaatacctcaactattaaaaccggtacaaaatgattcataagatagtattgatagtggtattggtgac

SEQ ID NO: 70222 - DNA, 1340 bp, Oryza sativa
ttcacataactattttatttcacttgcaatgaacactggttgatctgacaaattgacaggtactactgctgatgagaaatctgtccatgaacttaactagccccaactttgcggcacatgtaagtgttctgtttttgtatttgttctccactgatattatgcatcttgtagctatctaaacatgttatgagtaatttagagtttgaactgtactagcgttaaggtttgccattttggctagttattgtggttaggttcttgttagctgaatttgtgttcgaagtttggggtagctaataatgttttaaataacaaacaattgactggctactttcatgattactgtgatcagattgcattagttgcctaccacatgcttactctcatccacctgtgttcttctggatatctagtgtcaagttgaccgcatccatgtcctctcaaacttactttgcaggatttgatcctgattgggctggctacaacagccatagaaactttatacggaactttctttttcctgaataactaaataggatattattatcatggtttcgtggtatatagtttctacagatatgaaatgcattagctatgtcaataagggcatattttatgttctacacaacacttgcatttgacttcgatttgttatagtgcaatgtcctgacattttgactctacctgattgcagctgagcttgctgtcatcatgtaattctggtggggacccaattaagtctgaaggcatggaaaatcttggatctccacagagttgccatctcccgttcatgtaatacttcagttactctcgttttctaggtgcttgtaatctgattttatcccatcttgctgaagcaacttttcgtactccagggtaacaagtgagtgagggagaactgcttgtatgcggacgaagcttcagttgtttccacaagacgttctttgttctctttgtactggagttgtggacggctgatccggcagtttaccaacgctagcacgtgttgtggccgtggcatctgtatagcttccaataatgctctaaccctaggctagttttgctcatcaatcatgttcatgtagatagccagttttgtgtgctcagcaattctttttccctcggggtggggcatggctcgaaatgtttttgtatgtgtacatctttgtatacatgtatgtaaatatgtgtgatcatgtaatgcttaaagatactgttgactgatttgaggtaataatacaataaaccagtggggcactcgggtgtagtctctagggcgccccactgttgtgaaatgtgagctctgaagttgtggactatcttcaaagctatgacctagt

SEQ ID NO: 70223 - DNA, 2046 bp, Oryza sativa
aaatttctaagtctattacgcgcggcagtttttggacttcagttcaaaattcactcgtgactgttgggcttcaaacgggatgctcgactacacatcaactccgcgattctcgcacccggaatgataacgttctagacgcccgaagtcgcgaatggtcgcatgagttcgtttttgagcaaaagtcggaggctactgtcagggttacgggtcaggcataccccctacccttcgatatacgatacgtatcgacatggcatacccacgcgcacgcggatatttcctttatgatctaaggaaacctttcacgaaatcaatagacgggaaaaagtccttctcggacaagaactgggttacctacgtatcgtgctaggtctggtatcttcgagtcctactcggagagtaccagacctgtcatataaaagggaccccccgagaagggcatagatcatcgaatctcagaatccacacagtctaagaagccggagcctgcgaggagccaagtcgccgagagctagtcgaatcaactcgactacaatctcgccggatctgacaagtttcatcttttcctttgtaacctgtgttttccaccatataatcccacatcaactggattagggctattacctgtcaaggggcctaaaccagtataattcttgtcttttgattgctcgatgtcgtactacgtagatctttgtaccagcgtaccccaataccctctatatccggtctacgggtatcacccgtcgacagtgctacacttttgaaatcggtagccaatagtctcttattccactataggtggcgtagttccattagaattgctagctaaagaacattatgtggtttaacgctagtccataataaagagaagttggagatttgtctcatcgccttatttctcattttaattttaattttatctttacccttttttattattaaacttatgactgtgtgtcttatgatagaagctggagatgtaatccattttcattatctcaaatccagtactccatacacgagtacatgtcggatgtaaataaaagcacagattgtgcactgcattagcacacccatcacaagttcacaactcgcgagtcacagatctaggttcgttgctcgtcgtgactcgtgacgaagtagcaaacaacgataagaaaagagttctcaacggttggcagcatgcagagcatgcgttacatgacagcacaatctgcactacaagcatcgtcaaatccaagcatattctcgcaaatctgcttgagcctctccagcccataccgacccgcggcttcattcaagctcatcaccatcgtcctcggcagcaggggatcagaaccatcctctctccagtcgagctccatcaacgtgtcggtgtagatgaaatggagcagcgccctgaagacgccggctctcatgtcgtccttgacctcaacgcgcaccgacccatccttcttcctcgtgccacctttcaggacggcggcggcgagggacggcgacctcgcggcgagcacgcacctgtgcgccgcgatggacacgccggaaacgatgaactcgacgtcggcgaatctcccgctccgcagcagctcaccgagctgcaggtgaaggtcgggggacggctcggccgagttgatggtgttcttgctgagcaccgtgatggtgcagcgcacggcgaaggagtcgccggtgatgaaacccgacgcctccagctccctccgcttcacgagcagaacccacggcgagctctcgttcgcggacccgaacgcgtgcgactgtcgctcttctcctcggaagcatgggagcgcgtggtcgacgggtgcaccaggcagcagctgagctacgccttgatggcgccagcgtcgttgtcgtcgtcgtcgccgccggcgcgctgcgcctgctcgccgatgccgaggaagacgagcttgaaggcgacccagtagtgccagtgcgcatcgtggcctggggtgtagtggatctcccacgcatacccggccacggtgagacgcttggaagagacatgctcgtgtttggccatggctttcgtgg

SEQ ID NO: 70224 - DNA, 728 bp, Oryza sativa
cgctggataactggttttgcgggacgattttgtaactcgatgacaagttgagggaccttcggtgtactttttcccccagaaaatagagtactatttttcctgcaaaacacatatgggctttcagcccaaaacaggtttatgggaaaaagttcctacctgagtgcccgataaaaataaaaatatcgggcgctcctcattctcagccactcgtttcttatctcgctctccctcttctcgcttctctcgctccctcttctatggacgcggccgagcttcgcggcgttgacgatggcggcggcgcagttgtggctgacatggccgagctcggcacggcatcgacaacggcagccacgcggttgtggctgagcttggtctgcatcgacgaccacggtgcagatttgccacatgagcacgtggtagtgattctagggtacgtcggtgccacctcctcatccacagcggcatctgtaacgccccgattttctttcgggattaaaaatcattaaataatatattttttagaaattaaataaaagttaagtcaattcaatcaagtgaaataatgggagaatttaaaatttttcctttaaaaatcattggccgagaatattttgcaatactctttgtgccctaaatattctccgaaattttcgcatgaattttcggagctcaaaaaataattttaatagcacaaagatcatgtaatcaattaattaaaaagaaaagca

SEQ ID NO: 70225 - DNA, 1554 bp, Oryza sativa
aaaggacaccaatgtgtgaatggggagattgttgaatagtcgcacattggttgtggaagaaaaaaggatctaagatataagtgggggagcccctcatctcattggctagctttttgggtgggaaagactctttacgatctaaaaaaccaatcaagctcattacagcttgaaatgcgttacttgttctgttgttcccacacaggctaaatagccagctaaatataacactttcggtaatgtcacgcccggaaattctatagtaatttccgaacttatttgtgcattaaatcctcgtccaggaatcagccgaggtacacaaactgacaatttaatatacagattcatcaaattaactaaaacgataaatacttacttatgaggcacttagtcctcaccatgaagaaaactacagcggaaaaaataaaatctagcgaagctccggctccactcccacaggcagctcaactggggtataagccaaacgtcttctccttctggatcctttttcttcaactgaggttgattgattattgcaaggtgagcatataacatactcagcaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccattctgaacaaccatacccggctgaacagatctaactccaaaccaggagctaagcaaattattaccaggtataacatccatagttatgggagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatatttcacaacagtagctcgcgaaccggtccttaattgtcatgagcacgactctcaaaaccatgtgctcacaacccaccatcatcaagttttagttggcaaataattaattaaccaatcacgattgaccatcgtgaactatcattaagccatcattaaataataatgagtcataaattatcccaatagtgtgctaatgtttctaagcatggctaagcaattatatctaatatctagttgaaccaatatatatataaagctcaactagtccaattataataacccaaggtaacaaggaataaagtaatcaagaacaaaagggccataacaaagaataggttaattccacccaatgacatt

SEQ ID NO: 70226 - DNA, 1936 bp, Oryza sativa
aaagtagactttgcaaggggggcgaaagggctgggccgagggagagggataggccggccggggagagggggggcatgggctgcgagagggaagggggatttgggccgaaaatggcccaaggagagtagaaggagttttaatttgttttctatttaatataattgattaaatgaactttgtgtctttaaaattacttcttgagctccgaaaattcgcaggaaattcgagagaatatattaggacgcagagaatattacaaaatattcccggccatgatttttaaaggaaattttaattccctctataatttcacttgattgaattgctttaacttttaatataatttctagaaatgatttttaatcccgaacgaaaatcagagcagtactgatccgatggttaaagcatacatcagctaaaaatccgatgtcataaaatccaatcgatttagataaacagtgaaacctttgttgcaatcagctaaatacaatttgtatgtaatctttgtaagaagatgtaacatccagataacttatcggctagcaccctgataaaacattagcatgaacctatcggcttaacaagaattatattaacaataacaatctagtaggttggatctaaccgatgcagcacgagattatatatgataatctaatactcgatgagccgatagatctgtctaatgtgatggatataataaatatatctataacaacattgtgattgtagagatatatcggctaagacagaagatcagacctaatctagacagtcccaactaaaccgatgcatctctaaacacaatgcaattagagatagaattgagatatcaggtaggcaaatatatcaagcaaaccagagcgatccaagagatcgaagcgatgcagccttgaacaacaccaatgtagccgatagattcaggaccaatggaacgtaggacttaccccttcgccggagatcaaactgaaccgatgcagccccgcgtcaggtgccaaattccaccagttgttaagtaaaacctcaaaaaagagggtggcgatgcgccgagagtagtattgatcgagagataaattacaatgaccccgggtgtacatatttataccctcgtcacctccgctgcggcatcgcctctcgctagccgccaaaccttttcatctccctcctcgccccgccgacatcctaccgacctgccggcctcctgccttctcaagcgtcgccacagtcaccgccgttgcgttgcccgtcaccggccgccgacgccctcctctcccgcctcgccccgccggccagcctgcgcaaagaagtgagagagagatagaggaggaagggagagaagaggggaaagagaggtgccgacgtggacaccctgacgtcggacaaaactggggccaaaccacctatggacctaaagcgtgagtgggcaaactaacttgggactataggtgatgactggtctaaaagctttatctacctattattttagaaacttaaacgtttgaaacctagtatttaaactaccatgtttgtataaatggctaattctttcaaacaaaacagataaaatagggcaagcattgtaggcttagcatttaagattatgcaatataaatataatcactaaatgcccaatgcatgttagctaaaataaaatgacaaagagtgatcgtttggatcatacaaattcctaatgtttaacaaaaaaaattagagtaaaaatatttaaatcatgaaaacaatcataccacactacataataatcacgcatgcagagttatttttagctatgaaattatgttcttgttaagctatatggagtctcacacactctgcacgacaatgagctctctcatactgcgaaatcaattaagactcgagaaggctttttagaaggctttttatttgaaatatatatagtgtcacatgcacccaaggc

SEQ ID NO: 70227 - DNA, 19556 bp, Oryza sativa
  unsure (1)..(19556): unsure at all n locations
atcgcagaaattatgactacagaatcaccaatgcaatggaagcttatttgagagataccttgcatatatgccctttgtactcttgtaacagttccccagtggacctaatcaatgcaacaaaagataaatggatcaatcaccaaaagaaacaatttaatgatgaaggtgcacttgcagtgggttagggccctccacatagcattttgtaaaaacaacacccacgaattctacaaaataacatggtcagagtcacaacatcccctgttcagtcagttttcataatggaaacatggtagagttttttttttcttttggtctgagtcagagttgaattttgtggcagcatgtaccacaagtccacggcattaaagttagtgatgcactctaaggacttgctaggaaataattaaaggatagaaaaaaccaccctttacaaccatagcctctcccttcaaaaaacaaaacaaccataacctcttacattccatattgtactataacagaagcaggtctaacctatgaatgacagacagacaatcataatgcagacactgtaagtagttaagcacaagtgcacaacaaaatcatccaaagtagccaggtcacgtggaccacaagcaaactatggctcctaaaccatgctgttggtatggatttgttcactaatacatggtgtggcacaacaatggcacattaacttcacttggcttgacatttgttgcaaagaccaaggacagtggtccatttgacattaaaaaggtaaacagttccataacacaagttaacttgaagctttcttttccacaaaacaaaagtagtgtctaaccagattttgcaatacaaactcccaaattgtttctttaaaggaaactgcagatgcaaaaatgaagtagctccacaggcaacaacaccaacaatgttcagcacagatgcaaaatatagttgttggactcattctacttgctcttggaaagcaaattttgctagcatgtttaagaggaagatggcagatgagatcactgttgtatcagagccgagcaagaaagcccccacggattgactaatttaataagggaaacagcatgttatccagtaaaggaatggagtgagctccctaactggtgagaaaagtaactaatatgtgaaattagtgttagcagaaaatgctgttatgtcgtcttccaaattaaaaattgacagagggtgttgttttgtcactcttgaaatagaggagggactgccgatgttgaagtataaagtcagcttgcagagaatacttacttgtctagaagcctcacagtagaatccaaacaattagctaataggcaattgcggtcatttgacaaagatatacagttgacaggatgccccaagttgtcgacagtctccctgttatcagcaagagggtaacagaagcatcagacacagtggataatctgttgaagcatggataagcatctgaatacttctattcaaaaagagaagcacccaaagttccatttaggaaagctaagataacaaatgagaattggttgaatattgattgtgaaataagaaaagtacttacctacccatgcgaatgtcaaatgtgcggatagtaccatcaacactgccagcaattatttctgtgttggttaaattaactgacattacactatcttgaaaagtatcaattgtctgcaccaagtgaaaaaaatcaccagaaacccagttacccaagtatatgagaaacaaaggggaaataatactactaaaatcaatgggtccatgttcttcaacaataataagaatacctgaatagggtcactgctctgtgatctgcaatcaaatgcacgcactgtgcgatcatagccagctgagactacaactgtgttaaactcattaaacttcactgaattgatctatggaagacagaattgaggtatgtaagcaatattatcaaggatcaaaaacctgtcaccgaggttgttcttgatctgttttcagtatcccaataatcatattgacgatgtgcagtgctagatttaaaaggaagtacaacaacaccattacagaggtatcattacagcacactcattttcacacaattcaccctgcaattgactagttgtgactagatcgataatgctagagtgctgatttcgtggtgttctccacatagcacaatggaacagacgttgtttgattataaacagtgccaactgctctattccactacaatctcaggctactgctaatcctatcataaacaaccgtgctctctctgtatagataaaatcaatactagtattgaaatagcagcggcgcttaacacactgatagtatggtgctgaaactgcttaatagtacaatttttcatgagcacttctcacttgctcaatccaaccgcgatcaccaaacaattacaacagcgcggtcatcatcacagtgagaattggggtccatacctcgctgttgtggccgcggaacttgcggatgacacgggcagatgcgacatcccagtagaagacctgcctgtccccgccgcacgacaccagcttggcattgtccctgcaagcaaaggatcctcaaattccccactggtgctcagctcctccaaatcagacaggggaagttggtgttggggggacggaatcgcagcgaggaagaggaagcgaagtggcttacgaggaggagttcacgtcgcggacctcgcggccgtgggacttgtagggcttgacgagggcgccggtgtgggggttccagaggcggatgatccggtccttgccgcagctcaggcagtagttcccgtcccgattgaatcgcaccgccagcaccggcccctcgtgccccgacagcaccctggcctccgtccgcggcagccgcgccgccgccgccgccgccatctccccgcttcctcctccttcccggcgtcggtgacggtgacgaactaggtttcttttttttcttttttcttttttcttttttttcttttgagatataaacggcgacgggttcccaacttgggctggcccatgggccgtgtaccgtgtacgagtcggattcccccgaggcccagactactactatccatccgtatatccgtacgccggagagccccgccgacgtagacgaaaccggccaaaactaatccaatggcggcggcggcggcggcggcggaggggagagggccacggcgcgtgcgcaacacctgcatcttggcgcacgtcgaccacggcaagaccagcctggccgaccacctcatcgcggcgtacggcagcgagcgccgggtgagcgagaggatggccgggagcgcccgcgtgatggaccacctggaggaggagcagcggcgggccatcaccatgaagtcggcctcgatcgcgctccgccgcggcggggaggacggcggcggccaccgcgtccacctgatcgactccccgggccacatcgacttctgctccgaggtctccgccgccgcgcggctcgccgactcggcgctcgtcctcgtcgacgccgccgagggggtccgggtccagacccacgccgcgctgcgccaggcgttcgtcgagcgcctccgcccctgcctcgtcctcaacaaggtggaccgcctcgtcgccgagctccgcctcacccccgccgaggcgcacgcgcgcctccgccgcatcgtgtccgaggtcaactccatctactccgcgctgcgctcgcgctcctacttctccaccctcgacgccgcctgcgccctctcgcaagaactccccgacaacggcgacgccgccgacgaggaggaggacgcgttccagccgcagaacggcaacgtcgtcttcgcctgcgcgcgcgagggctggggcttccgcctcgtcacgctggccaagctactagcccccaagctcagagccgaccccgcggagcttctcaaaggcctatgggggcagaagtacttcgacgagaggagcaggacggtggtggggaaggaggccatggcggcggcgacggccaacccgaacccgaagccgatgttcgtcaagtacgtcctcgagccgctctggggtcagtaccacaagatgaagcggaagctgcggctcgcggaggcggtgttcgacatggtcgtggagtgcactcccaaccccatcgccgcgcaggccaccagggtggcaaggctcatgccggccgccaagacggagcagctaacggcggccgcgccgtgccccgccgctgtcgccgcggaggtggagaaggtgaggaggtgcgtggcgacgtgcaacgcgagcaccagcgcgccggtggtggtgttcgtgtccaagatgttcgccgtgccatacaggttcctgccatccaggggcgtcaatggcgagcccctgaaccacaggggatcatcatccagcgccgaatcaggggagtgtttcttggcgttcgcgagggtgttcagcggcgtcctccgtgctggccacaaggtgttcgtcctgtcccccatgtatgatccactgagaggaggggacgacgcaatgcagcagaagcatctgcaggaggtggagctgcagcacctgtaccagatgatggggcctgacctggagatcgtctccgccgtgcgcgccggcgacgtgctcgcgatcgaagggctcgggcatcacgtgctgaagaacgccacgctgtcgtcgaccaagaactgccagccgttctcgggcatgatgttccaggtgtccccgatgctcaaggtcgcaattgagccctccaatccgtcagatttgggcgcccttgtcaaggggctcaagcttctcaaccaggctgacccgttcatcgagtacaccgtctcggaacgcggcgagcatgtcctcgctgcagctggcgagatacatttggagcattgcatcaagaatctgcaggagaggtttgcaagagtccagctggaggtgtccaagccattggtgtcgttcaaggacaccatccaaggagaaggtgccggtataatggagagcctgaaagcttcacatgaatttgttgagaggactactccaaatgggagattcactgtcagagttaaggtcttcaggcttcccaatgctgtcactaaggtcattgaggatagcaaagaattgcttgctcaagtaatcgagggggattcaggaaatagtaatggtgtgttggattcacggttttcgcaggatggcggtgattctgcatcaacacttaggcagctcctcatcaatgccatagacagtgatctcgaagcgctctctgctcagttggatgatgaaaagacagagagttacagaaagatgttgattgggtaccttcagagaatctgggcacttggtcctctgcaagttggaccaaatctcctcctctcacctgatgcaacatcaagcgatggtgtggtgaccagccaagatggaagagaaggtattctcgtgcgcggtacatgccatgtttctgagaggttagggcttgtgaattcttctgatgcaaaaactacaattggcatcgacggcagtcaatcagcagtagatggtcttgatcctgaaacagtgaagaacagcattgcaacaggatttcagcttgcaaccaatgcaggaccattatgtggtgaacctacttggggcttgatattccttgttaaaccttacatacttccggatagtgcagatgctagcaataatcaatctgaccattacagcaccttcagtggtcagatcattacagcggtccgagaagcatgccaggcagccatccttgagagcaaaccaaggcttgtggagccaatgtacttctgcgaactgaccacacctactgagcagttaggttccatgtatgctgttcttggcaattgtcgggcgagggtgctgaaggaagagatgcaggagggaacctcattgttcacggtgcatgcgtatttgtcagttgccgagagctctgaattctctaagaagctcaggaatgcaactgcaggtgcagccagcgcgcttctggccttcagtcactgggagactgttcctcaggatcccttctttgttccgaaaactcgcgaggagattgaagaattcggagatggctcaaacattggcccaaacctggcaacgaagctcatgaattctgtgaggcgaagaaagggactgcacgttgaagagaaaattgtcgagtatggcacgaaacaacgaactttagctaagaaagtatagttatgtttactggtatgtaggagctaacctgttgttttgtcctggtaaattgagatatgttagtatacaaccaaaaccaagtatgcattttacatgactgtgcagttttgatgtaccaaaaatgcatcattttacatgattatacagttttgatgtaccaatgattttatagtgacatatgtatagtataggtgacaatcagatgacaaaagagtagcaacaagatggtaatttgccggaaactcctgtatatatacgttgaaattgttggattattctgtgtaatactgtcagctgtacggatggataatcttgtgggttgggtgtatttatgaagagaagaaaccctgctatattttttttaacttcctgcaatggtgttttctctgctctttctgcttaggccgtcttgccggttcctgtacagtatcgtttcttgcgattactgcaacaattatgcggttgatccattgtctctttgcaacaaacaaaacaaaatttcaacgtgctgtagtacataacatggtttatgcaaaagtcctcaatgtgcatatcttaaaggttttcagcgtgaattgattgaacagataaaattatcgttccgctctgattttttttttttcatttgcacagaagacagatccccaataaagcaataactagaatacggtatcatctaggttaaacttctaccggtaaacttgcaaactagattggaacacatcagagcattaataagaaatcttcactaatgtattaatactagttcagtacttcaagttgatgaagtatttggatgcttatggggagaaaaggcacttttttttttttgaaaggaacgggagaaaaggcacttgaaagaagctaccagtataaagcgtcaaaagaaaattccagtatgtattatgatgatcaacttggacttagcaaacttgtattgcgcgtaaattctaagaactacagaatttccacttatgtttggactacaaagtgtataaatgcatccatttgcgtaagctctttacatgatcaacttaaaggaccatataaccatttcacataaacggcagcaataacctgacctcacatactgacgaactatcggtttcagtcatgcaaaatcttttgaaacctaatcaagagagtaagatccagagatacacccatggatgatggaacatagtgttaaaacccttaccagaaccaccaaaaggattaccagtactaacaacctgaaatcagaaattatgggaatccaaatttgaaatattacctattcattacaaatgcacgacaaatatagatatgtggagctggagatactccctaaatgttttaaaacatggaaatcatgtagtaggttcacaaatactgtaacatctagtagtaaacaattagctggcaaagattaggtaacacttttttattctttccacattgttttcagtatcaacagattgtttgcagagttaactacagcagtcagactgcctaacaacgaaatgaaactgccatgccaatctttttcaaattttcggttctcatatttcaagcattgatgtagagtatcaattgtctgcaccaggtgaaaacaatcaccgcaaacccaagaacatgagaaataaagggcgaaaaagtactaccagaattatatcactgctctgtgacctgaagtcaaatgcacgcaccatccatttggataagctatttgcatgatcaactttgagaatcatattatcatgcatttctcatacaatgggagtaaatcaaacagaacccacataatcataatgattaaccagaaattagaaactgtggaagtccaaatttgaaattgccaattcattacaaatgcactactaatatagctatgtggagctggagatatgccttacacgtgttcaaacatagaaaccatgcagttggttcaaacactgtagcatctaggaacaaaaatcagtaaacaaatactaactgaggaagattaatatgcctattcattcctaaatgtgcactgtcaatatcgcaacatggtttcagaattgagtacaacaggactgcctgacaataaaatagagctatcatgccaatcatttttcaattctttggtttacatatttcaggcattgaacgtgcagactaataatcaaatcaaaatttgatactactttcctggaacacacaactaaagcttgggcttgacaattttcaaagcacacgtatcatgtgctatgcaactgataaatcactgcaaatttcatgaagcatacatttcatactaattggtaaactcagtcagcatggcagaagcctgaaataactagtagcttctgcctatgtacttgtgctgttgtgcagattatgataaacaaacaagacaaacaacaaaggatgcaacactatatattgtggtgaacagtggttagctttttcattcagtatttcagtccaactgaaaattcagaaattaacagagagcatctgtatcaacatgaatcccaaccagcatgcttgctactaaatacaaaatgtccaaatgacttagcaacagcaacaaaccaattctgtcgaattgattgccacaggcaatttcaagcttcttctacatctacggaaacttgaacacacatctaaagcatagattcagcagattgcaaaacctggttgctatctagcagattacggaccttggaagaacggcgggtcgccgtcgattgcatcttcctgccgcatcggaaggaacgcatgcgcaagaaggctttcctggagcatatatctggacaggacggtgaggtggccggcgagggagtaaaacatgagcacgttcccctcggtgtcgcactggagcatcatcgccgggcactgtgccagcacattcctctcctgggacacggcgaacactgctgcggatacgaagccttcgtcgtcgtagccaccgaaaacgttgagcagatccaccggcagcgagatctggtaatggtgttcccaagcctccccttcctgaagaacccagacatccacggtggtctgcgagacgagcgtcatggcgagcctcccgttgatctcaagcagctggtctccctccaccgggatcatctgattaccttcctgttgattcgggggaggtatccacccgaaggactcggcgaccgtgtcgaacaccagcacgttgaggctggccgcctgcgcgcgccagtgcagcctgtgcgcgatggcgacgggcggcatctcgtaggaaggggagatcccctcggcgagcacggcgcggacggtctccaggtcggcggggcgcccgatgtccctcggcggctggtccgggaagaagctcagggagaagacccagtagcggcagccggggcgcgccgtgtggtacagcaccctgtactccctctcgtcgatggcgccgtggccgtagaagccgacgatgacgtggtcgtcgtggagcggcgggaggcggcgccaccggcgcgtggaggggtttgaggcgtatagcctggtgtggtaagagaagaggaggatgccgtcncangagccctcgatcgtgaacacgcgcgggtcggcgctgcggaggtcggcgtcggcgtgggagaagcagatgaccgggtgggtctcgttggcggcgacgtcgacggcgcggaggtggacgcggacgcggtcggggaaggcccagtggtcgaggcggtagaagaagagcggcatggggtggcgggagcggtggcgctggtggccgcggcggaaggagtccgtggcgatgaggtcgcgcagccgcctgcagacgccgctgcagcgggccacctcggcggccggcatgcggaggaggacctggtggagcgcgtccacctcgacgcgccgcagttcgcgcggggcacgaatccctgctacattcggcaagtccctgttcgcctcctcgtgttcccctccgtttgccgccgcagcttggtcgttctccgccgcagcctggtcgttctccgccgcagcttggtcgttctccgccgcagcctggtcgttcgccgccgcagcctggtcgcctccgttcgccgccgcctccgcctggtcgtctccgttcgccgccggctcctggtcgtctccgttcgcgacgatggccggtgggtggtggtctccgttcggcggagcatcctcgtggccaccgttgtccgccatggccgacgaggcgagatgggggtgcgggtggaaacgaccgttggtggtgggaaaaggagagaagaggaggaagaaaggggagggcgagatttgcgggggggatttggtggaggcggcgagatgagctggaggcgacgccgcgtgggctttttgtactactacattcggtgagaggaataattggaccggatctcagtttgcgagtttacttgggccacaagtataaggcggttaggccttaggctgaaatggcactgagctgagatatccgaaattcactactccatttatgcagtgattgtgaaaacgcatgtagtatagtgattggagtgacatgagtagcatctcaaggtcctgagtttaaatctctgtaggagcaaatttcaaattggattgtttaaggtattaagttcctaatttaaaagactacatatatccgattagatatagagaccgggtgaaaaatacccttccctacaaaaaaaaaaagttatgcatagactatcagattgtcaatgtgatttactttttactttttagaagtcctgccacccgtcgtgaccatgttgcttaacggcttgtctatcgtcccttctcttaatcatcattgagattctatttgtgcttttgtttatagtttttagatgtcgcatcaagtgccaccaacttactcctttacgggcctaatgtttctctcttctttatggttacctgtcatgtttgagttctagatggactttttttttgaaaattccatatttttcgttccgatattttcttatttgtaaagtgtattcctacttgaactcttagaattatttttctatttttgaaatttattttattttttattttgaattttaaggattcattttttaatttctagaagtcccgccaaccgccgccggctccacaccattatactcctatatggtatacccgttatctcccctatctattatcattgagattctaaaaaaaacatgattgttattgtgttttatttttttttactttatataagtcccgccaaccgttgtgactatactgcttaacgtcatgtctgtcgttccacctcttaatcgttcttgggggttctatttgcagttttgtttataatttgtaaatgtctcatcaactgttcaccatcttactattttacgggcctattacttgtctcttctttctttattgttatttgtcaccgttgacttctaggttgattaattttttgaaaatttcaatttttttattctgatattttttttatttataaagtgtattcctacaagaactcttataattatttttctatttttagaatttattttattttttaatttgaattttaattattctcgtattcagttatataagcactcttcttcatatattaattatttttaattccgaatttcagttatatctaaattgtattcctgctttaactctctttttctcttttctaattcagaatttattttatttttaattcagaattttaatttatctcgtattcgattccgaatttccgttatttctaaattgtattcctacttggactcttcttttcttttctaattcggattttattttatttttattccaaattttgaataatcacatattgggtttttatatggactcttcttttaatattgcttatttttaattccgaattttatttatttttagattgtatttctacttggactctccttttctttttctccgattaatgtgggaatttctagtccccacagcgaacgtggtaccttctttcaaggctgttttaataatataatttttaaaatctcaatgataataaaaatatatgagtatagtaaagccgacagtggttgggcagatttctagaaagtaaaagatgaaccccaacgatagttatgttcaattttcaaaatcccaataacaataaatgtgggagacaacagacggatcgtggagaattacagtattgatgtttgacaacactcctaaaaattataataagggaacttgacgagacaatggactctaaaaactagaaggtctattttttaaaggtttaaaggaagataaataaatccgtgatagattgggtaaacagataaaggggtgataaaagagtaagaggtaacgactggtgtgacttttaaataaaaactataaaaatttaaggatgataaggttcgatcttttaaaattataagacaacataatggctatttaacaaattttaagtaatatcaaatatagaaaaatagataattttatatggatgctagccgcgcaattgcgcaggtcacccagctagttaatagcaaagaacagtttgtgcatctctcccgatcgggcccaacgtgtcccggcccatgaatcccatgatcgaggagcctagccccccaacccggaattcccggccatgccgaagcccaaggcaaagaggcccacgccgccacgggctcaccgcagatccacccccacgggcgcgggcgcggcaggnctgggcctgacgcccacggcgtacgtgggcgtggactacgcgcgccgccacctgccgcaggcgtggtggcggtggcacgaccggctgcagccggcgctctggggggcgctggcgttggccgccgccgcgcgcgcgcccttctaccgccggtgggacgccgagctccgcgccgcgccgcggttcttcgccgccatggcgctcatgctcgccgcgttcctctgggaggccgtctccgtccgtttcgtctccaccgtcctcggcctccattggcaccggtcagtcccttcttcttctagccggccgcagcgaaatcagcgagggtttctttttttggggggtttcgggtaaaaatgtcgggggcttggtgacatcgtttgttcgcgttcttgcgctaatcatcgtggagcctgtggatcgcggttgttgtgattaggatttttcgaagaagaatgctcttgcagcggttactcgtagcaatgtgtaaaactgagcattgattaactgtggttcaaatgcttgatttggttaccccccaatcaaaaccatttcggtgaattgcttgctggtaggattgggttttgctttcgtttatattttatttatcagatgatttgcaagacaggtactttttacctctggtaacggattggtgtgagaactgagaactgtagataagacatcaattgtttctgaaatctaacaattgtgggttagtgcatttctattagttcgtgaagattaagaatctgttcttagttcttgctcacactttatttggatgattaactcaagtccacaatgcttggaaactttttaaggatcctagtggtgctttggataggaaatagaatggttcctttagggggaaaacacagaaatctattaactgtttatgtgcatttatgcaacattttgttccatatataacctttttcgccttgttagttaaatatgtagtgaggttagcaccttcacttttttttttccattaatggtatgttttttactccacccatgaaattgaactaccactagaagatattactagtagtgaggcagtgacaactttttgtcctgaccaacttcctccctttgtgcttatgcttatttgactgcactgtttattctgcacttttgtgccataaaaatcttaacaagagataaactaagactggtccatttttttctccacagatctacagctcctcttcccgacactgggcagtggctgcttctagcattgaatgagaaacttccgcaaattgtggttgatctcctcagagcacccatcatcagtcttcatcactatctgatgttgtttatcatgctggggttttcagctctgtttgactgcatcaaaggccctggacttggcatagctgcaagatatatgttcacaatggcagttggacgttcgctgcggactgtaacatttcttgctacgattctaccatccgcgaggccttggtgtgctgaagctcgatatcaaatacctgatcatcctcatccttgggcacagaaatactatgctccatatgcctctgatccagatgcgatccgtagggtcatacaagaggatatgccatatggtcagcacatccaacttataacccttactgatatggcttcttttattggcctgcagtagctaatgttcttccttcctaattatagctttcgttaaagagtaccctcgtgagtatagacctaagtggggacatatgagcttcttagtagacattttgaggccaactgttgaagaggggtcctcatggtatcattttctgaagaaggcaagtggtggctgcagtgatcttatgtatagtggccacatgcttgttgctgtcctcaccgctatggcatggacggtaagctatggctattttgtcttccagattgtcacaagtcacgaccaagatgcattcatttattctccttatgccctgctaaaaccaaaacggaattaactggctgcacgttaaatcgaaagaatgttatacactcatcaagccatccttgctatatgttcttttaaaaaatgcacatggttatgcctgcttttatagtttcatggcctgtgtcaatgcatcattaattggatttatttctttgcaagtgacatcatgaaccagttttaagcattccctaacatgctctgtgataattattgttaaatcaatcaagcactacatttatgtgacagctaggactcttgcggtgaagagttcagtttacccttgtctattttcttttcgtaggcatggcccttcctcctgatgataactccatcttgattaatttctgtgttgggctgttacttactgttcaattatcataatagatcctttttccatcgtcacaggaagcatatgggggatggatctctgttgttatatggtttcttgtcctccacagcgctcagagggagatacgggagcgccatcattacagtgttgattgcatcgtggcaatctacgtcggaatcctcttgtggaggatgactggtttcatttggtctgcgatagacaacagtcatgccagaaggcttgcaaagctcgacaaggttcagaacagactatttcaggctgcaaaagattcagacatggatgaaataaggggtctgctgaacgaagttgagctggctggccaagagaggaagggcttctcgcagcgtgtcatcttgtctttctcctctgctatgatagttttcaccctctcatgtgttctcctagcattcacactaaccagcgatggatgatttcttcgcaggcttcatactttcagtttcatattggcagattgagttttacttttacatgatcccagctctagattttttttgtagtgtaggttgagagattacgttgatgctacttacctagtagttgaattagcagtgaaacttgtttcaggggtgctctctcttggcactaaatttttgttgatatctgtagcaaacaaaatctagatacttgtgaggaaaataaggattatctcctgtgttacagttgttgagaagccctttgctaatgagatgagatggttatgacgataatggtggtggatgtgttagagaattagtgatgggaaaccatgtgaaccattgatgcaataatgcattttaatttgttttttcagtccaaagaaatggttcttcccatggcagcctgagctggaacatggaaatggaccaatgactccacgagaatgtggcccgcttgtcaccaaaatcatctaaaaatatgatttggaaatatatgctatattctagacttagtcaagctaagctggaaattttatttctagactcttattaagctggagatgtctctgtcaattgatcgtaatttggtttgaaagtcagctcatttctacatcgtcagacaagtattaattgtagtgcttctggtgatgaattttgtgaaccattttgaaggaaaaggaaagggataagttgcagttaacttgtaaattgccagactgatacacatattatctatgcgcgcgggagatgatttcatacatatatacgagagtattttacaactgaaaaatgtcaagtttcagatatatttactgtgagttgttgttatctattgatcgtaatacaggcagaaactagtggagttttcttttggacaattaatccccggacgtgcgcaaggcgtgcattcagacccttgacagcgcctcaaagtgaaaacgaaaaccagggaagggatggacaaatgatatctactactccctctgaatccaaatgtaagttactttagccttctcaattctttcctagatgtaaaatgtaaatcttgtttaaactctttctttaatcttttcttgtatatttgcttttgccaaataaatgttatcctcctcacaaatacaccgttcttcttttctaatatagtcaattcgatcaaataaagggcaagaaaattcttgtgtacaaatcagattgcgtataccgtgttttacatagacggttctgtggttttgcatcgttcccgcggttacttccagcactgagcgcttccaaatcagcgctctgaatttctgaagccgcgagttcttccaattcttcgctatgaagtactacctccatattcatattttaatgtatgacgccgttgactttttatccaacgtttgaccattcgtcttattcaaaaaaattatgtaattatcatttattttattatgacttgattcttcattaaatgttctttaagcatgacataaatattttcatatttgcacaaaaaaatttgaataaaacgaatggtcaaacgttggtcgaaaagtcaacggcgtcatacattaaaatacggagggagtactagtttgtactacctctatcccaggacatagcaatttaggattgatctacgtatcttatactacaccaacgaatctaaacatatggtatgtagtactccctccgtcccaaaatataacaacctttagcacttaggatttgtcccaaaatatatcaacttatccatcatcccaaccaatcacagccctccaccatccacttttctcacctaccttcactactcatccaaacacaaccctccaccattcatttctgcctacttttttaataatcatgttcaactctaaaacttattatattctgggacggagggagtatacctgacacgctttcgatctgcctggtctgcatgatgatctctggtttcagaattggtacaaagggctcattcagaaaagtcttgaaattcacgttgtcatcaacggaaaataggacggttggccgcttggcccaaatcacaccgtggggccatgagttgttgatctaatgaacttttttgaaaccttgatccaatgaactaggcactcgaatttgctaggggttaaggtataaaagtggttcggtgaaaatattttactcacgataaaggtagaacaacaagtaatttcaaacgaaagaaaaatctgtaggtttgaacccacaggtacaagttaaaaggatgtgcttgaacaactcatgcagttttaccgttcattttctgaatcttaatttttgtatccttagctctgaagaaatcaagaaaccgagttcaacctactttgtcctgtcgggctgtctctatccgggctgataagaaccgagggagtgtgacaaaacccaactggccaatccgcgtgttgattacatttccaaatccttggtcgacgctaacaaccattgtccatgtcgatgcttagctgatgaatcttgactttgtttgcatgtccttccaccaattaaggtgaagatctagcagatgagctgtaatagccatcacactgcttcatttctgaaagacaattcaagcagtaacaaattaatggcaaacttataactcctatgtacaccattgtactgtgtacaaacaactaaacgtattcggtaatttcagtaactaggtttctgaataatcatgccagttaattagtagtagtattgatgatgcatcttaggtcaccagctggcacgtcccattcggataattgcagtggctgactggctctgattaattaattgatgatcgatcgagcgcgccattacgcggtgagtgaccatgaacgagtctttatcaaattaaataggccattagctaattaacctaattagatggatatatccattatcccaaacagtatatctctctcttgattccttgagacttttgagggttcatagttcatacctgcaacaacaactgcgcgtaacacataccacacgcccaagtacgccctccccctctaaactgagatttgaggcccaaactaatgttattagcaagtagctgatgctagccgctccttgctataaatacatgtgctttgctagttagcttttgcacagatcaacaccggcaaccgactaactctgtctgaaggaagctaagattattaatcagtgagtagctagccatggctgaggagaagaagcaccaccacctgttccaccacaagaaggacggggaggaggagagctccggcgtggtggactacgacaaggagaagaagcaccacaagcacctcgagcagctcggcggcctcggcgccatcgccgccggcgcctacgctctcgtaagtcattaattagtacatttgaccaccactattacaagaaaatcgattttcgcagacgtatatgtcatcccccactttaactaacctatatgttttagccgcttggaaaaatcgattatgtagtggtgaactatgatctaatgataactacctagccatagctgattaattaagagataattaacggagaatttatttgtggtacgtcgttgcagcacgagaagcaccaggcgaagaaggacacggagaacgcgcacgggcacaaggtgaaggaggaggtggcggcggtggccgcgctgggcgccgcggggttcgccttccacgagcaccacgagaagaaggacgccaagaagcacgccgccgaccaatactagatcgatcccgatcgaatgaacgcaagaacgaacggtttatatgcttaattactttctccccataattacatgtatgcatgtggttgatggcttaatttgcttcttcttgttcgtcgtcatacgtcgtcgcttttacttcgtgttcatgtacattaattctgtatccgcactgagtattaaataagtgcgtttgtgctgcacacagaaattttggtttcgttttatttttcttctttgaaatgaagggcgtaagacacggct

SEQ ID NO: 70228 - DNA, 2250 bp, Oryza sativa
  unsure (1)..(2250): unsure at all n locations
atggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatccaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttanattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatgggtataaatacaaggtcccctaggaggagaggggacacagaacaatagatcaagacacaagatcaacatacaagccaacatggcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccaagtcgacaacagttatataggctaccccaaatattgtactggtgcgattttggtgaataagagcaacgaccggcttcggccaacaggagtagggttattacctgacaattcaggggcccgaacctatataaaaatcctcgtccccatctcttttacctaagtctcgcatatatcctggtaccaacgatccccatactatgcaaataccgtagtcgtgacatcaaacgtcgacaaatacaatttaaaattaacttaaatttggaattaaatataagcaatattgataagagtaaatataagaacccaatagtagattaattaaaaaatccgaaatttgacgggccgtagaggagtatagttgcatcgtttgacgggacttctaaaaattaataataaactctaaaaactataaggtccaatttttaaaggtttggaacttctaaaaaatataaaaaaaccaacgataattatgtttgatttttaaaatagcaatggcaataaagagaagatgcagtggacggttgtagaggagtataatgcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtgg

SEQ ID NO: 70229 - DNA, 955 bp, Oryza sativa
  unsure (1)..(955): unsure at all n locations
gtaggctagtatcggtctgaaattcatttcctattgatccccagtgagcagaaaagagcaggcaagtataggtcataaaaaataaagtgcatcggtgttctcccgaccattttagttttgcagcaaaagaaccagcgaccgcggctggggagatctgttcgggggagttgacaatgagatggtggccagcggccctgagtcccggcggcagaggtggagtacagacggacggcgaggcggcactgaaggaatagtgatcgctggtgacgacgacgcacgctacgacggcggctgctcggcggcagaggtgtagtatggacggacggcgaggcgacacagagggaatggtgatcgctggtgtctggtgacgacgacgcacgctacgacggcggctgcgagcggagaagggtagtcggcgatgaggggctcgaccccgccgcaactcctcccgagcggcacgaagggcggcggcgtgagaggggcggcggagcagcggcagcaggcgtgagaggggcggcggagcggcagcggcaggcatgataggggcggcggtgtgggcgtggcggcaggggcgggccgtttttagggcacgggtgcgggcgtgagaggaggcgctggtggggtcgtgagagggggaggcgcggggtgcggtgtcagtacgtctagattggttcaccatccctcctgcgtattttttaagtagtataaatattcgtagaaatatccataatttcttgaagtgtcacatggcggcttaagaatgctccacggatatgaaatcatgtgactaanaaaccatgtaattttttttacaaggttattaatgtttatgcggtggcttagtctactaattntaaattatgtagcaaaatcttacagtataataatatcaattttaacttcgcccggccctccggcgttagcactagccgttggatgctgctggccaacggcc

SEQ ID NO: 70230 - DNA, 3484 bp, Oryza sativa
attccctgttttcaggattggatccgtcaagtgtttattgatctgatgatcgagttgtggttatgttcttggggcttcctaccattcttatacaggttcaaagacaaggttaaaaggagaaaaaccctgctggacacggcacgagtttccttttctatttacataatcgtatccaattaggactattagctatgccttaggtaacaagacaatataatttctaagtcctaatctattacataatatgtgaacctggcccaccagtcggataaagcgatcgtgtgggtaacaatatgtgattgtacccggtacatagctcgtttaaaattcaggctagtggccttgtaattaacttcagtgcaaaatagattagtagtccatcgactggttgtctggttgccactacatattagctgcctacatggcagccactacatattagctgcctaacggccatgtacaaatctcactccaccgttaacgcgcaaaaccgaaattgtacaacagagttctgtaacataagagaaaaactatcgtcgaatatgggtataaagttagtttgccggtttgaaattgtaacagtgtagtataaagttagagtcaaactatcctaaggctgagtttggcactttagtttcccaactcactctctttctttttcacgcgcacgcttttcaaattactaaacggtccgtattttaaaatttttctatacgaaagttactttaaaaatcatattgatccattttttttaaaaaaaaattagctaatacttaattaatcatgtgttaatggtgaaccgccccgttttgcatgcaggaggggatttgttcccaaccacagctgccgaacgcagcctaagttctctctatgtacatagagagacatactagttatataactacaagacgatagtaatataggtgtgggtttgactagttagtggcctagtcgatcgagggttatgaatgcctagatacactgtaatatgctagattaaagagaagtggatgtaatcatgtctctttaaaaaatatcgagccccgatatcgtcaccagtttagatcttttcgcgatgttattctgtgttgagtttccaaagtaatatcatggctggtttaacgagaccactttggactcaagtgtcgctccccgcatgggcaaccaggtggcgaaaaacctagccgccgctcacccccgactcaggcggcgggaagaacactccggcagcgctctcgacggtgcgggcatatagcggcgagttgccagggcagcggacaatgccgacgcgacgagctggccatggaggagtggcaatgacggttgcgcatcatgggaggccgcggtagcgcggatccggccagcgcggctgagctgagacgtcgaaccagcaaaacttacaactgaaccaccaaatccggcatggtggcggggggggccttttaaaaggcggcaaatgcgggaaaaggaacgcccggtgcaaggagaacaacgggtccggcccaaggagacaaccgtgtggagcgagggcccaaaccatggttaaatttggcgcctggcaactccgtggttggctctggctggcaccgagcatctaacatggtggggcaagggcatagtggccaaggtggggcggtcggcatcggtggtaggtcgcgcacggaaggaggttggcgggaggctgacctagcgcgggttggcatggtaggagcgtaggaagtaggcatgatgatggcggtgggagcggcgtggtgcgagtaagaggagccgtggctggctggtgtggcacaagcggggtctgctgcggtcggcgctccggttggagtctcggtggaggcatgggcattaggacgaggcgacggtgatgcgggcaagcggcctaaggcatgcgagtagtttgactgaggcagcgatgacggtcgtgccgtgaggtgggtgagtaggcctgcgatgggcttctatccagacgctagtcctcctgtggtggcaccttgccgccacaaggtggccacatttggtccattattctctctcaccctctccctttctaacccatccgcgtggatgggtttggagtgcgccaaaggttgaggtcctacttgatggctagccagcggcaaggcgctagcgcggtggctacgtgttgaaggtgcacagttgatagtggttatgtttccagcaggcaacaacacgggcgaacaaagagattacaggcgaagcccagcccctccagggcagcaatggtgatgcttgagagcgccgttttcccttggggcattgttgagtgatcttctctgctcaccctgatggatttcttcaagtgaaaaccacgttgagggttcaaggtcggcgacgatgacacttttagtgtcgtatccttcctaaaggtgtcgtttagaatattcatttccttagggatgttgtgttcctgcttcttttttccttagggatgtagcgggatctggttatagacacacggtgtggttgttattttttctttttcctactatatcgccttctagggttgcagacttgtaatttattttcctgctctatcaatacgaaacatcgcattgtcatgtgcggattgtttaaacaaaagtactcccttcgtcctaaaatataagcattttcaatacagtaataagtcaaatatttttagctttgaccattactaaaaaaataaaaaagataatcatataaaattgatgttaatagatttatcattaaataaattattaaaatatgctatactttttatttaaaaaatcttacttttatatatattgttacttaaaatagtatctcaaaaatcatgttagaattaaaaatatttataatctaggacgaaggaagtagactccagtcacaaacatcacagagtcagccagtcaagtgaggtggtccacccttgcagatgctgtcgtcctcactagtcagtaccccctccgtcccaaaaaaagtccaatcctagctacgaacctggacacacatgtgtccaggttcatagccagagtttggctttttttgggacagactagtactcagtagtcagtagtcactagtcactactcactcactcccctgctgctttgcgttagccatccggagtgacttccattccggtctcacagaagtcaaccaaccccttccaggggctggatctggccggcgagcggcagggacagcagagctgcgcgtccctcctgcttcaggccaagaggaggcggcggatctggggcgggcgggccttccttgctgtctacgacaggcttgttcccgacccccagtttgcaagcatggagctggcgacgggggcgatgaggagcctgctgcccaagctgcttcagctgctcgagaaagagtacggcctgcaaacgggcgtgagggagaagatcaagtctctcacgggagctcgatgtcgtgcacgccgtcctccgcaagatcggcgatgtgccatcggagcaggtgggctgcaggaatt

SEQ ID NO: 70231 - DNA, 1892 bp, Oryza sativa
cttcgtagtcctaggatgggtctaatcccatcctaggttgtaatatattgggatggagggagtaagaaagtttttcttagcaatcagggtgtatgattcactacattcgcttaagaaatattgtgagatatttcaaaatccatggaatttagatggtagtgaatttattcttgaattttttccattgttgcgtacaagtattacttatattgacctatttccattcagtcgcacttttattcgtcgttttattcttgttgtacgtcaatagtcttgctttccaaatgattggcctgtaatatagctcttggagttgaaagtgtttatcgagtgtgtccagaaaattggtagcttgattcctctattgtgggtaagaaaatttgccatatacgctttatgctctttttatccagatataccactggtataaattcaaactccttgcacttgtcggaagtacaaatctctagctctagtcatgaatctccaaatttttatggtcatgaatgtcaggatggggagtttcagagtaggaaatggagatcaaatattcagacatgcagagaagttcagataagcagagaagaagcagagttcaggacatatcgtttcgctgagaacgtaagtgaagatggacggccggatgaaggaaattaaactttaccgcaggatccaaaggtgtagaaggagttatcttgtactattcactatttagtatttgtcgttgcctgcgagcacgatttttactctgattatgtcagcagcgctgtaattttgaacatgtgggtgaaaatgcgactgggagtatataacccagcgccgtaaggagaagaaggcatgaaaaagcaaattaatttgtcctagagtaacttagaaccctagtttttctcctgttcttgtcttgcggcggccacatcgtgagagagtgggagtccatttcaggtctgaatacgctggatctgacaatgaataccctggatagatcttgttcaaggtatattttcaaccaataattttgtgtcctctaattattttctccttgttgattcataaacttcgatgctgattctcctagtgtagagaaaattgggaattcaatctttaaagaaaatttgtcgtagatggctcgcaccctttttatccaaatacattgtcaatatccgatcaaactcttggcacttgccaaaattgtaaacttcttccttcagtcatacgtcttcgagtagtagcatggtttgtcatgccttgaagggatcttgtatatttctaacatatatttttgtatcatttaatttcttcatatattttctcctagtctgatatacccatttatatttttaggataaatgagtacaatatgtttctttagtactactatcttgaataattgttggttcacatccatttctccagatcaaggtcttgaataaaatatctctattattcagacatttgtagttggtcatccttggtcttctttgtctcaacctgagtttgtagccttcaaattatgaatagttgtgcctatgtgttgtagttaatatggcacataagtcatcattctaccttcttgtgtaaaccttcattttattctctctatacaatgccgtcttataactcaggttcatccatttagactccttttgtaggtcttcattccgttcactcgcggttttagcttaatagatataactattgttggcggtatgtcatgagacccttcgaccagacttgccgaaaccatgcacccagcgaggattcagactcgagacgtcaagattcatcggggcgaagcctcgtggcgaagactatggggcaaaggcggcgaagggtgaagagtcgcgttgggaccccgcaagtccaaatgcgtcctgggcgaagactaaatggcg

SEQ ID NO: 70232 - DNA, 4212 bp, Oryza sativa
acaaaggaacacgagcatccatgctcaacaaggctggagcagctgggaactcgacctcgacatcagtatcccactcgaacttgctatcaatgtcactaccataagatagtggcaacagtagcaagttccagtgggatacggatgtcgaggtcgagatcccatattctccggccttgaggaacatggatgttacatatctgctgacgaggaggacacagatagaacacacaggcaaccaaaacccttcctatccttagattgcatccaagatccctaacgttatcgtcagcaaactcctagattgcgtccaagatcatttcgttagggaaccctttcccatagatacaacaaccagctttggatactgaatttatgggaatggggttccctaaagaaatgaccttgaaagcaatctaggatattggtaatgataacagatttctagacatgtcttatttgaacgaaatgttctgtttaccaatttgtcttggtcggtaccgtgcaggcagtaacccgaccaaactagatttggcaaccggaacacttcgtattctcctaaatgccataatttcactaacttcatttaataacaggcctatgcatatccatcccatttccctcaaaatcacccaaaacagcccatagtacacaagtcatgacatgtaataagtttggcctcagttttgctcattttctttcctaaaaaaaacaacaagtgtagatggtctgttcttgttgaaaaaacccaaaaagaacaagtgtagatggtatgttgttatgcgttaaaaccccacatttaaacctaaacaagaaccagagtgaggctggcccaaaaatgcatccatttttgcaaaacatcccttactgccactcctcccaaaaaaatgaacaagagtagatggtctgttcttattgacaaaacccaaaactcacaagtgtatagggtctgttcttatgcattaaaaacccacatttaaacctaaacaagaacaagagtgaggccagcccaaaaatgcatcaatttttgtaaaacatccaatactaccactcctcccaaaaaaaatgaacaagtgtagatggtctgttcttattgacaaaacccaaaaatcacaagtgtatacggtctgttcttatgcattaaaaacccacatttaaacataaacaagaacaagagtgaggccggcccaaaaatgcatccattttgcaaaacatcccatactaccactcccccccctaaaaaaatgaacaagtgtctgttcttattgaaaaaacccaaaaatcaggagtgtatagggtctgttcttgagcaatcatcattggccattcatcacaaatacatccatcacagcccccacagcatcccaacatggcatttcccccaaaaatcacaaattaattccatcacagcccactgcatcccaacatggcattttccccaaaaatcacaaattaattccatcacagcccactgcatcccaacatggcatcacagcccactacatcacaatatctacacacatggcatttcaaaggagaagagggaagacatgcattccagggagaagaagaggcaacgtcggtgttgacgacgacggctgggctcggggtcgacgtggcctctggatcttgtaggtggcggtgtgcagacttggtgtagaggaagccggcggacttggagaggacttggcatcgatcttgaggacttggcggagaggaagccggcggcggcggacttggagcggaggccggtggcggcggtcttgggcatggaggacgcggacttggagaggaggccggcggcagtggtcttgggcatggaggaggcgctagcggtcagggaggccggatccacaagggctcatggacgacgaggaaggaggaggccacggtcagtgaatcgagagggcgacggcggtgtccaagaagaagaggccgccgccggccgtccaggagaaaaaggcggtggcggcggtggatctgagagagtgagaaagtgagagagagtaagaggcacccgcggccgaagagagtaaggacctgtggatgaggattgactaagtaaaccctagtcaatcctcatttctatcgggcaaagtactatacctgatgcggatgacactcatccgtaacgggcgctatttgtaagcccgatacggatgacactcatctgtgatgggcattagtactaagcccgattgagatgattacatctctatcgggcatggtactaaagcccgtcacagataacttattaaaatagttttaaaatgatgttaaaattataaaattaatatttaagtaatacaataatttataatcacgtataattaaaaatgtcttatttacatagtttaaaattcctattaattttttaaaattcatataattaacaaatgccttcctcacatataatttaaaattcatataattaacaaataccttcctcgcatatagtttaaaattcctattatttttaacaaatgtcttatttacatagtttaaaattcctattaatttttaaaaatcatataattgacaattagttttctcacatctagtttaaaattcctaacaattttttaaaaccacataattaacaaatccatttcttcaaagagttttaaatcgtaattaactggaatggcatgaaacatatgcaattcattcattaaggctccaatacaaattaaatacatcattactgataccaatttggaaattgcattactacaaagacttcatttatagtgatatgcattccgaatggtctgaacgaacgtacgccacttcatcttcgagatcatcgtcaaggtcgatctaaggtctcacatgaagattcttgttgtattcttcttcatcgacgacgttgtccacccccacaattcttcacttgccatccctaatgacgtgcatcttcttgtttgcggggtcttttatgtagaaaatctgttcgacctgcttcgctagtacgaatggttcgtctgcgtatccaaccttagccaggtccactaaggtgaatccttcacccaactgcaatgaaacaacgggactttgaagttcaggtagttcagctcccatatctgctctatgcgaccgtagtatgtgcttgatctagcctgatcctgatatgcatctatacggactccactgttttgcactgtgcttttctcatcttgtgtgacggtgtaaaatgtgtatccattgatatcgtacccctgccatgtgtcaacatcccaagatggaccccttgccaacctttgtaatatctcacttgcgccatcggtcgaccatgctacacgatccttgaaccattcattgaagcaagaaccatgttctctgttgatccaaatatctgatcgaccaatattgtcccgtcggaccttcgctaaatgctcatcaaagtatggggttacttcaaccatatgttgcagcactgcgaaacgagcctgcacgtacgaagcttgattggaaacaattctttttctgccagttgtgccgacacctgcaaccttccttcgtggcgagacgcaggaactccgataggatcaatctcggccatgtaatcgatacagaactcaatggcctcctcggtcgtgtaaccttcaatgatgctcccctctggttttgctctgttccgaacatacgacttcagaattcccatgtacctctcgaacggccacatttttctcataaaagctggcccatatatttttgtttgcttcactgggtgaacagtgagatgaaccatgatattgaacaaagctagtggaaaatacatctccaagtgacatagggtactgacaatatcggcttgcaacccatctaagtcttctggatctataatcttctgaccgattacattgaagaaggcacaaagccgttggatcgtgtgacggacttgtggtggtagaatgcctctgatagcaactggcaatatctttgtgattagcatgtggtaatcgtgagacttcattccaaccagttttagatcctccaatttaacgtacgtacttattctcacacaatagcctgaaggaactttaatatatgccagacatgatagcattgctatcttctcatcattcgacaatgtgtggcaagctggtgggaggtacactcttcctgtcttctcatccgtaacaggctgaagttcactacgaatgttcatctcctgtagatcaagacgcgcattcaacccgtcctttgtcttgc

SEQ ID NO: 70233 - DNA, 2533 bp, Oryza sativa
aagagcatttcagtgattaatttaattggaaaagtatttaaaatcacctttaccttttcgggccgaattaggaaaagtcctctcactctcggcccagtctcctctcagcctgcagcccttttcctctctttcccgaagtctgcttttgtccctcctttaatcagtctttggaagtagaagcccagcagaaagtctactttccctccctggcactgttcatcttccagctctggacagagccgagccgcccgtgctgtgccctgtgccgccgcctcttccttccaaatctcgcctccccgttgctcctttttccaatttagttgaggggaaatattcctcttatcctcctctatctttaccccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgtcgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgaacccgagccgtgccgccgctagacctcgtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgaagtgcgtcggaagtgatcaagaagattacttgaagaccgattattgcaaggcaagtcacacagatcctaaaccaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttgattaattacttgccaactaaaacttgataatggtgggttgtgagcacatggttttgagagtcgtgctcatgacaattaaggaccagttcacgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttaggttgtgcaaggggtattgtcacaactcctttccgaggtaccgtggtggtattgaggcacatggtgacatgatgaggggttgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgc

SEQ ID NO: 70234 - DNA, 1757 bp, Oryza sativa
ctcggtacccccttttcttttccgttggtcgtgtagacgcggcagcttcggaagatccgctcttcgtgaaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatacctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagtctttgggaattttctcatcacctggacactatggaatggatggattattgtggaattggattcacacctccccctctattcaaaaccctcaaaatggttttaggctgggctcagggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccgggcgtaggtgtggttgggtcggtactcttgtctatggctaggatgggttggaaactatgtcatgtcttccgtccgtataccgtggtggtatgtggcacgtggttacacgtgaggaagatgtgtcttgtgggtaaagatgtacacctctaatcagagtataacctattcgaatagccgtgccctcggttatgggcaagccgagcaatgtacccaagttggttggcttgggacgagctgggacccagggtcgggttgccagttcggtctgaatcatcgtaggccttgggttaaggtaggttcgtgtgggttcacggccttgattaataatattgtatagctctagaatcgtgtttacaaaatagctttgagcaactaagtgtcttttaatgctgtttactgcaaaccctaaccctttatattataacccccttgtactcccttgcatttactctgcacttatgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcaccgcccatgtaataaagtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatttctcggatttttcggagctcaattcctatttttttaatcttacaaagagcatttcagtgattaatttaattggaaaagtatttaaaatcacctttaccccttcgggccgaattagg

SEQ ID NO: 70235 - DNA, 2532 bp, Oryza sativa
tcaagaacccatttttgtgctttgtttctgctgttatgtggagtttagtagagtaaaagccttttctttttcgttagtcgtgtagacgctgcagcttcggaagatccgctcttcgtggaagttgaagccggtgtttgggaaagcgagcaaggcaagtcacatcatccttgagcatattgaaccccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgcgctgctgctaggggctcagtcctgcctgcctgtcccgggggttccggctgtaggcaggattgggtcggtactcttgtctatggctaggatgggttggaaactatgtcacgtcttccgtccgtataccgtggtggtatgtggcacgtggttacacgtgaggaacacctctgatcagagtataatctattcgaatagccgcgccctcggatatgggcaagccgagcaatgtacccaagtcagtgttttaattcttaaaatttgctcaacaactaaaatgtggaatggttggcctgggttggcttgggacgagctgggacccaggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaacttaacccctatattattatccccttgtacctcccttgcattaatcatgcatctgccggtgtggcttgctgagtactgtggttgtactcattcttgctcaatctttctcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggtaattttctcggtcgcgacaagctggtatcagagccatctcgactgtaggataagccaagtggataaaacccaaggacatattttataaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaggatccgctagcgaagtggaggaagcactgaagccagctgtgaagcaggagtgaagatcttgagaacccgtcacagaacctaagccaccctctagggtagagttgttagtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctatccaaacctttgcaacagatggctgacaatgagaaaggcaataaggtcagaagtcaggacattggtacctcaagctctcgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaagacccctcatgccatgccacatgttgacccaaaagaagcaagtatcatctgttt

SEQ ID NO: 70236 - DNA, 1139 bp, Oryza sativa
gtccttaattgccatgggtgcgaccagcaaaaccatgcactcgcagcccgccattcagtgtattttaattaactaacaccattgcggtggcaccaatccaaagctatgctaatagacaaagtctatgtaataatgtgatacccatttgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtttttactataaaagaaaagccttattggtttattgcgcaatatatattcccagatgatgtcagcaggggggcgccgacatgcgggcctcactggcagcggctcaaagggggtggtccaccgtggaccaggtccacggggccggggtggtggtgtatcacgtggcgtcgacgtggcaccacgtggctggccacgcgggccatgggatggacggccacgatcgggcgagggccgatcgggcggttggggacgggcggcaccgaggccagcccgggcatggcgcacggtggcgaccggcgaccggccggcggcaacggccggcgacgcggacggcggcgcggtgcgacggcacgcatgcggggagcggcggcgcgcacgagagaggagaggaaggggaggaaaagggggtcctcaccgaaggggcgacagcgaccggtgcgggaggggaggagcggcggcgcaggaggcagtggcgaccggcgcggaagcggcggcagcgcacgggcgaagcggcggcgagcgtgcggggaggcggcgcatgcgggag

SEQ ID NO: 70237 - DNA, 657 bp, Oryza sativa
tgtcataccatttcagagtaaggaggatatttatttgtaatacatccatatacaaatgcaagagtcataataacttactactgtaagattgttagaaattctttgtattgcttgtgtttgtaatcgagaggatccaagactaccacggttccgtctttagggtggatgagtaaacagatataatgatcgctacatattaataacattataattagttagtaacagctaaaataagacatatgtgtacaagataaatgtaccgaacttacttaaaattataagcggccatgacgactctcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcagatctgagttggatccaagaaccgatgggttcttttttcttcttagcatccatgtattgcatcctacataagaagtttgttagtagcaatcacatggagttgtattgtacatattttttatctaattaattaaaattcgtactcacatgcaccaaacaccgacatagttgacgtccatcttatcccgacgatatatgggg

SEQ ID NO: 70238 - DNA, 775 bp, Oryza sativa
cataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcgacacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggcaaaccctaaaatacgtacaagaaaaattcaaatgtggcccagagaatttttgttaaattctccttggtctaaaaggagccctcaaattttagtggaatttcagagcacgaataataattattaagaaataaacaatgttaaaataattttataaaaagaaaaaccctaaaaagtctttcccccccctttcccctcttgggccggctcggcc

SEQ ID NO: 70239 - DNA, 1768 bp, Oryza sativa
taaatgctgtttattgcaaaacctaacccctatattataactccattgtactcctttgcaattatgctgcacttgtgggtgtgtcttgttgagtacggtagttgtactcagtcttgtttaatttttcccaaacccagcagaggagcccctggaggatgaaggctttggtgtctagctcgtgcctgccgtcaagcgcctgtggtcgtcgccttagtcttctgctgtttttcgttgtctttgagtgtgctgggccgtcgctgcccatgtaataaataactatttacgcttccgcttgttaaactctgaattgtatcaacttttggtgtaccttgcctcctaggacaaggaataatacacgcacgtaaggaacgcccgttgggttatttccggtcgtgacaataatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggctagataaaattttgttaaatactttgcttaattctataattcctagatttttctgggatttatttgagctaaggaagtgtttttaataaatggaattgcatttcatgaataatttaaattgaaaaaggttttttttttttggctttgggccgaaagccggcccaaaaccctccctctctctatctctctccctcctcggcccagtccggcccagtccgccgagccgccactcttctctctcagccgctgacaggtggggcccgtctgtcaggcctgtcttcctcctcgcgccgccgccgccgcccgaaaccctagcgcaagcgccgccgtctccttccaaatccggccgttcctttccgtttctggtgaaattgattgaggggaaacgatctccgggatctcctccaccttttcccctttggaaacatcggctaaatcggtttggaatgtgtttgattcgagttcgaatcggatcggtctctttccttcaaaccccgatctttccttctcgtcgccggcagccgtgggccttcaccgttgcctcttagcccctttataaggatccccggtgtctcctctacccgccgccaccctcgcctttgcctctcgtcgtccgtagcgccctagctccgtgtgccctagcgccgccgtcgccgccgtcgcttcagccgtgcgccgccgccgttccagacgtcgccgtcgctcgggaagatcgccatcgtggtcgccgtcgcgtcgccgtcctcgtccaccgcttcaccgccgccgaagaccatcggagcaccgtcgccgccgtcgacccgatcttctccgccgccttttcctcgacgccgccgccgtccgttggtcttccgccgacgttttggtcatcggtgagttcgccgcgccgtgatctacgtcttggtgccctccgtttgtgccgtagagccgccgttcgccggcgagcatacgcgcccgagccgcccgagtcgccgccggtgctgacgtcatcgctgacgttgtcgctgacgtcatcgggaccgtccgccgtgagccggtcgtggacagatcgatctcgaccgtccgttttggatagggttgatctcggccgttcgttcccatgaaccgttgccgtgcacccggtccaccgcgaaaccctagccgctgacgcaataatcctccttttccttttcaaaaataattcattattgcgtcataattcaattaaaatccatataag

SEQ ID NO: 70240 - DNA, 23604 bp, Oryza sativa
aattaggcaatcggaaacttcatggttgtgatttggacctttccctttatgtttgtggagatccagagctctagttaatgatacataatccaacctttgatgtttatggagtttctttgtttggtttcactgggacaccatgtaaaatgagttaggtctgttgtacagttaaatttcttatgattaaactgattttctgttattacttccaatgttaagattcgtccttttgtttgagtttcctattgcagggggaaattgtaaggttttacgctaatgatcaaagaaaaattacttgcggtgagtatatggaacctttaattcccaaaagagtgattatttctggtgatggagtgtttgacataattccactcctagagggaatgttgaatcccctatatatctaattaccaaaagagtggtacttctgatattctgtttaactaataaaagttttccaattatgtgatgattatttaaactaaatagcagcagcacatgttttgcacccaaccgactttgaataaaccatcttcaatgcagatcctgaaacaaaggagcttattaagagaactcttgaaactggtcatgtatcttatgaagtccaactacctgtatgttctctattacttggaattatctatcaaaagcattctcactaatttcttatgatttcatgcaattatttcaaatgttaaatcttcttatagcaggtgaaatttttagatatgtgggaaccagctattttggcaataaagagggaaggctacagtattaaatgtactggtcagcgtggtgttgttctcacagagaaatttcagcaagcaacttctgtacgtccttattccgtattctttagcagtacatcatttgaatttcaggaagtagatctcattctaaaattgtgagcaaactctgttggttccttcagtacctgggtagcatgttggttcacccaaaatgatggaaataaacccattgtagatggatgtaaattgatggttaccttgaattctggccagagacaggttttgttatctcatatggtttcaagatctcagatttatgtctgagatatggttaaccgctagattacactgcatctagacaaacgtcatgtctttctttgatgcattgtctctcatgctatacatgaaaagaaaaatgtaaaaaataggccatgatctggcctatttctgttgacctaaggaaatgggaacagttgagcttctttcctgatgaattgtcttcacatgcttgatggacccacaccgaaaaatctggacaggacgattaaatggtgtgcacataagtcataagtgtgatactgcaagtactatactgagacaaattgtctccgataataatttttttctgctgcttttgctaattaaccatattataatttttgttctgcaatcatgtttgtgtttttttgtaaatcattgctgtagacatacaaaaatgtggtatgattgacaacaacttttgttctgtcttttccagattaatattccttacgggcgtccgacagagttcttgattacatctgctgatggtgttgaatataatttaaagcctgcagaaaatgcactgtgagtacccaatcgagctagtgtttgcatcattatcagcagcccaagatctatgaataaattaacattagtattcattattccttacactatatgtgtcttgatgtgcaactgtacttctgatttagcagcatggctcccccctactgctttccctacaaacaactctatgggtcatcacttcttgaaacatcagagttaaaaatatgctgcatatgtctaatagttacttcttaaaactcggaaggaatgcctcaaggtcagcagtgccagactgccagctcatcgatcttgtcacaaagcccatgttgttttcagtaatgtggtcttctatagctgtctgatcagcgtgtgcaagccgacctgaccgtgccctagtgtgttcattcttatgtctttgaaagcatagcaatttaggatatacttaccttctaagtgtaatcagtggaggtttataccaaacttgaattgaacaccctgtccttggtcttttactttattactgctgtgtttattttagattaatgccaatcataattcataacgaacatacataaaatactgcttatcttgtgttctccaattttgcaggccgcgggataccattgttctggttttaagattgttcagaattatggtatgagctcgttatctcttgtgcaagacatatattagcacctcccttcattatctttatcttcattcaacatcatcgagtgggtcatcatgggatgatggccctccactctattcaagttcaaaaccgagtattatttgacgattagcatgtttgaagaacccacagtagcatttttctcaagagaaaaaaagatggaaaaaaaaatatagagaagttaagtgtacgctatcagcattcactagtaggctactagttgtgtggctggctgtgctgttcggcttttgttgttacaaaggctaatattatctttggttaattaagtaggcggaggttaattttacagccctctgtttattcttcaaaagaaacggcattcccagccatcatggggatctcttatatagtagcactttatctaaagatagggcactatgaattgtttgtaaagagctgtgttgtcaaagttcatttcttgtgttttcccccaaggtagcatatctgaatggtgactaacaggttaaccgtagagccaggattagctgcctgacttgatgagaatatgtcgtctcacgttccttaaatactgatgtgaaacatcatgcattttgcaggctgttgagaagaggagaggaagaaagaagagccttttcttcaagtaggtttggctcctataccgtggtgtataatttgtattcgtgattggctggatgtatgtaattaagcgggtgataggtttggcatattctttcggctgtatcttctgctgtaaaggaccataggcgatttaaacacaagggccccaggtgatgggagttttcttcttcttatttttttcccttattccttttagaaacatgagttttgtcgttgcaagggatggaagcgtgccgctgattagaattgaagctaatttatgctaatagaatggaaaagataaataggcaagtcctaggatgctctggaaatattccctgcatcgtagggtagtgaccatcatcagttcacgggtgacctccctgcctgctggttacttccaacgagcttgcaattttggagatgacgcatagcagtacctgaacatgtatacaagtataactgatgtatcatatgctgtgtaattatttgagacgaagtagacttgcagtagtttaagataacaagggcatcttagttattccagcgtgtactgtactgctggaagaaaacacttgcattattaggcagttgtgcgtagaaataatcgtgggttgcagttgtgtctacatcctatgaacattctgtggatggtaacattgaggcaggctatgtccacaccacactacacttgccaaacggaatgtgaatgcatttagggcctgtttaattggtgaaatgaaaatttttgggtgttacatcggacgtttgaccagatgttggaaggggttttcggacatgaatgaaaaaactaatttcataacttgcctagaaaccgcgagacgaaccttttgagcctagttaatctgtcattagcacatgtgagttactgcagcacttatgactaatcgtagactaattaagctcaaaaaaattcgtctcgtgatttacatgcaaactgtgcaattagttttttctttttgtctatgtttaatgctctatgcatgtgttaaaaaattcgatgtgatgtttttttaaaaaaaattaggaactaaacagctgatcaaacatccaaaaatttttatttcacgaactaaacagggcctaatcaaggccttatttagatttttactcctggcttgctctcggttgctctctgttcggaagtcagtgttcccaaccggatcagtgcgcacggaaaacagagcagtccattagcgcgtgattaggggtgaaaacggtacggaaattttcgagaattccggctaccgtttccggtttgcaccgaccgtttcaatcggtatcggtaattgtcggtatcggaaatggaaacggtaatctctttcggaaatggtagcggaaatgatatggggttttttccgaccgttttgtcggtaaccgttttttatcggtaatttccgtcaaatttccgacaaaattccgaagaaggaagtcggctgggcctggctagcaagaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccacgctccaccgccggctttcgtgccaccgagccaagcgccgagcgccgccgcaccgccccagcctcctcctccccaccgatgccgcccctttctcctctctccttcccccaccgccgccctgcgccaggccgccatctccggcgcctctctcctctcgggcgcgcatgaaggagccaaaggcagagaagagaacgagagagaaaacagagaagaaatcgagagagcaggaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctacgcgtgattaattaagtattagctttttttttcaaaaatggatcaatatgattttttaagcaactttcgtatagaaactttttgtaaaaacggcaccgattagcagtttgagaagcgtgcgtccggaaaacgaggcggagggagttggtaacaagcccttccgaacagagccgctccaaggcaagttttgcgtcagatctgtatttcaaagcaatggtccattgaaaaggtatcaccgctgattaattttgttctgttgttcacctcttgtagagttctactctgcagttatttgggatgttctttgctacagtacttagctgctgagcgttctggatgtcttttgatcaatacacatacgcaggttgtgctctgttcagtatgttggcaccgaagtatgcttctttgtgttcttattctgattataaaataatttccagatgtacaatgcaaagtagttactttgggcttttgactgttgagacataaggattaggtttatgaattttgtgtttatgtttcttggttcaattatcttttatatgaattacaaaggtttagtacaaggtccatggattgactaagtatcatgacccgaggccatgacgggataaacaccgccgggaagatagcagggcggcgtcggctcctggagaagggatgtagatttaggctagggagaaaaacattattggaagggagagattagactaattgatattcattgcttgcctgataatagacacaatcccatccttatatagattgtacaacttgacctctaagtaaaaatctaatcctaataatcttcttatcttatctttaactaactaataatcttcttatcgtatctctaactaactaatattcttatctctaacttaattgatattgggctacctataggccttggcctacggcccaatgcccatgacactatgctgttaagcacctacttctaaatctctgcgtaagttacttttcagtatttgtgatataatcagatggtgacattcactactactttagtcaagcttggaagaacaaaggtaagtacatggaactgaaaatggccacttggagatgacagctccatggtcagctgttgtggctgccatttgatttcccagttccctctggaagaaacaaccagcaaaaaggaggctagcaggaagcagcagaaaatactaagcatgatctattttcccatcatagcatcgctgttagggcacccgcaatggttatctataggctctatataagagatccatatcagcatattttcctacttggaagagattaaatgaagagagagagcaaatatatctgttaacctggagatagtctatagagaaaaacgatgcaatgtattagagagctatagatacccatgtagacatactattgagatggtttactattaatctagtctattgctgagatgtacatgttttatagatatcaccttactttaccattgcgggtggtcttagagcatgcatttgttttttggttcgtacgagaaatttcagaaagcagagcattgcaatatcagaaattaggcttattccttttgtttgacctcctgtgctgtttgatatttaattttctaggttgatcactagctgatgtcttttcatttttttaaatatgtatttctgactgggttgaaacctccctttcttaaaaaaaaggaaataattggttacaaaccattaaactggatgttaaggtcgtatggcttgctcaagttgtttgtgcaaataaccattctctcaagctgatgaagtgacttgagttcttttgttgccctaaatatttctctttttgaagaaattaacttgcaagtgaatgcattttgtatgaacatgtgaaggaatctgagactaggaagaatacaaggtaatagatgcctacctcagtacctcacagtctttgtccgcataattctgaaaatatggatgcattcttcagatttctttatgtcaaatggaacactgtaattgtgatgatgtggccttgagaagctgttgtgagtcattgactcatcagcaattattcatgtggattttattgacttgtatggctttgtcatctcaaatgcgtctttccatggactgatgctttgtagaaatctatagaacaatactgttttctgaactcatatttgattacaggatggaaggacggtcttggatataagcttatgttttggaagagatttcaagtcttatgatttggcaaagcttgtttagttactttcgactaacactatgtacacattgatggacgcggagtgaagccgcgcttatttatctagttccacaacagacgcaaaacaatatacatttctgaaaactagaaaatctaaatgctgaattgacatcacaaaatcagaaaagtacacacaattgttcatgccaaatcacccttgctcagatctgaaaacacagcgacatatcactttgttcattccacaaaatcacccttgctcagatctgaaagcacgatgtctaagacatataactttgttcattccacaaatcacccttgctcagatatgaaagcacattgtctgaggaaaaaagatagcacaccatcactccccattcgaatcaacacacaaatatcagaaaccatgtggcttcctttttttttgagaggaaaagaactttccattaacttaaggactcagcaaaatcgctggccaccaagtcctccatgcccggaggcatcatgtcccattgttcaacagtattccgaggacatttacaacccaaagctgctaaagcatgcgctactctattacattctcgtggcgcaaaaacaaaggaacaagaaaggaaactacttccgatcagcttcttcaattcataaatcaagccacccgttgctgcaagtctgtgatcatcggcatccatagcttgcttcaagataatggaatcagtttcaaaaacgacatggcccattcctagtgcattcgcggcccttgctccggccaagcacgcaacaacttccgcctggaaagcatccaacagataagatattctaccagcacttgacaggataacctctccctccgaatcccgaattacaaaaccccatcctccttcccctgtttcagctatatatgctccatcagaatttatcttcagtttacccacagcaggtctgcaccttacaaaatctgttgcattcttcccaacaaaaccatgtggcttccttgttgcagaaaataaactaactcaccttgtgaatcgttgtggactctttgttgcttgccacaagttgagaaatcctgggattcatgatgagaatcggttgagaagacttggtcatctcaaccaccgacgcagggatcgccactgtgcgcgaatggctccatggaagcctcgccgacgatcgccggaatcgccacgagcacctccccgactgccgtggggacaacaaaacgtgtctcgcagacaaaacacaacgaccctcctcccccgcgctctctgccaagcccaagggtagcacgagggctcctcccgccggagaagacgacgacagcatagcacccctgctgatgcgtcgccgccaccttctctccttccctatatgctccttctctctcctcaccgataggggaaagctccttctctctcactttctcccgtgcgtggcggagaaagaaaatggaaagggggatattactgtttttcgaactgtagcggaaataatgggctgaaaatatgtgacgcgaggcgagggtcccgctgctgcttggttgctgggcttttagggcatgcaattgcttgggctggagcacaattccttggctagatcacgttggagcacacgaatcttcaagggagatccaatggctaaaaaaagactgacaaagacaaaaagaaaaaaattctcttctttttattggcaccgatgatgaaaatattttaaatcttttaagtagtagagatagagagaagtactctcttctcgtcctgtttattttgatagttgattcatgacgataatgataaataagaatccaaatcgcatctccgaccctaatcctaatcgctgcccgccgccgccgctgattctcgcccgcccacgtcgccagcgacgtctgcctcgccggtctcagtgccaccgccggaacacccacgcccgcgcctcgaatccccgcctggtcgtctctcccctctccctcgcgtcccccgcctcccctcgccgcactaccctatcccctctccctcgcgtcccccgcctcccctcaccgctgcctccgtcagatctgccccgcacgagccgccagcgacgcccgcctccttcgcgccctgggagcagtaccaacggcgggttcgggggtcagcgccggcttgatcgaggcgtggcccgtgctgaccaacggcgtcgccgccgccgccgctatcatcaccggcaccgacctcaccgagaggtggggttctctctctctctctcttctcgcctgtgtcagtatgtctcttttcgtctctgttttctatgtaaatataacatgtattttcctcctatactaaaattctaatgatttgttctctagagtacaaatatttgtagagatgttcagtgcgtttagcaaatacttaggccgtcatacaataagtgtttatgctgaacgatgcatttcagaaagatacggtcaatttgtttcctgtcaattctgcactcatatgattttttttttttacatcactagaatatgaaatcttattgatcttggacttgatatttggattactccatatatactcctattatcttcggtttatggtaaaatgggacagagcgagaggagagcagttccactctcagctactagcttaccttagctatcagttgatcatattagctatggctgttctattcattgcttcaactgctccaaaaatttctttcaccgttatccacaattagtctacttgtttcaagcaatggagaggatggctgttacgcaatgtaccgaactcgtgatgaactttactttgtaatgttaagtgttcaacttttctaattgtcatctaacatgattcagtccccttcgtcgtgagcagccgtcacgtcgtcagatcctcctccaccgctgtccatctgccaacccctacgcacccaccgccgccatctccgaaaggtacagatcccccccccttcctctatctataccccgccatctttctgtgacctatttgattttggctgtgatgtacgagcagaccatggacattcggcattctattgaatgctgcagaaactttctgccaccctgttaatcaaacaaatttgtagtcaatagtaggaaactattacaccaatatgttatgatgctggatttgtttataacacaattaccaatctgtttctctacattgccatgcctatagggttttaaataaatttgtgctaacaatatttttactagatttagaccaaagcgacgatccccttcatttatgttgcctcttttccaattaaaggaattaactaagttctgaattttcaagagactaatttacatttatggatgataatataattttgatagtttatttctcatgtttaaccttgaatcatttgtactaaaaaaattctctgcccattaatagtcccggcgctgatcttcggtcaacgtcgtgactttcaaccccgcagccgatcgcaggaagaggcctcaccacttggcagtgccccgatctgttctgcgtccgctgacggcgtgaacgcgggcgagtttggtctacggctaggctgcagaattaaggtctgagcccaatccccggcctgctccactcatttcattggtgtatttgtttgataaattattagaaatgtctatataaaaatgatggactgaagttgaatgggacgtgtgtgtatatacattatatagcagtgcatgaaatttgattatgtcgagatacttgctgccggcggatgaagttcgatggttattatacttcatatttggttccttacagttattttgaaattagaacatttgtctcatttatttgcttgatcccatcttcttgcaggctacagccatcctgggtttttttaagtgctgcacttctatatatatatctaggtaaatttcaacccctcatgttcactttctcgagagaatccattttctttgctttaatttcaggtagtatataacctgttctgatgcttcttgtgagatttcatgtttgattgattttttttgaacatattagcaaatatacgtgtgtcactgcgtgttttgatatttgatttagtaaatatctcctataatttttcactgccatcactccaggaatattcaacttatgcttgtcatattaaaaaatatgaggaaaaacagtatattaggatcttgtaaaatagcatgttggaccctagtagaacctgggccctagtagaacctgggcgccgtgaaggccatggtcgcaaagctgatgatacgcaggagatgtaaaagttagcctattaagttgaacaaatcatattgttttacattgtttcagacaaacctgatctgaagttagcctattaatattttatctgaatttaactttaacattggttatccagcgactatcaagcatcacccttaaaagtgtcattgataagaatgaattatacctaaatctgaccaatttgtcacatagctgataatacacatgtgaagcgtactgcaccgataatagttacatggaatatgtagattctcattgcccctggttgctgacagtctaactccttaacattcatattcattctcatcttgaggttggtcatttctaactccttaacattcatattcattctcatcttgaggttggtcattttgtttgctctgtacctatgagatttccccttgcgctgtgaaacatatgccatgtcacttcacggcagcaagctgaggctttgttctaattgtaggttcaatatatcaagagggtggaacctaattgataagtgtgcaccagatcgtggtcagactaattcacggtaaggctgtgtctgtttctcaacccttgatatatagtgtatgattgtgttgtgttgggtgtatcctggaagaaaaacaaatgcatgtctgagattgtttcttcgagattattaaaatttagctgtcaattgagattgtaactatggtctatattacattaacgcatatatatgcttatattttttttcctttttaatttttttagatggttcgtccatacaacttaaatgaatatatttaattcattcattgtataatagaaatatagggcgtatagaccgtataaaataccaaccatgtgcaggaattataatgccgatatgtatacgcatacgcacgccactcaaagttttattgtgcctacgcaatatcatagtctcgtaaaattttattgtgcctacgcaatatcctagtgttgtactttacgttacatatatttgatgtgcgacatgaattgaataaaagttcaaatacacagatcatataaaaatattttttgctaacatgaaattttataaattatttaggacaaaaataaaattgcagcgtagcgtttagcacaggcatattactagtctccttaaatccatctcctttggctttcccctctaacaccgtctccctaatcccagagtctacctaccccacccctcttgttgccgccgcctctccatcctctcacgggccatgggttctgttgccggcgacgccgcccgcctttcttatccacccactcgccgtgacaattccgtcgtcgacatgtaccatggcgtccctgtcgccgacccttaccgttggtaagtactccaaccttgcttctcgggggaggtcttatatttttggctacttatgttgtgtgcggcgtgcacgtaggctggaggacccagagtcggaagataccaaagaatttgtggcaagtcaggtggagctagcagagtctgtgcttgcgggctgcttcgacagggagaaccttcgccgtgaggtcactcgccttttcgaccacccgcgccacggggcgccgttccgtcccggcaacaagtacttttactttcgcaactccggactccaagcccagagcgtgctctacgtgcaggtatgccatcaaactcgattaataaagcacgcagtggatctaaggtttggagctttgcgggacatgttgttgtcccgatgatgtgaaaataattggagatgggtttcaatagatttcgtgaatatacatcttgactttagaaactactgtgctgtaggagctgaggctagttcagttagtgaatgttgcaatgtatacatctctattgcctaagccggagacctctttggcttggctgcttgcatacctaattcttcttgattaaattgaatctagtttattaaagtatcattagttctctgataaaattaaaggcaaaatctatagtcatgtgattgtttgttggtatgcaagctttgcgatactcactcttttccaacctagacaatgtgcaattggacaggacttattatataccaactgtgcttgtgtaatatttgctatgcacatgttttggttcctttgcccacccttccttagcctcgatgagtaacattagtgggcatttgttccagtttgattttaggcaaggaagtccaccctaccaagtctaggctagcaaatgaaccaaacatgctttacataaaaatgaaccctgtgagaatgttcaaatctcatagtcaagttccacagcactgagcaatgctgattgttttgctttctctgtcatattcatgctttcagtttctcataagattatttggtgttcttaaaataaagaaacaagtccacatattccgtttagtatttcttttaccctttttcgagtgctagttttgtttatgtttgaattctgtcaataaaaggctgcataattgtcttgattcgatgaaagggttagaatgaatatagcatgtacttatcaattcaggatagtttggatggagaggcggaggttcttctggatccaaatgcactaagcaaggatgggacagttgctctttcgacgtattctgttagcaaggatggcaaatacatagcttatggcctaagtgaaagtggcagtgattgggtcactattcgtgtgatgaacattgctgataagcagactttgtctgacaaattgtcttgggtgagcagatgcagcttgtaactattatttgaaattgtagtgcttatgtgttacctattggttcttataaccaaatccaacatatatgttccatcaattattggtgcaggtgaaattctcatctatcagttggacccatgatggaaaaggttttttctatggtcgataccctgcaccccggtaggtttacaaacttctgtatttctaatgtactgtaatagattgcttagtttctcttactccttttgttagagaagtggaattggatgctggaactgaaacaaacattaatcttaatcatgagatatattaccatgtcgtgggatctgatcagtccgaagatatattatgctggaaagatcctgaacaccctaagtttcctttggtgcatcggtcacagaggatggaaaggtaacaacacttcctctttttcccatttgtgtaccagtcatatctatatgcttatttacttctttcatcttttggatgagactacaaacttgatttctcttcttctatggttgatgcttcatcttctagtttaaatgacagtacagacaattttactacctgaacttctctcgaaaatattttattcagtcccttgcttctgatggagcttcctgcattatctaggattatcttaatttctcaagtgctcactagaatatttggtgcttcttggctttctacatggcaataaatattacatgatcgtataatggattttctcaatcaacatgcatgcactcatagcactacttgcagagacaacataattcaagtagtaatagagtaagataaacatgttgaagaagatccatgccttgctcacagaggccagctcctgtcatgaacctacaactccttggaaccttacatatacctgcttgtctaagtgaactaaacaactaatacgaataaatactaacaaaactcaatcttgtctaagtgaactaaacaactaatacgaataaatactaacaaaactcaatctatctatctaaaccttactaatcgtgcactttttaggagctctcaagtcaaccaaaaagatctagccgttgatataataaatcataacatcacaaccatagatcgtaatatttttaacagccacataaatcggatcgtagaatcctatatggtttattagtaggaaatatctcccatagatgtatggtcttgatgtccgatccgacaaattaggtccatagcaaaccaataaaccgatggaagttactcctatctcctaatgaataatcatgcatgaatacgtattgttgtacaacccctgatgcttgaatacgtattgatgtccagcaaaatagtagatccatagtcataacaattaatttcggtaatctctatctttgtgtagagaacaaactatttcctaattaatcttcctccaaactaaataaacataccatcaaaaataatatgcacttcattttattaaaatttagtaactccaaaattctagattaaaaaaatatgatgttttttttattttaattacgaaattttgattttttttttttaaataatattgaaactgtacaagtaagctaaagttgacgtgcacttttaatctaaattactacaatttagaaaatagcctgtgtatgttaaattctatatatgtacaatatgaataataataataataacccacacaacgcgcaagttgatgactattataacttaaaatttctacagttgctagctcatggttatatatgacatgcaaaaagaatgaatcttacctgtcgtctaagtgaaataaatagccaatacgaataaataccaaatagagctcaaaattgcttgcaattttatagtagctagctcatgggtttatgtgaatgaattgcagaaagaacaactcaaacccaaggtcctgagcaaacattatggctattcaaagatttatttggctaaaagtgcaaaaatgattgcatattagtttcggaatccttatttcatccgaatttcaaaatctctgtgcaaaggctttatatgatgaggagtataaaatgcaatgggcaaacctgttttgaaccacctgaaatggagctagcataaattagttttggagcttgaaattaattgaatttccaatgtgaaaattattgattttctgatttttgcaagggttgaatattccattgagttcattgcattagcatttcgtgatggatgttgcagtagagtgtgatctttatggtctacatgtttgttgcaccaaccttaaaaagcagagtatctcttcacatctttaattaatgacttttgtctaaatcttttaatagcccacaaaaacagttctctcataacctcatcttttgttgacagtacatcatactaggtacttatgaaggttgcgatcctgtcaataagctatactactgtgaaatttgtactcttcctcaagggatagaggggttcaaagagacaaaggggatgcttccatttgtcaagcttatagataactttgatgcccaatatcatgttgtggcaaatgatggtgatgaatttacatttttgaccaatagaaatgctcctaagaacaagcttgtaagagtagatatcaagaagccagaattgtggactgatattcttcctgaacatgaaagagatgtgctcgaatcagctgacgcggttaatggtaaccagttattggtatgttatatgtcagatgttaagcatattctgcagataagagaccttgtaactgggaacttgcttcataagttgcctctagaaattggttctgtttcagagatctcctgtagacgggaagacatggacgtctttattggcttcacaagctttctttcccctggtattatttacaggtgtaacctcacatctgcgatcccagaaatgaagatatttcgtgaaatttcagttcctggatttgatcgaacaaattttgaggttaagcaggtacatgccatcactgtcttaggttgccatatcattttctatacaaagaataccaatgaaactaaatacttcgttaaaatgtggtttctaactgtttttggtttttcagattttcgtcaatagtaaggatggaaccaaaattcctatgttcataatgtcaaagagagatattgaacttgatggatcacatccaactttgctatatggttatggtggattcaacataagtcttactccttctttcagtgttagtcgtgttgttttatgcaagaacatgggttttgttgtctgtgttgcaaatattcggggtggtggggaatatggggaagagtggcacaaagctggagcacgtgcaatgaaacaaaattgttttgacgacttcattgcttgtgctgaactcctcatttctgctggttatacgagttacaggcagttatgtattgaaggtggaagcaatggtggtcttctgattgctgcttgcgttaatcaggtcatacagtaaactcctgttttctacaatgcttcttcagtctgtataagttatcttgtactccctcagtagaaaaaaatatgggtgattttgaaagtcttaaaagacaagctttgattgttgatttcttaatacatatagaacaaaattttatgtaagctctttgaatatctattgatatagttcttttgctcgaaatgcacttgtttgactagagttgttcaaaatatgaatgtagtagttatgatagcatactattgtgatgtggttataatatcatcctattgtgatatcatgcataaatttgatttcctgtctttcagcggcctgatctctttgggtgtgctcttgctcatgttggtgttatggacatgctccgttttcacaagttcaccattggtatttcttttgttctgttgtgtatcatctttgttttacctgtatattgatgcatattatcagtgaatgcttcatgtttttttgtaggtcatgcctggactaccgactatggttgttcagacaatgaagaggaattccactggcttatcaagtatggaatttctgttatttccaacaccacttttactagaatatgtgtttcagttattagttcattactccagtgattgctggtctagtgggctatgtagaatactgctacaccactttattcttgaggtttgaaaattacaatttcgtagctgacagtttccgagttatatgtgctgttcaggtcttttaattgagagtccagtagtgcttaattatcatgttaatttcttcatttttcctgcttagtctgaatattcctagactaaaatcttgcatatacgttaatccactgagtccatcatatttaattatttgtggtgataatatttttctatccaattttccgtctcggcagaaaaaaggcatccagtgttccaaaagagtctttttagtcattcagtaatagagttcattgtgaactctgaccaagttgaaccttccattttccaaagtcacgccatatcttttttcagtgttttattagatgtattacacatctatgctgtactgatgagtggtgaacatgtactagatattccccccttcataatgtgaggagaccttgggagcaaagttttgttaactgttgtcagtacccagcaatcatgctgttgactgctgatcatgatgatcgtgttgtgccattgcactcattgaagttgttagcagtaagttacatttctttattccatttctctgcattttcatttgaatacaaagcatccagtccacaatataaaaatcattggttctgttaggcataagcatattcaaaactgaaaattatcaacaatatttgaatgtagtgcaaaacgtaatgagcatggttgggataaaggcccttagacctagtcgaggtgttcctggacccaaatggtgtgatggtgccatggagatgaggatgtgactaaagactctttatttatttcttgcttaaggagtagatatgcgtttccatccatatataaatgtgacaagacactttaaggaacttctaagattatggaaacaatacaaaataaataaaatctgaacagcccatgtgaacagtacaacgcttgaatagtaatcatgcacgtgacaaacaaatattttgtaaacgttgacaattttatagtgaagaatctataacataactggcctgttggtaggatctctttatagattgtgtaaatgcaagcctgtattcttgtaattgttgagcctcaaaacctttgctttaagccttccagttatgacatcgtcttccacatagaacttggcttgaagcccacttgacaaagccaatccaattacttaacccgccttccactttgaacggaagctgaaaccaaatctgtgggtttgactcatttaccatcctgggtccaccaagatacttggcatcatgctagtaatgattaccacgccatgctactcgtacttagttaaagtgcgaagacattgtgtgtaggcctttagggaagtattgggaaagaatggttatttcatgccagttttggacagaaattgtcaggaatgacacgttgatggataaatggcacaaacaaaaagaggaatttgattgagaagtaaacagataggggtctttgttgtaaaaaccaaatttcatgtgtggcgtgtgacaatgataagtttggtgtgtttctgttaactggaatgtcaagcaacattgaggtgctctgaaaggattaatcggattctgattatgtatttttattttgatacattaaacagttgtttgattttctaagcaccgtgattatgaaagtattggatgatggattagtcgttcgatttccgaatgtggtttttcacctctttagttttatgttctcacccctttgcttctcttgttattcagacactgcagtatgtcttgtgcactagcattgaggatacaccacaggtcaatccaataattggtcgcattgacgtcaagtcagggcatggagctggcagaccaactaaaaaaatggtttgtccaattctacatgtaccgccatagtttcatatcaatatatttatgatgtttgcaatctattgcagattgatgaggttgctgatcggtatagcttcatggcgaacatgttagatgcgtcatggacggagtgattcattttgtcctgcataagttggagatggtgagcgttgggcacgtgcaacggtgcaagacaggccctttcaaacaaatgatctgtgcaagaactttgtaggatttttgtttgaccatttggaacgaaggactggagcactaaaaatcttttgggatttctttggaatggcccaatgtatgaagatttgagatgaaagttagcatgaggtgtaacctgttagaaaatttctctcttgaatttctaagttttttctgtggtctgttttacaatcctccaatttacacttccattttatatcaaaatcatacgtttacgtttcctctatgcttgtgttttctctgttacaaaggagtccacatcaaccctccagacaaacgtgcgcactaaagttttgctgtaagcttggaaagtaaactttgtactccatccagcctattaatacttgttgtagtgcactttgtccagctgtgttgtcaaagttcatttcttgtgttttcccccaaggtagcatatctgaatggtgactaacaggttaaccgtagagccaggattagctgcctgacttgatgagaatatgtcgtctcacgttccttaaatactgatgtgaaacatcatgcattttgcaggctgttgagaagaggagaggaagaaagaagagccttttcttcaagtaggtttggctcctataccgtggtgtataatttgtattcgtgattggctggatgtatgtaattaagcgggtgataggtttggcatattctttcggctgtatcttctgctgtgaaggaccataggcgatttaaacacaagggccccaggtgatgggagttttcttcttttttttccttcttccttttagaaacatgagttttgtcgttgcaagggatggaagcgtgccgctgattagaattgaagctaatttatgctaatagaatggaaaagataaataggcaagtcctaggatgctctggaaatattccctgcatcgtagggtagtgacgatcatcagttcacgggtgacgtccctgcctgctggttgcttccaacgagcttgcaattttgaagatgacgcatagcagtgcttgaacatgtatacaagtataactgatgtatcatctgctgtgtaattaattgagacgaagtagacttgtttgaatttggagatagcaggagtagataagataacaagagcatcttagttattccaacgtgtactgtactgctggaagaaaacacttgcattattaggcagttgtacgtagaagaaagaatctgggttgcagttgtgtctacatcctatgaacgttctgtggatggtacagtgacattgaggcgggcaatgtccacaccacacttgccaaacagaatgtgaaggcgtttggcataaaggtcaactggaactttcaattacccgtagtaattgaaggagataacgtggcatctacacgcatgtggtatgacgtgtggctgctaacatcagcagcagtgttcatgctgcttgctgttcatgaattaattagctgtccatccctcctataattgcattcttttttactacccctccttcgttacctatagatggaattaaaacagacaaaattatgattaattagttgagaaaaaagaagtacgtgaagaaattaattgggatggttgtgattgatttagattagactatatggaaaagttgttctatgtttgggacggggagagtggtcaataaatttctctccacgggtacaggtcaggcaaagggtatgaacttggagacagtatgcatcaggactgcttatcaaggaattcttcagtaggtcctccctgagacaaatcaataaaggcgagcgattagactttctaatttgactattatttctagagctaaaccacatacttcatccatttcaaaatataaggagttatagatttccatccatccaggggcggatctagaaaaaaatagtagcgggggctaaataaactacatcaatataaatcgaacctccagtcctcacatcctatagatctatggaaaaaaatttagtgggggcttaggggggtctccattgtcccgggggcggtagtggggtctctcttcccattgacccccattagtccccccccagcgcttacatcttaccatataaggcgttatgcatatttacagccgcagctgaactataagtggtcgcgcgaccaccggctggtgcctcccaatcacatgctttcctaccctttactgacatatcatgcaccatgatccacccttttgacccttataataacttacaccagccttagacccatatacctgcttactctccatatgggcctcttctgatccaccatactactagaatgccacagctaacgtttttctatttcccccactacaaaaaagtgatcttctgtgaagccaattatcctcgtcaactctcagttttcccgtgcataatagtactacacacctcttcaaagactgtagttttaactagaaaattcggccaacaaaaaacaaatgtatttttaaaagggaggctattagacatcttttaagtccctttgatttatagaaaacatacaaaattttgagaaatttcaattttatataaaaagttttctattacaggttttgcaaaaaaaaattaattaagagattttgcagaaaacttaataagagctcttaatctcttggaaaattttttttgaaatcttatttcgaattctctatttttctcttgcttcaatcaaaccaacattcatttgtttt

SEQ ID NO: 70241 - DNA, 1366 bp, Oryza sativa
ccgccgccgaatccgccgcatcccatcgtccccgcgtgaaataaataggggggaattattccccgtgattccctctcccttttcccccaattttccctccctctctcccttggattcgtttggaaaccctcccctaatcccgccggcgccattgatggagcccgagaacgcccgtgccggtttccttcccctctggccgccctctcccccttccaaccctatttaaatcctccccgcacctccctcgtccgtttccgcctctcgccgccctttctccccgccggattcgagctcgcgacgtcgctctctctctccaccgtcgccgccgagctccggtccgccaccgtcgtcgccccggaccgcctcccacctcggggccgcctccttcggcttcgccgcatcctcgccgacctcgtccacctctctgtttcggtcgccgaccgccggaacgccgtcgaccccgtcgacccgagccgcgccaccgccttcctccgctccggccgcctttttcgtcgtcgccgtcgacctagggtgaaccgtggaccgccgcctcttttcccccttcccttcccctctgtcggccgccgctccgccgtgcctatggccgccgccggcgaccataggggcgcgggcgccacctcccgccggccgcgccgagtggccgccgcgtggggcccggccgtcagccacccgtgccctcgggtgcggctgaccgtgcggcccacggcgccgaccggtgcgagcccgggtgcgcccggtccaccgtggactgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccattcaagtctctaatttttccttaagaagtcaagaacccatttttgtgctttgttcctgcttgttatatggagtttattagagtaaaagccttttcttttccgttggtcgtgtagacgcggcagcttcggaagatccgctcttcgtgaaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatacctatttacctttgttatgaccttattattgttattgttattatttccttgttcaccctagaataaacaaaaccccaactagtgaacactctactcatggtaccactagtatgatttt

SEQ ID NO: 70242 - DNA, 2187 bp, Oryza sativa
ccctcttgctccttttggcaggaggggggaggtgcggcctgctgtcgacctccataccgtcgaccccaaaatctgtatcatactgtaattggagatcttcatatctttattcaatggcaggagggagagatacaacagttggatggggacgcatcggcggcggacgagaacttggcgctggccttggagttatattgatctcaatgctgtgcttgggccattgaataaaggtcccacatgcagccccaagggtcagaatctcgtcattaggtgggtgggggatagtgtagccaacccaatcgggcttcactaagtccacctgaactttggcattgccggctagcagctgcgctccatgcacttgggtgtccggggtaggcttgaacgcttgaccctctgcagcaggaattgcaaatcctggtgtcaccctaacgactagggtacacgatgtgggttcctgcgatagattcattagtgtccttagaatatgttgcaatgtattgtggtgctaatacaatatatgcctttttaagttgtttttaccgttatgtggtccaccgcagcggggcctttaggctattctgccggagcctcagttgatgcgcagctgctacgcctctgcgtggggctcacttgtactatgggaccgggagtggcatcggtcgacctatccctgatgcgtgcctccacccgagcctccatacctaagagctcggtagtgagctcttctctaagctcttctttaagctccacccgaagttggtccttaaggcgtgcagttttctacgcctttgaaagcttgtgcttcttgtactgccacgcgtattggggaaacccaaacttccatggaacattggagccaatgccccttgttcgtccacggtgttcttcgtttccaaacgctttcgtgaggatgtcatcctcgcgtctttgtgagcagacctcttgggaggcatgtctctcagcattcagttcgacctggggtacggttaggatgagttagatgaagaataagatacgacataatgaaatttattctatgtgttcaacttacgattttctggtacaccgcttgatctttgggatttgggaacaaaagagttccatcactattcttcttcacccttgcccttgcgcagttccatgcccgctggaccgggatatcagtaagcacttgcggggtgttagattccgctgcagcttcatcctccttgtcccattcttcctgtttccccgtgtaggctccggtgccaagccggtgcgggtgaaggttccttgcctgcagatcccggtaggcctggctttttgcccgagactctttcgttgatttggcggcatggaactcatcccacacggttcgggtgatgaatgggtatttcccaaatggttctggttgggctgggttgaggacgtactccgtgaccagcgttgtcttgaaatttttccaacaattccccatcttgcggatagcctgccgcttgagtcctgcctcggcctctaaagggtattggaagctttccttgaactgcctccaggcctcttctttttcttcttgagggaccagatagatgtggtccttcagaatagtgaagttccgcctccctaggactctgcatatcgtagggaactttttgacagctttcgtcagagccgtcggatatccaacattgtccacctctgttatggtgtagacttccttaggaatctaattctgggtcctaggattccggctcaaagtagtcctagtagtagtcgtcgacattggttcgccttgctgcgacatgtcctatgtgactgttgcacgggaagaaagtactttttaaaaagtaaattgcatctagacacattctctgatggtttgatatacctctatctcctacctgcgcccgccccgtcgaaggatgtcacgtcccaaaacgactctaaaatatatcctttaaattatgcctagaataattaaaatccgtgtgtgaaagcctccaaaaattaaaatgtgcaaagtaaaagtcaaataaggcttggaggatttttgtatatttcctaaaagcctaaaatgtgtaaataaattttagtggaattttcagagcacaaataattttagtggaagttaaaaaggttttataaaaagaaaaaccctaaaagtcccccttccctcccttgggccggcccagcccatctctcctctcc

SEQ ID NO: 70243 - DNA, 582 bp, Oryza sativa
atattcatctgatcataccctggttggaatggtttctttttggaaaaaaggcgaaacaccccattagctttacctgaactattaaatcagataggtatagtaagcccctacttgttcattggtccaaatgatctctgagcggtttcacctctatggtgtcactggtggagaaaccctttgtagtcccggttcgtaacccccctttagtcccggtttccagaccgggactaccaatccgggactaaagatcgatctttagtcccggttatttcacccgggactaaagatagcgatctttagtcccggattggtagtcccggtttggaaaccgggactaaaggggggttacgaaccgggactacaaagggtttctccaccagtgacaccatagaggtgaaaccgctcagagatcatttggaccaaatgaacaagttaggggcttactatacctatctgatttaatagttcaggtaaagctaatggggtgtttcgccttttttccaaaaagaaaaccattccaaacaaggtatgatcagatgaatatattctcagcaggggacaaaaacatgaaagctacaagag

SEQ ID NO: 70244 - DNA, 2101 bp, Oryza sativa
cggcccaagagaggggggaactttaaggtttttctttttataaaatcattttaactttgtttatttcttaacaattattatttatgctctgaaaattccacgaaaatttatttacaaattttaggcttttaggaaatattcaaaaatcctctaagccttgtttgacttttactttgcacattttaatttttggaggctttcacacggattttaattattctaggcataatttagaggatatattttagggtcgttttgggacgtgacaatttatacccgagaattacaagatatgtccataccggacacgatcactatctctaacaaactctaagataccgtaagtctttgtggcagacttttgcccaaacatatctctaaggaagttgcataaaacatcctaattaatagatacaattgccttctcaggactctatccatgtgcggcaatcatcttgaagcacctcaattcaacccgatgtcatacaccaaattatactgtcggaatcggctgcatcggcttacctagtccgacttagacccagcagatcctaatcgtagccgatctggacttcagccgattcttgttctgttctcgaatcaatctctgccttcgactccacctcgatctagtctcctcttccgatgctgatattaccaaatttggttattaacaatagtcccattcccagcaaccccattcccagcatcacagcattcacaaccaattcacagcatcatagcatttatattcccagcatcgcagcatttatattccatcacaacacatgcattcacagccaattcacaactcattcacatttatattccatcacaacacatgcattcacatcacatatatgtcattcacatctatttttctctccaaaccgccgacatgcatcaaaacctgcaaactaagttataaattggaaagattttatatgtaattagaaatgcaagtatatacagagatgagctacctaggactttactctaaagaatttaattgtattacaaagaatatttacaaaaatcaaatgtttgtcgcatatgcattgcaaatgttctgccattccgagacgagctacctagaacttcactctaaacatccctttcggtgacaagagatcatctagtatgaattgtgctatctcctctctaatgatatcgaagttgatttccggaatcgttgaaattttttcctgcatgttcggcgccaagttagtctacatacttgtaaaattgtcgtcctatgtgtgtataaacaattgaaggacacacctcagggtcgagcaatgtcaccttgtctgcgaagctcctcatgttatggcagacatggaacccgcactggtcgccaacttgttgacgtattgggaagtcttttgtgtgaccgagtttcggatgcccatccttatgcctcccgccacttgccacgtattggtcccatgcctcgttcaaggcagatttgatggccgaccaatcgtatatttttggattgatattggagttaaggtagtgtaccaaactccacttcggcattattaccagaagaatccaatgacgcctgcgaaattaataaattgccagttacaaactacagttgtacgcatcacgcatttgagtataagtatggtacacgcttactgttgattgtaggcacacataatgaagtccttgtcttgacgggcaaataagcagtccttgatatagtccaccatgttggctcagtcattttttagcgttatctcattgacgacagctggatcgagtaaaacaacatggggtgctttatgatggacatgcttccaggttaacctacgagcaagacaaaagtcagggtaagcgtaatttatggatagttactaccatatcgcgtacccagaaatacttaaaaggaatagcacttaaggaggttggtgtcgatcgctcgcaccctgtagaggtcccatagatctttgaagtctacggcgatgaaggtagaaggcccgaggaacggctgactattgtgctagcccaacatggaggtctctctattcttcctccttgcattggacttctccatgtagtacctgtgcaactcattgcatgcagggccctt

SEQ ID NO: 70245 - DNA, 595 bp, Oryza sativa
tggttttacaactctagactttgggaatattcatatcacctggacactatggaatggttggattattgtggaattggattcacacctccccctctattcaaaaccctcaaaatggttttaggctgggcttggggtgcatggttttgatagtagcacctcggccatataaggaccggtcttcgggcctctattgcaaagcactaccgtacttccacatgtctagtgggtaaggcttagtttgtggctcagtctggttataaacaaaagtacacggatggagatagtacacggatggagatggatgaagtcggggctcgatggacatctctagggcaaatgaaggctacacgagctgcggcccggtagtcgagatgtcatggcacagggccggtgtcctgctgttaggggctcagtcctgcctacctgtcccggaggtttccgccgtaggtggggttgggtcggtactcttgtctatggctaggatgggttggaaactatgtgacgtcttccgtccgtataccgtggtggtatgtggcacgtggttacacgtgaggaagatgtgtcttgtggttaagatgtacacctctgatcagag

SEQ ID NO: 70246 - DNA, 14431 bp, Oryza sativa
  unsure (1)..(14431): unsure at all n locations
ccctcgcccccccattgtggatccgccccagcatccatcctaaaatataaggtgttatggatattttgggatggaggagaagtatcattgtcgatcgatcaccggctgctgctacccaatcacatgcattttcccccttcgctgccatattatgcaacaggatcgatatttcaaaccctcattttaatttgtacgatcttcaaattaatttcgctggagactatggtggagagctactactcatacagtcatactactagaatgcaacagtaaatgtattaatagtggcaagacaaagagaagaatgggctacagtgaaacaaataatccacaacaataatcaataatcgtgtgaataatagtactccccacgtcttcaaaagactgtagttttaactgaagaatttgtccaacaaaaaacaaatgtatttttagagtgaggtctattagacatctttaaggtccctttgatttatagaaaacataaaaaatttggagaatttcaattttatagaaaagttttctataaaggtatttgaaaaaaaaattgaatcaagagattttgaagaaaacttatcaagagctctaatctcttggaaaattttctttgaatccttattcgatttctatatttttcctatgcttcaatcaaacgagtattcatgtgttttttctgtgttttacaatcatctgtttttgctattgtattgctgtcagaatcatgtgtttttcttatgcctccgtttttccatttatgcaattcaaagggagcaattagtattttgttcttgttttctctccgtaataataaattgcacggcagtctttaaaactaactttttttaagggacataggtacggatggagagcattacgatggatacatgcatgaaccgcgagagtgatacaaactggctagtacagtacaaacagtagctacctagtcgttgtggatacatatgcatgcatgcatatacatgtacatgtatgtatgtatgtacgatcaggacaggcatatatatctggatctgcttaattggatatattattcgtagccttttgttttgtttttctagctacagtgtacactaatagtgtacccttccgtctaagaaaatctaatcctaagtacaaacgtgaatatatatgtgttcagatttatagctaacgttttttttttttacggagtagcagtacttggactgatttcaccgctcgtaattatatgcaggtccatgtcgatggatcctctctcagatcgtctgcgccacacaggacaaaccagtagtatatatgcatcctgaccatacattgtatacacatgtacatacatgtaagggtaattaattaagtctaattaactattgcttccataaaaaaatattacttcctatatcccaaaataaatacagtcgtatactttaaatttggacaacacggctgcatattgttcaaattttgggatgtacaccctccgtccaaaaaaaaagacaaaccctagatttacgtgtccaacgtttgactgtccgtcttatatgaaatttttttataattagtcttttcattgttgttagataataaaacatgattaatactttatgcgtgacttgtctttttaattttttttaaataagacggacggtcaaacattggacacggaaacccagggcttagctttactacatactcctgttctaccaacaatcaattgtctctgtttgtttgagctataacttattttgaattatagaattgacttaattttagaaattactttaacaatttttcatttgctcaaatctcctcaaagtatgttttgttctggtccccgcccggcctgtatatatggtggaccaaaacgacatgtgtatatatatcgtcctgtactatacatatctgccaatctatagctaaagctcgactagtgtgactggacagctagaacctgcaatattccagtctcttgggtatgtatgtttgtcgtatatgcagaagtactattgcagtatggagtatattctttccgtcatgcaatttttgacgttttactagattatttaccatatattaaggtttgaaaaggaatactatagtgatcttattaaataatatatgattgaaacttaaaaataaaagggtgattgagaagagtaagtagaaatttggaccaaaaatgattaatgcatgggacaaatattagtaatactttattgtctaaattttttatgataaattttaaattttagagagagatagtaactagtagtattttgggacgggacgtgtgtatatgttaaactgaataaagtttgggctgtggctaacgtacctgtggatgtaccaagtgtattgtacgtatatgtttgttggtttgtgcagctgtgctagctagctgctactacagcctcttgtgccttgtgtacatttgtctcctatctacagtatctgtttcatatccatagatattagatgtatgagtatccatccatcttgtaggctgctagccagtcagcagttacaaccacaacatcaatagatgcatgtgcaacacatacacacaccttacgtcacccttgctgccgtcaccagcaattaacgttagttaatgctcaatgccagcacacgctttagttgacacactatcacaaccactccctactcctacgcgcgcgtacgagtaacatgcatttagctggaatattgttcaacattcaattcaaggcgatctatatatcatcaactgtttatgttagcgctatcaagtttaataatactgtatatatagcgctacaagaacgtactactctccctttgcaaaatttgataacctataatagaagattagacctattttagaactacgaatttaaatagatatgaataatttttaaattcgtagttataaaatggatctattctctcattttagttcgttatatattgaaacgaagagagtagttttagaggttatataaaaggttagtattagaactaattagcggcaacgttcggatgtgctggcgcctggctgccatagtagagcagcaatgcaagcttgggtcatgcagcatgcagctagctgtggctgctacgatcgtatctagcggcaccgaattaacactccctaacatttagtacgtacgacgctagttataacactgttttcatttttatccttcccttttaatttctgtacttaacgcaactcttttggagtacgtgcaatatatatgtactggttcttgtatgaaaaccgacaccatttatgtcttttctttagttaatgaaataaaatctcggtctttactcaatgagatgtaatcaattagtataaatttgcgtagacaaaattgcacatgaacaagtcataacaagcacaccgaaaatatgaacggggtagtatgtcatcagtacagaaaatagttgagagattagcatgggagtcagtgtaatactagatggaatagagggcgaaatgaatgagatccagaaagagcagactctagctcctgcaaacactgtaagagtacggcctggtttagttcctaactttttttaaaaaacttttaacttttttatcccattaaaatttttctacacacaaacttctaattttttctatcacatcatatcaattttaatcaaatttttaattttggcgtgaaccacaccctacgcttgtggaccctggctatcgcaagtgcatttaatgcagggtcccagcagcaccacatgaatttgcagccgtcctggtggtgtagtggggctatagctagctgtaggtacgtgtacgtgtaaatactatagtatacagggatcatatattagttacgtgctctaaaatatgtataggctaccttgctatcactaatgttttagaacacatatatattgtgttgctgtgtttggtcatatataatatactacccctaccctagaatataaagacattacatagtataatgaatctagatatgattatatctagattcgttgtgctatgtaatgtcccatccgtgctgtatagtttgggtttttttttacggaggaagtatatggttagacacgattactaagaaagtggtaaaattaaatgaaaaaaatgttgtaactggataagaagtgtaggcatgtgagaaaatttaatgatggatattatgattggttgggatcagaatgttggtgaaaaagttattatattttggaacaaactttgatagctaaaaattattatattttaagatagaggaaacattgattgtatgcatgctatatatatatatagaattatacggaataaatacaaacggaagggcctagctagagctaccagctgcgtgcaaatttattccgtataatttggaaggatatatcttgcttcattttgctattagcttgctttggctatcttaattaatatttaaaaaacgaatggtgctgatttgctctctcatctttataaatatgagcactcgtctctctgtacatagagagagtgagagataacgcgcgggcgctagctagctagctcttaatgtgatatgtatacacaatttttcctttatctgtcaaggaatgggtaaatgcatggttgagagaattaattgagtttcagttatagatatatagctggctgagacgaccagttagccatcgtcggtcgacgaccaatcagatcaatcagttaactaattatggatcaggagaaggcggacggcggcggcaggaggaggaggagcagggcgacgagtagcagcggcagcggcgcgagcagcacggcggcggcggcggcggcggagaggaaggagatggagcgcaggaggcggcaggacatgaagggcctctgcgtcaagctcgcctctctcatccccaaagaacactgctccatgtccaaggtagctaggaattaggatcgactactcactaattaatttttattgagttttagtttgctactacaagattgttgatcgagcttatatatgctattggatgactaattagtgttcaatgctggttaaaataatgttcatatatgcactaatttctttggtttgctctaaggttaattagatctagttttgtctcatcggtccttacatgaaatgttaattaatgtaaatccacatgaaattaggctactatactagctagacattgttagagagttcgatcttgcgcgcggtcttaattagacaatcctcaagacttcattgaatgggccggccgggccggcttaaaattgtgtgtctcgatcggatccttccaaattgcttgcatagcataagaaaataaaatttctatatgtcgagattcggatgtgccatcaactcaattccactcattttcttcatgtaaatagttctgatcaaatttcagccaccctgttatatattacccggtgcaacgacgggcattttgctagtagatgtaaaaaatgacaagtaaacttattattagaagcacagagctagggtacaatatttttggtaggataagatctctctctctctctctctatatatatatatatatatatatatatatatatatatatatatatatatatatatatatatatgcgattaattgttgggcagtaaattaattagttaagctggttggagctagcgaggaaataaataaaatgaatgtgcatgcagatgcaggcggcgtctaggacccagctgggcagcctggacgaagcggcggcctacatcaagaagctcaaggaaagggtggacgagctgcaccacaagaggagcatgatgagtatcacatcatcgcgctgccgctcaggaggaggaggaggaccagctgctgctgctggccagtcgacgagcggcggcggcggcggggaagaagaagaagaagatatgacgaggacgacggcggcggcggcggtggtggaggtgcggcagcacgtgcaggaggggtcgctgatcagcttggacgtggtgctgatctgcagcgcagcgaggccggtcaagttccacgacgtcatcaccgtcctcgaggaagaaggcgccgacatcatctccgccaacttctccctcgccgcccacaatttctactacaccatctactccagggtatgtactccaccaccacctatatatacgccaactaattaatttattatatgtattcgtcaactaattaataactatatactagttcattcagatataattcgcatcatctatctctgctttcagatcgatatatactcaattaattagacttcttcttgaactgtatgcaggcctttagctcaagaattggcatagaggcttcgaggatttctgagagactacgggcattggtatgacacctgaggtaccagatcataactgtatatatatgtcttctacacatatatcattccataaacatatatatgtgaatgtatttatataatgccatgcatagagagctggattttcatttttctaagagaacatttctttgtaactgcttgctgcaaaagtacatttattcttatgtgtgtatgtacttgtagcaggtgatccggtcttgaaggattttgtgatgggcttggcccaactataacctgggctagctaagaatttccaaatgggcctgatccaatcacctcatgagtagtccagtagatatctcgatatatctctactattataaaaattgaagatgtttttgccgatactttggtacgtcatccatgtatgagtcggtttttaagttcgtttgcttttggaaatacatattcgtatttgagtcaatttttaatttttaagttcgttcgcttttggaaatatagaaggagtcgtataagaatttttttaaaaaaactcgcatgctaacttgagacgatcggattcataattgcagctcataattttctaaaaacagaatatatatatccaagcaaattctcacataactaaaccatataacaataatagattaaaataaataaataatgttcacccggtgcaacgcatgggcatttgttctatatattatagaaaaaaaaagtgaaaattgatggcgacaaaaagtaacctatataaatattaaataagttcaatggaacgctactgcatgcgtgtttgcatgtaaacgtgacgaatatagtttatagcattatagtctaccttggttagtttctagaataattaattaatcatgtatactttgtttcatatctggcaattgatatctcgatatagcgtgccgaagaatcgcgagaggaatccccttttccttctgctgagaaatatgaatggttgattgctctactacttaataataaaatcacaatcactctctagtctctactttgcatctttacctaacactccacatgtactagtacacacgccatgataaaattagtgccagtttccttcaataaataaataaattagtgtcaggtagggtccattgagttgatcatcttctttttttttttttagaactgagttgatcatcttatttatacttgggtttctttcgacaggccagcaatgagtaatataatctcattacatcacatgcatggtgcgactatagtactttaattacatgatactattgtgtactattgctgcacacatatggtggataatattgcatattatattttaactagcaaataattaattagcataggctgaccaggtgtccacttgcaatttttttaggggagaaagttgcagcttaattaagttcagatcatgcatgatatagctagctattgcgaaggacgtgcatgcatgttccaatcgttagctaagcacgtaccccccaactgtcattaaccgttaattacaaccgccacattaaacttaaaattctgtaatgttaaattgtttatttattaaattaagataatcacttcgatccactcgatattgttgcatgtttttggataacataagtatcatgggcttaatttgcaaaatcttaattaattttttacgcgtcgccctatagtgtgtatatatatatagatactcggttagtacgcaacttcggctggagtataatttatcatcagatattcagatttctggaagcttaatatttaatttagttagtcgtaggtatatatttcacgtggcatcacactgaccgagggggggaacttggatgaattcgattatataaatatttatacagtatactgctcttgcaacgtggagtaaggacacatatatagctccaacttctaagtttggtgttgggtctggagtggagttgagctgtgagctgtctaaacccagctatacttctctagttccttttgtgatagggctccacctagctctgctactattttaggtggagctgaaactgtttggctgagaggtgaagctggagctgtgccaaacatgccctatatatactccttatgttctgaacaatcactacctccgctttaaaatagttatctttctaaaatttaaaatttatcctgaaagacttatcactctagttactacttatcacattcatctcttttcattcaaatttctttctattattgtatttttcaagtactactcaactttcaaccgtatatcatttaggccctgtttagatcccactctaaaatttttcatcctgccacatcgagtatttgaacaccagcatgaagtattaaatataggctaaaaataactaattacacagattgtgactaatttgcaagacgaatcttttaaacctaattgcttcatgatttaacaatgtggtgctacagtaaacatttgctaatgactgattaattaggcttaataaatttgtctcgcggtttaccgacggattatgtaattagttcttttattagtgtccgaataccccatatgacaccctatataatacctgacgtatcacgacgaaactttacacccctggatctaaacaccccattaggagcactataatctcttttttaaccattatgctagataacgtgttttttggatggagaaagtactccattcatcataaaatataataaccgagaatcaaataaaaagtatctatgtccactcgtagtattttctaggttgctatattatgtaaacagagggagagggagtaagtgtgaattactaccgtgtactccgatctctctctggatatacatacctccccgggagaaggcgaccgatactttccccttctctcgttcccctcctccctctacagtactctccccaaaatctctcctcaccggcccctcttccccttcgattctggcggcttgccaccggcgagggttggaggagaggtccggccacctcccctctactagtattaggttgttagatctattattaggtcgtcaggtgtctcctgtagttagggtttgtccctaattggtcttttgccgacgagctccatgggtgccggtgtggtcggatgcggcggcgggtggtggcggtggagatgcgagatccgaagaccggtggatgaatcgacggaaaaggctggttccttgcggcggcggcggcggctacatcgtcgtcggcaatcgggagaagccggctccttgcggcggcgccagttgcttcgtcgtcggcgtccgggatgtcactgtcctgatgaatcgacagaaaaagctggctccctgtggcagtgtcagtggcttcgtcatcggtgtccgggaggtcgctgccccgttcctagagacggcggcggcagcttcttgaggcctgcttcgccagggcaagctatcgcccagagcttgctgctcgtggtgcttgactgcccgttggcgaggtggcggcgattctgccggtgcatgcttgagtgcttcctatgccatggttccataagtcaagtctcgcaggatttctctcccccattcccgcatgtcgatccaagaagacagcagtttatttgccaccattcgagtgcttcagtgggtttggggatctggatgtgggctccttcttcctctgtgtttcccaccagctcattccatgcagggtttgttgttcgggttgagctcacgctcctcagatttaacgacgaactccgtggacttctcttgctgagtccggtgatgctccctcaaaatctacggcttagcagcaaacctccgttttgtgcagtcttcgtggaggcaaccggatggagattaccggtttgtcaagcgtgctgcacgccaaaggaggcccaaggttgcattcgtcgcggcattgccgcagctccctgtcgatgtgcaccttctttgcagtgtggtttcatcacgaagtttgtagccttaagtgcagtttccccgttctttcgaaacggatggttttatgcttccttttgatctgtttgcaatgtactgggatttattcccgtgaactctgtcgccctgtattgatggatgtttaagtttaaaaaaaaaaaacatacctccccggggacggagggagtatctctgtttatgtgaacgttcgtacggtctgatcgacacgcgtaagagtgatgatcagacgcggttgatatatgcacgttagtcatcctctcttgattaattaattagtgccacattttcagcatgccaaaggaccctaccggtaagataaaaaccttaaaaactactccacgtttatataattaaatatataggaggagcagtcaactctgcttctccaacgtccaataatttttactagaggtagcatgatatcaatttaattatgccacttttggtactcacaaaattacttcaacctctattatactccctccattatagtttagggccaatttagattgctaccctaccaaaatttgtcctaccaaaattttggtagggtagcaaaccaaacacctctactactctaccaatgctataaatttggctttgcctatgaacttgtctcttataggcaaattttggcttcaatccaaataaatattttcaactctactctaccaaaattttaatagcaccaaaacttgcccaagatttggccctaccaaaattttggtagggcatcaatccaaacatgcccttaatcatcttaaaaagagaccaagatcaatgacactaagatattcatcactctcaaattaatcacatcaattaagatgcttcatcgtttcgtgtcctatcaattaccaatagaagttaattttgaatgtatgcatacaacacattcaaagaaagacgcagcatattttgcacggcacacgtactgtagcgcggttgggtggaggaacaacgcgccatttgagtttgacccgcatttatctgtcagaattaataaaaccatccacaagccacgcgcatgtgggacctgcatgtttaaggcgagctcaattgaattaatatccttttattggaagttggaacagaggctttaatcaattaaaaacttgtgccagctcgggcgcgatcccgtttgaacacgcaggtgtctaatttaattgttgttaaatctatgtttagtttatacgatttgatgccatttttaacttattttacggttttacaattaattcaactctagttacataatttcgtgaattcaatagtttcataaggctatctatagtcgttagctggcattgctaattttggggttttattgagagggtagtgggctctatccccttcccgttgttgtttggaatcgcagtaacccagttttttccttggtcttttattgttttccctccttccttggtataagtcggtctggttgattgcattgtataacaaatattcttttcttctaatacattgacgtgcaatccttttgcgcgttcgagaaaaaaaatcaataatttcaaagaaaacggtagattaagagtagttataatttgcaaattgtaatctgtagttattagttaagttctcggaaatcaaaacttagttttaattagtacctttcagaaattagtctgtagttattagttaagttctcggaagtcaaaacttagttttaattagtgcctttcagaaattagtctccccgggaaaaaaaaagtgtctacaatatggagaggatatatataaccacatgtcaatatattgtcaccacgccagatcgacacatctgtaatggatcaaaatgcctcgttacgcaaatgaccttatctttgatggactagactgaagcttgtcgttctatgtaaggcttaatttgggtatagagtgatctacctatgaatttaacttgcacaatcacaaataatctaaatatatgggagtatagtgtatatgcctaataaagagcgatcgatcgaatcatgcaagtatgcatgcatctcttcgccaaaaagaaaaaggaaataaaatacatcataaatggacggagctaactacagaggtgagaacagaacaaaactatatatagctctaggtcaacgccctggaatttagcacgggaatgtactaagttaacactttgatgagttgagattacgacataagctagacaagttgctcgcagccactggttgattgattgctttcaagcattttgtgtttctttaaaaacatactccaagctagcaagagcacagacgtgtgcaaatcatcacgtgtacgtgttcatttgcatctgttccaagaaattaaaataaagtactcttgtagtaattaactacatacatgcacggttgaattgtttacaaaccgatagtagttccaactggtacgtagttaatttcttgcaacaaagactgttgagaatgataaaaatacgaatcaactagcatgaccatcaaaataatttattcatgacatatggagcagaaaatgcatgcagttggaagatgtgatgtgtgactgtaacaagatagtactactaattaaaaagcatcaactggtgatggtgaagcagcaatttttatttcttgtttttataggcatgttgaccatgcaagtagctggccaggtttgcaactgtaataccctaattgtaaacatggaccttcttcgtttatttaatttcgagaaagcaattaacaaaattgttatatgtgtcttgtggcacatgtttgattgaaaattgatgttgtccgggatggtcgtttgcccttgtacagtggttgaattgttgccagactagtccgagataaaatttataggagaaaaatatgaagaaatagtggtggcacagagaggctaatccagttcacaattcacaaagaagagtagtctgcagggggtgatatactttaaggatacagtgaggagagattaattaggaaggtaaaaaaagaatcatgatgtttgcttaggctgtgttctttccctattttcccgaccagcctctctcgttttccacgcacacgctttttaaactgctaaatattacgatttataaaaaaaactttctatatgaaagttgtttaaaaaaaatcaaattaatctattttttaaaaaaatagttaatacttaattaatcatgcaataatacgagcttcattttacgtgccggggaggaggggttcccaacccctccttccgaacatagccttagtaaatgcagggataaataattaggctgcgtacggtatatcactttcttacctttttgcttcattgattttcacacgcatactttataaacgttcattgaatggtgtattttaaaaaaatcaaaaaattattttaaaaatcatattaatatatttctcaaatttagtgagctacctcgttttatgtgtaaagaaaagttccccaactcctcctgccgaaacaaaacagggcggatccatcatgggagcgttggggctcaaacctccactactgtcatgaggatcatgggagcccccacgaaaccctaacaatctttttttttttgccatatgtagattggaggagggttgtagctctgttttattttaatgagacccacctattttttctttctcgatctggctcaaacataatacttcttagagctttctagttaagaaatattgaagttccctacgaagattacccctacaaaaatgttagaatcggatgcccactcttggcgggcttcaaaactcccggatgattttcaccaggccaacatggtcatcatatcgatccctcgccttcaggttgttgatatactttatgctggctaatttatcgccttcaggaattaatagtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagctgtgctcacctaacagcatttattgcagtctggtcaggcgtgtcacgctgcnnnnnnnnnnnnnnnnnnnnnngaagtcgcatatcaaanntctcc

SEQ ID NO: 70247 - DNA, 19372 bp, Oryza sativa
ggtctgtgaccagtcacagaccggtcagatcacgggttaggtggcgactggcggtctgacgcacgccttaccccatcccgtcaaggtgtgagcttctaagcactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtcaataaagagaagaaaagtccagtttggaaagggaagggtgcatgtggtatccccttgaagtataaaaggaggaccttgcccatagagaagggggggattcttttccagatttagagcttagaacggggaagaagttggctcacacttggtagctcattcatacacaaatccacaaaaacacaggagtagggtattacgcttcgcagcggcccgaacctgtatacatcgccgtgtctcgtgtgtcttgcgggcagacgatctttccagatacagagggagagcgagagcttgagatttcaccctaagcccccggccgaactggcaaagaggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcaaggaaaagcgcacgacctctctccgagtgcgagcggcgacgacggggagccaaacccacgccgtcgagctcgtactcccccacctcctccacaccaaagtcctaagcagggggaggcgctcgagagggttgataaatccgcagcatcaccggtcgcgggtggtgcaggagaacggcgagatggggagcgtcgcctccttgtctacggcgacggcagcacgcctcaaggcgcgcttcaggctgtcggcgcgctcctacgtcacccgcctgtcgtccctgacccggagtctccagcccagcgatggctggacgatgtggccaatttggtcatgacggcacaacagcgcctgggtgctggtggacggtccgccaccaccaagacctccggcgccgctaccaccggctccgtgtcgtcaaggcggagggcgcggcgagcggcggctgctgcgcgccattcggccgccactccctcgtcgacacctccaactcgggaggatcagcatggagagccggatgcccgcatcgacatcgagcgccggcgtaataaccggcgtactccccgcgcaacggagggcgcctcttcgtccagagtgtcacctcgacctggacatgagaatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggatggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcgcacgcggtgatctacgcgttcagggggggcgtgcggcacaactgcatgctcgaaaagatcgcttccaaagagccccagactaccgcggagctttttcagctcgcggaccgagtggctcggaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgtgcgacaaaaagaaagaggctggtactcccagcagggagcgccccgccggcaggtggtgctccgtccacaacacctccctccacgatctcgcggactgtcgtgcagtaaaaaacctggctgagcgaacgaggaagtgggaggaggacaggaggcaggaacgccgtgagggcaagtccccggcggttccttccggcaaacggcgaagtgaggccaagcagaaggcccccgctgttgacatcgatgatggcgatgatgacctaggtttccaagaacctggggccaccatagccaccgtcgatggaggagcgtgtgctcacgtctctcgccggagcttcaaggctatgaagcgagagcttctggccatggtccctactcatgaggcgatgcgtcgggcgcggtggtcggaggttgctctcactttcgaccagaccgaccacccaccgtgcattgcctggggagggcaggttgcaatggtggtttcccccaccatctgcaacgtgaagttgggacgtgtcctcatagatggaggagcggccctcaacatcctttcccccgcggcctttgatgctatcaaggccccggggatggtgctccagccgtctcaaccgatcatcggtgtgacgccggggcacacatggccgttaggtcacatcgacctaccggtcaccatcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaagtcgcgctcgcttgcatggagcagcacgccgaccgcctcgctgccgcgtccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggctagacttttggaggccgggttcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcatcgactccactgcggggtgcgaccttttgtgttttctagatgcatactctggttaccatcagattcgcatggctagggaggatgaggaaaaaactgcgttcattacccccgtaggaacttattgttatatgtcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttcttgggtttttggtctctgcccgaggcattgaggccaaccccgagaagatacgagctatagagcggatccgcccccccagcaaacttagggatgtgcagtgcgtcactggttgcatggccgccctaagtcgtttcatatcaaggctgggagagaaggcgcttcccttgtttaagctcctcaagcgctcggggccgttcacttggacggaggaagctgaacatgcccttactcagttaaaggcatatctcagctctcccccggttctagtcgccccggagccaaatgagcccctgctactttatttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgatgaccggagtcggccctctccccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggccagaggcccctagcgaccggagttggccctttgcccgcttgtccgacgatgccaggagcccccgacccccaggacggccccgaggccactgagggaaggccgcccctttcatcctccgaccccgaggtcatcggcacagaagacaagtgtgccccgaaaggccacttgaacgaagaacgccccgggggtgcggcccctagcgaagaagatcggccccgccgaaaggtgcagaggcctgtctactttgttagtgaggccctccgggacgccaagacccgatacccacaggcccagaagatgctttacgctattctgatggcctcgaggaaactgcgccattatttccaggcgcatcggatcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagactgtctcaatacccgaggccagcacggacccctcacagctgcctcaaaccgcccactgggtgatgcagttcgacggttctctgtctctccagggcgccggtgcaggggtcacgttgacctctccgaacggagacgtcctcagatacttggtccgtctcgactttcgagtgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatatacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccaaagggagcgctccaagctcccttagattgattgcttggatctctgagatccaaacgtacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcaatcgacaagttcactaagtggcccgaggcttatccggttgtcaagatcgataagcactctgctcttaaattcattaagggcatcacggcccgttttggggtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccgtccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctatcatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaagggggggagtcgggtgtcaggttttggcttaggccaaccccgcacccccctcgggtgtgcagggttggccgggggctaccacacatgcacagtcttacttttcttatttcagcatttcaataaaagcagtttcaattttctaaaggttgtgtctgtgccgtttttttccttttgaagaatcttgacttgaaataatgtcactcgtgctcaaccttgccctcgggggctcggttcggtcagctaaaatcgccaaacggggcccagaaccgagccgtgccccagggcgtggtgaactccgggggggaatcggcaaaaacccacaatcgggtcacccataaccctcggtcaccacgttcccggcctggctagtctcgacatgcggatctccccaggcactagccccgacccgcgcttttcgaggactgggacttgggcacgggcccttatttcaagctaagacgcaaaaagaccacggcacagatcatcctcatctcatatatagcaaaataaaactaacacaaaatttttttcatcatttctcattgcagattaagttaaattgtacgaaaaagaggcatgaaggccttagaagaaagaacaagaaaaaagttaagattggcgggggcctgggggctcattcaaatgcgcccgggtcgccggcctcgtcgccaccgtcgtcctcgctgctggcgtcgccctcctcgtcggagctgggggcgaacgcgagccgaggggccgagccctcgaagccgttgacgatgtggtcagcagcatccccgacccgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtagaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggccttgcggtccgtcaagcccctatccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcttggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaataccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtaaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggatgcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgtccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagctgtgctcacctaacagcatttattgcagtctggtcaggcgtgtcacgctgcatgcagcgcagtacggcgcgttcctttatccggtctgtgaccagtcacagaccggtcagatcacgggttaggtggcgactggcggtctgacgcacgccttaccccatcccgtcaaggtgtgagcttctaagcactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtcaataaagagaagaaaagtccagtttggaaagggaagggtgcatgtggtatccccttgaagtataaaaggaggaccttgcccatagagaagggggggattcttttccagatttagagcttagaacggggaagaagttggctcacacttggtagctcattcatacacaaatccacaaaaacacaggagtagggtattacgcttcgcagcggcccgaacctgtatacatcgccgtgtctcgtgtgtcttgcgggcagacgatctttccagatacagagggagagcgagagcttgagatttcaccctaagcccccggccgaactggcaaaggggggcctgcgcggtctcccggtgaggagccacgagctccgtcaaatagttatttaatttatggctactaattactatcatattttaatatgtaagaccggataagacgtttcttatattttacgacggaggagggagtactatattaaaaaaaaatcatgtgagggcatatattaaataaaataaaaaaaggaaagggaagaaaagaaaagaaaagaggaagtcagtgacgcgtcaggcagcagacaacgtgggtgtggtgcgcgggagggtgggccccacacgaaaaccctggggtcacccccatcccatcaccccaccaggatggatctactgtaagcaccagttgaccgcatttcatttccctcctccctcaattgtgttgttgttacacacacttgccacccgctataaaatgaaccagagcagatcgaccacccaatccaacccaaccactcatcatccatctgctactgctactgctagctccatccattttattctagctccatccatcctttaagagaagctgagatcaagaaacgtactcactcttgcctgcatcgatccttgagtttaattaactcaaggaagaagcaatcttcgcttcggtggatgaagagcaggaagaacagcacgacgagcacaaaagcagcaggcagctgccacaccagcagcagcggaggaggaggaggcggcggcaactgctatagcagcagcagtagcaagatggagcgcaaggatgtggagaagaatcggcgcctccacatgaagggtctctgcctcaagctctcctccctcatccccgccgccgctccccgccgccatcaccaccactactccacctcctcctcctcatcgccgccctcctccaccaaggtactactctctttttatccacaacatgcatcaatcatcctcttgtttcagatactcctccatatgtttgttagtaattgctgctgcaactgaaatattttttacatggatcgaccggaccatacattaataatagatccacacatatatagtggagtacagtactatatcacttgcaacctcctgcttactgaaatatgctatgtagtattctgcagccattttccttctctaactacaagcctagctagcctcttcattcattcagctcaaccccctccatcgatctggactggactagtaattattttcttctctaccaggagtatatatgctactcttaactcctggagtaccatagattcttgcttgtttgtaaccacgcatcttctttaattaaaatcacaaacactaccaaattaatgatcaaaatcaggttacgtaggagtaactgcgtgcacacaccattcatttactgcctttttaagctgcatatatataaacagaggcgtttacagatggccgcgaatgcgtgcgtgcgtgcgtgtaaaaaaagccaagcaaaaaaaagttaaaagagaaaagatttcaaaagggttggctgggtggctaaaccttttttgaattttgagggtcaccaatgttttgatacttacggagtggaaatgatatgagttgacatggtaattggtttttgtaggactaatactagtatttctgatagtggagtataacaattagtggagcagtatcttctttttctactagtagtaggattgagtatctatctgtgtttgtgtgagtcgtcgtgcactcgaacgacttgagctacagtttcaggcacgtgctggaatagaatatatattttgatatgactgattttgtttctcaaaaaaaaggcccctcactcacttagacagcgatgcgcttccaatggatggatctcgcatcctttttactagtactattttctttccttcctttctttgtttgtaagaaaatattttgtcaatggaagagtagtccagttgttttggctgtagccacgtgacggattggtagagcacaacactaaccgacgaacaacacaagctcaatataatcaattcacaattcacaaacagtgcagatcattgttctgctcaaactgaacccaccaataattcattcatccagtgacccacctaccactacctcaaatccatccaatccagtgcgttcaggtcacagcagcaatcactttcaagaaaggaattccttcctcagcatcccttgcagaaaaacaaacaaaagcaatgctactaatcatgccaaagttcctgtttccaatagttgaatactggtacaacgatgagcttgacacctcaccttacagtgttggatcaacaacaacaaaaaaaacgtggaaaaagtatgtagtagtagtagtagtaactgaattaaactgtggtggtggtgtactgaataattaaaatattactgatggatggtgcaggaggctgtgacgcagctggatcacctggagcaggcggcggcgtacatcaagcagctcaaggggaggatcgacgagctgaagaagaggaagcagcaggcggcggcactcaccaccagcaccagcaatggcggcggcggcgggatgccggtggtggaggtgcggtgccaggatgggacgctggacgtggtggtggtgagcgaggcgatcagggaggagagggagagggcggtgcggctgcacgaggtgatcggcgtgctggaggaagaaggcgcgaaggtggtgaacgccagcttctccgtcgtcggcgacaagatcttctacactctccactcccaggcgctctgctccaggatcggcctcgacgcctccagggtctcccacaggctgcgcaacctcctcctccaatattaattcacaccactctttcactctgctcagaatgagataatactctctactctactctactctgtactgtgatgataagaagtataaagagtagcagaccagagagcctctaggtagctaggttaattagtgagaaacaagagtttacactaagctaatggatggcatgagcgggagcaagctgttattactactaactcttggctaacgtttttgtatcccctagctagctgcctgccctacgtatatgtctccagtctatcatgtaggagtactccagtagtatactgtgtgtgagtgttctcttttgtgcctgaaattaatccagtccgatgtaagtacgtactagtatttggtttactgcatgctctctagcctcgcatcattatttttgagaggcaatgatgtgataatccttaaaatgggggcagtctcttcttaattctatacaccagcaaattcgccttgctctttcaaaaattataatgggggcgatccttggaaaaggaatcatggctttgagaaatatgcagaaagaagtaagccccaggaccagatatgatcctctgcatttagctacaagaaggatgtggattacaattgacacaagtacaatagcagaacttactactgcgtaggagtatttgctacttgtatgaaaaggtggaagcagaatttcagtatccgtgttggcgtgttgctatcagagaaacgaaggtggtatagtggctgttgtgcatgtgcctaactattgttcgtactactacgagtagagtatcagtatagtacttagtactggagtagtatctaagtactagaaagttggttaactgatagtgatgtttggaagaaatggagaaagaaaagaagatgatacagcaattcatgcacgtggctcaatgcatacaaacgtttgtgacggactaaatacaggaaatgagcctgaaaatgacaaggtcacattttagccgaagcagcttcatctttacttactctagtagtagtacagtagagagcaactcactccaatcatccagtgggtcgatcgggcagaggaagtagaaagcagagcagaggagaggagaggagaggaggaatttggtcgagctgagcctcaaattcctgagaaggtgtgagagatggagcctcagctttcgcggtgcccggagacggcaacagcacagccggagaaaggatcggagccgatcgaacggcgacggccacgttcccccctcccctggctggcctgaactagaactagtagtcctaaaactttggatttgcctggccatagaaagaaatgttctggtttatgtggaccctgtgcaccgctgagtgttagctacagggatatgatatcctggattacaagcaaaaaggatttgatgccgcggtagccagaatttcagtttcagtgttaccgtcggagagatgaaatgaaggcagtacagtgaagtgagtggctggtgtgagtgcttggcccgcgaaatgtaccattaggatgacataaaaccatactagtagtaacatgattcaaccctgcttgagagagtgatgtttggaagaaaaaataaaataaaatataatgtagaaaaactagtcgaggatgaaataattgatgatgcatgtgggtgaatgcgatttgtggattgaaggatggatgtaaacgtttgtgagcgatatatattggatgcagggaatgaacctgaaaatgacttgtaacatttgcctggcagccggcggcttgatctttactgaggacggaggaggaattacgttagctcgagagatagagagactactcctgcagggaagtgaggcgaggaggaagaacgaagcaattaagcaggaaggaaggagagagcaacagcgcatgtattgtatgcagccggagcgccgaggatgcggcggcgccggcattggggcaggagaaagaagaggtcgtccaacggcggagacggagacgattgattgggttcccgatgggccgtttctgacattcagcccacggcccaaaaaccaccctccatcgtgccgctcttcttcctgggccgaacgctctcccatctcttctcttaaaagaaagcccaccgttatttgtctgtccatcgagaggattttagttttttttttgttttctcggagaaaaatgtagaattttttgtttcagaacaaaatgcttgcgaaagaacgaaaattgaaggagaaaacgaaggactgagacaattgaaggagacgtccgatttgtagtttgcctgtactagtacggtatgtgtccaggcatttttgttttctattttaatttctgatgagacgctgattacgaaatgaccaagcagaactgaactgtgctataccatactatgtgctgcttcgcaacggaaaagctagtgggcgatcaatctcccctcctcctccacgtgatttccttttttggcaccatattactttcctattttagtaaatttatacatctaaagtttgtacatctcaagtttacacatctaaagtttatacacataaagtttagagacccaaagtttataagtcaaaagtttatatatatatagtatttctatacataaatttttctaactatttttttattttttaaaaaaattatggtgtcgtaggaagagaagaaggggagaaagaaggggggagaggagccgtatagggaggggatgggggtcgattagggctcccataggatggcctattcaaccaaagaaaaagccaaaatttgaattttcaaacttaattttgatattgattttgaggtatttttaacgtagtttatttttcaacattggcttttaaatcaccaagaacacatatataaaagttttacctataaatttatttttatcctctaataagccgttaaaaagccaaacgatgaggcactagctttacccgcttggcaaatccagctggagtagctccctgggacgtgacgtggcttgggttgatttactagagtagtatttttttttcttaaaacgaaatgcacaagaaaggcaggggaaaataaagaaaaggaagaaaaagagagagcggggaagcggcgcgggggtgggggcgagtcgaccgttggggtgcgtaacgttccaaagcccatcacaacacaagaaaaggaagcaaacggaccattggttgtgtttgctctggattccatcttcctcctcagctcctcctcctcacaaccagcttcttcctcctccacctcgcccaattctctcctccacggctccacctctgctcgatcggatcaagatcagaatcacgatcaggtatctcctcttgttcatcatcaagattccatccatccaataattcgcctctatttcatcatccccgccccacgccttcaatcgcagatcgatccgcccgccatgagcacgctatccgccggggtcctcctcaagctgctcgacggcatgaaggccggcgcagccaagcccgtcggggagcaccgcaccgcgctgctccaggtcaccgacatcgtccccgccgacctcgacgacaaggacctcctcccccgccatggcaagttctacgtcaaggtctccgactcctcccactccatctacgccaccctcccgctcccccaggccgatctcgtcctcagcaacaagctccagctcggccagttcgtccacctcgaccgcctcgacccgggctcccccgtccccgtcatcgtcggcgccaggccccttcccggccgccacccgctcgtcgtcggcacccccgacccggccacccgcgccaagcccgccgcgcccaggaggggctcctggggccctgagaaccatgccggaatcctcgcctcccccagggtcatcaagcccaccacgctcaacttcgaagacaggacgcccgtcaaggagagaccggccgcgccctcgccggcgcggagcaccgccttctccctcaggaagagcagcagcgtcctccccaggatcaccaggagcaagagcttcgtcgccgacagggctcctgaccaccccaagatccccaagagcccattccccgccgtccgtaaccttacctctatatactccctcttcaattcgattaga

SEQ ID NO: 70248 - DNA, 4618 bp, Oryza sativa
  unsure (1)..(4618): unsure at all n locations
ccttttcactttcgcagtcctccttggcgtcctgcaacatctgaccaagatcatccgcaacgtcgttaccatcagcatccatttcctcctcgcccgtttgatttccttcaaatccaacgtactgagcaaagtctggaatattgtcgtcttccacttcatcttcttccatttcaacaccttgctctccgtgggatgtccaacaattatagcttggcatgaaccccgactcaaacaagtggaaatgaatagttctgcatgcagaatactccttctgattcttacacttattacatggataacaaataaaacctctttgcctgttagcttcggccactctcaaaaaatagtgcacgccgtcaataaacactttggaccgccggtcagcgtacatccattgccgatccatctacatgagtcgaaaaaaaatcgtacaaaaataattattcttacaataatgacagtcatacaataattataagataattacaaactgtttcaacagtcatacaataatgacatatctttattcatacaaaaatcatgaaatattacaccaaataattcttatttactatttctaaagttttaaactaattttaatgtgttttacttcttttaattttcattttagttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaaacattggaggatgaagttgcaaaccttttaggcacctccgatttgtatgtaattaccaaaataaattcactagaaattttggcatcacctcccctcttttttgaagaaattttgaagcttgctcgggcagctggaggaggaagaagacataaatataggggtgggactttagtcccggttagtgttaccaatcggggctaaagatcccgggatctttagtcccggttggtaagttacgatctttagtcccggttggtaccaaccgggactaaagatcccggggggcctgacaggccctgacaacatttgaaccgggactaaagatgatctttagtcccggttaaaaagggtaacgcgcatatttaaagatcatctttagccccggtttttattgcatccgggactagtgtggagttcggccgaccgacaaaagatggtttctccaccagtgtgtgtaagggttcaacgatgtcgcctttttaaatactctctccgtcccataatataagggattttgagtttttgcttgcaccgtttgattactcgtcttattaaaaaaaatttggaattattatttattttttttgtcacttactttattatccaaagtactttaagaacaacttttcgtttttatatttgcacaaattttttaaataagacaagtggtcaaacaatgcaaacaaaaactcaaaatcccttttattatgggacggagagagaagtagtatatggaggatgctgaggaacgtccatttgaactatatgtcatccgaaattcatactctcttccgggacaaatatgtagtgatataattaattaagcgtttattagttagattgacatggttttcggtgttgaaattagaatcagtacggcacaactcgtttttttactaaacatgtaattaataaaattgctaattaagttaatagttagctaaaagttctaaatgtcatttttgtataacacatgtatatatgtatttcaattatctactgtggtagtatattataaagcggcatcaatgtattgtaatatcatagctaggaaacacattagctaggcatgcaagaaaaattctggtccagcaacagtgctaaaataaaaagcatagaaagggagttatcacctcccacccaaaatgaacgtacgacacccaagtaaaacaacaataagaaaataacaaataaacaaaaggtccagtaaaaaaaaacaaaaggattgatcttccttacatatctgttgcacccaaattgtctaatttgttatggaaaataagcataagcatagatatattttttagataatggaaatgggttacatctccggcttctgttataagacacacagccataagcatagatatataaataaggttcttaattatccatgtggcacgtaattgttaattaacgcctttgttcggtttgaaggggattaagggagaataattccacaccacaataggtgttgaataaattgggaaataagtaacaatattgatgtggcgctagagtcttgatcatatccatcatgtttcgaatccaagtgtcaaaataaataaggtcacatgcatccttgggtactgcatgtagggatggaaattatgcatgtgatctatatatgtacataaaattataattaagtaaagctaatgatgcgttcaatatggtttatattctagggttttgccttctcctctgtgctgcgtcgtcgctcgtagactactccattccgctcgcangcgtgcacctgcaatcgggagagcaggtctccggaacctctgccttctacgtcctgcaccgggagaaggcggcaataaggtttttggaaagtacttggtgcgactgctccctgttagtccgcaaaggatcgtattcctattcgctcgcgtgctgtgcgccgtcttcgacgtcccgcaaccggaagtagttcctgcagagcaactggtctttccgccacttcggtatgtgttcgacatgttgtgcatatttgatctgttcatgttttactgattagtttacatgtgtagatctaatgatgcgttcaatctagtttacatatgcaatgtcatgatttatttatgaaataaattaaatcattattttgttataatttcaacaatccaaaccttatataggcactgtgattttactatggctggttttgccgatgcactgaggccggataaattcaccggtgtgcacttcaagagatagcagatcagggtcactctgtggctgacagctatgaaatgcttctgggtgagtacaggcaagcctatgggcgttcttaatgttgatcagcagaaagaattcgatgaggccactactctctttgtgggatgcattcttagcgtgcttggcgatcgtctggtcaaggtgtatatgcatatgaccgacgctaaggagttgtgggatgcactgaatactaaattcggtgctacggatgctagcaatgatctgtatatcatggagcagtttcataactacaagatggctgacaaccgttctgtagtcgaacaggctcatgagatacaaaccatggttaaggaactcgaactccttaagtgtgtcttacccgacaaatttgtggtcgggtgcattattgcgaaactacctctatcttggagaggtttcggtactgcactcaaccacaagagacaggaatactctgttgaggggttgatagcgtctcttgatgttgaggagaaagctcgggaaaaagatgccgcgtctaaaggcgatggtggccagtccactgccaatgttgtgcacaaggccctgaacaagagcaaggggaaatacaaagctcaacagaccaccaacttcaagaagaagaacaacaacaacaattctaatcaggatgataggacttgctttgtgtgtggtcaacctggccatctggccaggaagtatccacaacgcaaggggatgaaggcacctgcagggcagacctctaagtctgctaatgtgaccattggcaacactggagatggaagcgggtatggtaatttacctactgttttttcagttaatcagtctactaattggtgggttgatactggggccaatgtacatgtttgtgctggcatctcattgttttcttcttatcaggtcgcacggggatccaccgtcctaatggggaatgggtcacatgcttctgttcatggtgttggcacggtagatctgaagtttacttcgggaaagatcgtgtagctgaagaatgtgcagcatatctcttctatcgacaggaatcttgttagtggctcctgtctgactagagacggatttaagttggttttagagtctaataaagtagttatgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtctcagctttccagcatgtgtttaattcctaagttttccattgtcaaaggttctaagtgccatagttgtgtgcaattgaagcaacctcgcaagcctcacaaggctgccgaggagagaaacttggcaccattagaactcctacattcagatctttgtgaaatgaatggggtgttgacgaagggtggaaaacgatatttcatgacgttgattgatgatgctactagattttgctatgtgaacttgttgaaaacgaaagacgaagctctagactattttaaaatttataaggcaga

SEQ ID NO: 70249 - DNA, 1355 bp, Oryza sativa
cgagtacatttacaacggagtatttttaagcctgattgagataacttcgttctgacggcccaagaagtctaggcatatgttcgctcgtcacagagggccggatctgtactagtgacaattagtttaagttagctgcattcaatattttatatgaggaagtaccattttattgagaacatcacaaagtgtcaaacagcaaaaatatgacctatttatacaagtgaacgaaatacagcttcgtcggaatattcataactatatataccgcatattcttctctctatctattattttcatgtgttctgttgctttgctataacgaagagtttcgtcctttgataaatcggagagggaaaaaatggataagtgttttcgaaaaagaaaaacagagaaatgttgcatcgccgtttgcaaaatgccaagtcaacagcagcatacagaattttgagtcaactgcaataaatgcatagccccatagtatcgcttatgctagccgaattttaaatttaaaacttaatttttttgattttgtagtttttttatcgaagtttattttacacatcggacactagaaacatgtatatacaagtcttacccataaatttcttttttgttgttaatatgcggttcggattaacatatgcataagcaaaataagtccactttgactctctctccaatctaattcgtatctctcaaccagaatactaatatcttagccctagctattcaaaccggtgcaatttaactgctaagacagtacaacccctgtccggcatcgatggttaccaccgccgcccgccgcctcaggccactgccaccgctccttcctcaccactgctgatgggggagaaggtaggaagagagacagagaggaagtgagtatgacaagtgggccacagtatttttttctctctagtcacttacatttggcccacttctacgttgtgactggagctgctacgtcagcaagggttgaacaaggtaacaagccacgtcagaaaaaaactgctctcaaaaccgttgaggaagtcaaattacaatatatctggtgttgcagttaaggggtaagattggagcagtacgtgagggagttaaagtggacttacacctaaacggaaaaatggggccgtgcctctatgacatcggttttgataattagcgcgtacgcgcgacttctctaagtcacgcacgtaccacgtggcaggccctcgtcaccgtgtggatctgagtcccatgagcttttcttttttttccagaattttctttccggagacgcgttcatctaaactaactaatccggttagtgttagataatgacgataattaaggtaagatttatgttttttttgaag

SEQ ID NO: 70250 - DNA, 587 bp, Oryza sativa
tatgaattgggggcttctattgtacatattgagttgaatcaacagagtgattgttttagatggaactatcatcagaatggccaattttctgtccggtcaatgtatctggctttaataaacaatggttatattgagagaaataagattatttggaagtctaagatgcctctgaagattaagatctttgtgtggtacttgcttaaaggggtagtattaactaaagataatttggcaaggaggaactggaatggaagtttgaaatgttgtttctgtatgaagaatgaaactattcaacatctttttatggaatgccattttgcaaagtttatttggagagctgtatagttctcttttggtctttaccctcctaattgcatatctcatatttttgatgattggctctgggggtggacaagaaaaataggaaacttattctcataggagcttctgttatatgttgcgctctatggttgagtaggaatgatatgatttttgataaatcaccatctgtttcatatatgcatgttaatttccagggcacgcactgacttaagtcttggtcactgctacacaagtgtggatgttgg

SEQ ID NO: 70251 - DNA, 547 bp, Oryza sativa
cagagggagtggcaaaatggcattgtttgctagtagaacaaaactctgaaggcagcatttgctgtcacttctcattgctccttgcatcccctcagctctgcatgtctcacagttgcaataattcaagggcagcaaaagggtacaaggaagggaccaagctttggttcttcatcctccctaatcttttgtgcatcactgtgtgtcctccttttcggaagcacctctctgttgcaattgaaggctttttctttatcatcatccaggcccatcctctctctctctctcagcctcagaagtgagtgagctctctgttcccgctgacactggacactgctggccctgggcagcagctcagcatgctcctcctgcaaacattatcagtggtgttgggcttttacgacacctgttgctaatctgcattttgcacgagttgtgccgcttacaaggctccaattacaaaatcatgtcaattttattaggaactataatggtatccatttgattgattgagtccacatatcaatcataaaaagagggcaaaggtaca

SEQ ID NO: 70252 - DNA, 16881 bp, Oryza sativa
  unsure (1)..(16881): unsure at all n locations
cgcgcgccagataagatacggctgcgtcagcaacaccncatcatccggtgcccgggaagctcaatctcctggggaaggcaagtccctcaactcaatttccatcctgaattcgcagcgtcctgatgcagtcgtctgattgggttgctgatttcacttcgttccttgattcaggaagccatggagcagagggagcaagctcagaaggccgccctcgaggcgctgcgcaacgcctccgccacggacaacgtagtcaggatctacaagtacgatcctttctttctcttttccttctctatctgatggcaatggtgaatgtggcgattctcgcttccaagcaaattcgattgaggtgctagttgctgtattacttatcattgagtgatcgattctatgttggtcaaccggaccaggatgttcgctgaattgagcaagacggcgaggcccgacgcaccggccacctgcttcgagagcttcctcagcttccaccaggaggccgtgcaggccgtgaccgacatcgagtcgatccaggcggccacctcgatggccggcgccgtggcagccgatgagccgccggtcttgcaggagattgcgcagaacaggtcgtcgttgtccaagaggagaggagccctgggcgtgtccaagtcggtgtcgttcgcgccgggcacgctggatgacggcggcggcaagaaccggagctccaacgccagcagaaagtgccttgtactagacaagatcggagaagacggcgacgagaagcgatcttcttctggtagtactaccaccggtgctctcgggtcgtcgttgaggctggcgaagcagatgcaatgtgaggcgtcgagctggtttatggacttcgtggaggctgcgctggagactggcctgaagaagaagagcaaggcgtcggcgacggcggatgggcggaagcagagtagctgctgctgcccgcagtcgctgatactgagggtgatcaactgggtagagatggagcagagtggcgatggcagcagcaggaagcccagtcacccgagagcggctgccattgccaggaagcttaggataaaggccaagaacccttaattcctgctagtttattcttttgcttgttgtaggcattgagaaggttatctgtagaatctgtagatcaaggaaaggaagttccaggatagagatgcggattcttttgcttcatggtatatgaagctgttctgccctcctccctgtgacataaattgacatccatactatacagtagtcaatcagccacagaaggaagaaaacacctctgcttgagcaagtgctacgctctagtttgagtacaagtagtaccatccgttattattcattttaacttgttttttttatcattgtcttatcttgtgttttgcatgatgggggtaagacaaccatttgcttgactaattcaacctgctttcgcggtgatagaaattgttctgatcacgtggcatgaatgctttgctatacatgaaagtttgaaatttctgttttatctgatgaatggactgttgtgttgatgtggtcctgtgcaaacttgtatatatccgatgaataaggagattcagatgtagtaaaagtaccatgtaggaggagaggacaggaggattgctgctgcatttgcaatcgagccattcagctagttggtttggaacttgaaatccagccacttcacggcagatgttgtaaatgtaatgcgctaaagcttcagcaatccagatgaatgtttagttcacactgaagtttggaagtttggttgaaattggtacgatgtgatggaaaagttgtgtgtgtatgaaagttttgatgtaatggaaagttagaagtttggaaaaaaaactttggaactaaacagggccgaaattgacttgttgatactagaattttaaggccgtcagaaccttctctggcctgcaaaacataatgtgcaagatgaatgaaggaacccagaagcatatgatgacaaagtcaaaaggtatccatccagctttacatgttaagcatattggatatgctttggatcggtttggcacaaagtggaactacaaattgaaatgagattggatcataccttgatctcctgaagttcccatctctctgtctatgttcttctttcttctcttctaatttggaagcacagagagaatcatgtcttggttcttccctgtgtttcagtgggtttttcttgatcgggtagcaagagaaaacttagggtttaacacttaggtattgatctctatttatagccattgcacacagggggaaccgacactagggtatggcggtaatcccccgatcagggatgttcatgagagatcgatcactgtagcgatcgccctaaacaaaatatctctttgccgactttaggtttagctgcaagatcatattttgcgttcacactaacattctcccccttgatcgtgaggctaaacttataagtccatttctcaataaaatagtataccaagacaaaagattacagtgaccaatataaagcatcacagaatccagtgactatagcataccattatattttaaaataaacttctttaatcttacgagctctttgaacttattacattaggcttatacaaacttatggactcacttttcaacaaaacagtatatcaagacactagattacagtagtcaaaatgcatgccggcaagtatatcaagcaccactgaaccaagtgactatggttcctatttaatttcaaaatgagtccgtcttattttttatggggagtcagtgccatataggttccttcttattccaggatcgaaggcttttctaccaaacgcatgccggcaacatgttctttaaatacaacgggtggtaggccttttgtgagtggatccgctaacatcaacttagtgttcatatactcaacgcttattgtctgatcctggatcatttctttcacaacatggtacttgatatcaatgtacttggcagaagcacttgatttgttgctactcgaatagtatactgctggtttgttatcacagtataatttgagtggtttcgatatactgtcgaccactctcaatcccgggataaagtttttcagtcatattgcctgcccagtagctttataacatgccacatactcagcctgcattgtcgacgatgcagtaactttttgtttggagcttttccacgatatagctccccctgcaagggtgaatatgtaacctgacgtggatttcttatcatcaatacaccctgcaagatcagagtccgaataaccgacaacttcaaggttttcagactttctatatgtgagcatgaggtctttagtgccttgaagatacaaggtcttcttagctaatttccagtgttgtagacctggattagattgatatctgccaagcatcccggtaacaaaagctaagtcagggcgagtgcatacttgtgcatacattatgcttctgacaactgaagcatatggtattgacttcatctgcgcaacttcatactcattcttaggacattggaattttccatacttatcacccttcattataggagcaggcgaggctgaacaattatgcatattatacttcttcagtatatgctttctgagatagccccaaaacaccatttgatctgtctcggtaaatctctatacccaacacataagtggcttcaccgagatctttcatttcaaacttagaggccataaatttctttgtttccagtagcatatttttgtcattattggctaagagtatgtcatcgacatataatattaggaagatgaacttactctccttaaacttagcgtatatacagtcatcctttttattctccttaaaaccaaattgtcttatgatttggtcaaactttagataccactgccttgatgcttgctttagtccataaatcgatttctttagatgacaacccatatgttcttttcctttcataacaaaaccttctggttgtgccatgtatacatcttcgtacaaatcaccgttcaggaatgccgtcttaacatccatttggtgtaattccaaatcataatgggcaactagtgccataataattctaaacgaatccttagtagagactggagaaagtgtttcattataatcaatcccttctctttgcgtaaatccttttgctacaagccttgctttgaacctttcgatatttcccttgaggtcacgtttagtcttatagacccatttgcagccaactgttttggctccttcgggaatttctactaagtcccagaccttattagtactcatggacttcattttgtctttcatagcttttagccattcagacgaatgttcactcttcattgcttctttaaatgagatgggatcattatctagtataggctcattcacctcttcactcataggttcattcacctcttcattcatgtaagtgacatagtcacttggaatcgctgactttctaactcgtcgtgatcttctgacgggttcgttatttttctcatctatcacaacatggggctgctgagcattctcattattctcatcatttgatacactactagaagtagttgcaggagcttcagcaggtgttgcatcattatttctttctattaaaggtgcaacatgagtatgtgttgagaaaacgggttcttcaattataggcattggaacataattccgtttctcttccagaacaacttctctgggtgtcatactccccttgattatgtcattttccaagaacacagcgtgtcttgtctcaataaactttgtaaactgatttcggcagtagaatctatatgccttcgacttatcaggataaccgataaaatgacaactgattgttttgaggtctaattttcccatgtttggattaaaaaatcgtgcttcagcaggacaaccccacacatgaaaatagttcagggttggtttcttcccagtccataactcaaaaggtgtcttaggaactgatttactgggaaccctgttaagaatgtgtgcagctgtcttaagagcttccatccataactttaccggcagaggggagtgacttaacatacttcgtaccatatacataagagtgcgattatgcctttcagctactccattttgctggggttcacccggtgctgagtactgggccttaatgccattttcttgtaagaacctcgcaaaaggtccaggaatttgaccataagtagtatgtctaccatagtattcaccaccatggtcagaccttacaattttgatctttcgatcatgttgattctcaacttctgctttgaaaattttaaatttgtctaatgcctcagatctttctttgattggatagatatatccatagcgagagtagtcgtcggtaaatgttatgaataaatcaaatccatccactgactttacattaaatggaccacagatgtttgtgtggatgatttccaaaactcccatacttcgatttgcacctttcttgatttgcttggaatattttcctttgatgcaatcaatgcagtgatcaacatctgcatctgagaagtccaaaggacagaggatgttttctttaatgagacgctcaattctccccctcgaaatatggcccaaacgatagtgccataatttcgaagaagtctcattatcgttatgttttcgtttggtactgacatttgcatttgaggagtcaacattataggtggcatcgcacacagaaatttgataaagttgttcctgtccaacggcgagaccaacctctttattatcatgcataattatacatctattgtttccaaaagtacaatagtaaccaccgttatctaaacgtgaaactgaaactaagttccttttcatagagggtacataaaggacgtcatgcagttgaagtttaaagccagtatgaagtgtgagagtgaagtctccaatggccttaacttcagtttcaactccattagcatctctaattcttctttcccctcttcttagggtcctcctcatagcgaatccctacaaggaatttgcaacatgaattgtcgctcctgagtcaatccaccaagaattggtggcataatcaatattcagggattcatcaacaaaagaaataacatcagtacctttcttactaagccatctcataaacccaatacattccttttgccggtgtccactctttccacaaaactagcacccatccttttcttttcccttttcttctgtatagggatttcctccagatttattctgctgggattgatttgaacattgccccttttctttaaattaactaggcttaggcttcaaatactccttaaatttcttatacttttttcttctcagagtgtttaaatagatttgcatggtcaactctttctgccttaagcctttcctcttcttgtacacacatggctattaattcatcaatgccccacttgatcttcattgcattataattgatcgtaaatggagaaaactcctggggcagagatgacataatgaaatggacaagaaaaccttcagagatttccatttccattgatttaagcttagaagccctgtgacatttcttcataatatgttccctcagatttccagtaaaatcatatctttcattgaccaatcttttaataagagtggtggcataaaccttagaagagcctttaaattgttcttcaactttagcaagatattctctggttgtctgagtatctgggactgctcctcttattgcgtcaataatggagctcttgataatcataaggcatttacggtttgaaatatcccattttgcctttacttcatcatatttcctttttagggtctcataattctcattttccggtctaggctcaaccggaggatcattatggagggcataatcaatatccaacagagctagagtaatttccagcttctccttccatgaagcataattacttccattaagttgttcaatattgcccattattccggcaatttgtgaggcataagatgctgcataggagagaatcagcagctaaataagtaccttcttttattgatcaaattcaaaacggctttggccagagaaggaaatgaacaataaaattttgtgaataagtatttattaatcagctttggccagaataataaatacaaaccacactttatcaatttgtttaaaactccttttattaattcaatcaaaacagctttggccagatttgaattgaattaataaaattttgtgatcaaataaaagtcaatcagctttggccagaatgacaattatttgtcacacttaattataatatttatttgtagcggaaataaactcataatacataaaacaataataactttaagtaataaacataatgtaataatcataaaataaataaataaatgaaagagaattttatcacataacaaagtcacttattattcttattatcattaactaaaacataataaaatttcttcaatgtttaaacacaaaaaaatcataatcataattcttcaaaaaggaaaattttaattgtaatattatatcagcccaattcttttaattaggcccattactatgcagcccgttactatgcagcccacacattttttttaatcttgaactgggccgctttctcgagccaggccgaatgcggcctggcccgttattgccgcgccgccttccgcctgggctccaggcccatcaacctgggcctgggccggcgtttgccgcctcccgcacggcctcatcagcccgcgtcgggagcgagccgatccgagccgtccatctcatcggacggccgggatcgctcccgcgcgggacaaaaccgccccccccccccggcgaaaccctagccccattctttccccttctctttctctcacacccgcggcgacaatgagatggcggcgagccagcgcacgacgggtcggagatagcgtcgtcgagctttgcttgccggggctgcgtaccgccatatctggcgcgcatccccatcgagcaacgctcgacggtgccctaagcacccgtcggtcgctcgcgcaaggaaaatccgcggcggcgacggctacctcagcaaggcggcgacggcgagacgaggctggcgacgagcacgtgaggaggaggagccgggccagcacggcgggtcgcgaggccgctcggggaccaagtcctcagccgcgcgctcgcctcttacagcgttggtggcgacgcggtgttcgccgccggccaccatggcccttaggtaagcccgccgtgctcctttttccccttgattttagggttagggtttcatgatttggggaaattttggggtcttactgtagctagggtttcggttcttggggaattatctgagatttgcatgaattttgccttccccttcttctaatctcttcaagccgaaaccctagtcggcctaatttcatttcttacacctcgggattgcatgattttgggcttaactgaactttaacagagggatttgggcatgaacacgaagaacaacttgaacataaacacttattgagttccaatttgaggccaacccggtgctctgataccattgttggatatgctttggatcggtttggcacaaagtggaactacaaattgaaatgggattggatcatgccttgatctcttggagttcccatctctctgtctttgttcttctttcttctcttctaatttgaagcacagagagaatcgtgtcttggttcttccctgtgtttcagtgggtttttcttgatcgggtagcaagagaaaacttagggtttaacacttaggtattgatctctatttatagccactgcacacatggggaactgacactagggtatggcggtaatcccccgatcagggatgttcatgagagatcgatcactgtagcgatcgccctaaacaaaatatctctttgccgactttaggtttagccgcaagatcatattttgcgttcacactaacaaagcatacagggaacgtatcataaactatgaaactatgcataaaaagtttcaagcaattaccttcgcactacaacaaaaacattatataaaggcactttatataaaactctaagatcaggagttttatagcgtagagacactttatagaggcactttcaaaattttctagaaaatttttactctagagactctttagaaatatttttagcacattttattagattttatcttgtagaggcattctttcggcactttaaaatgtgtctaacatgtaaagacatttgcttgagacactttaaactctgtagagacacttcttacaataaaaatatactaaatggctaaatataagtaacttaaggcataaacatatacaatgaatgacatggggttgagttggttagtgccttgaagataagaatgatttgttcaaagaagataagaatgatttgttcaagagatcatgagttcaaggattggcaaaaacaagggaaaatattttattctcatttttacattggtttcgtatggttgtggtacaatttaatgtctctagaaaatgtctctaccaccttatagacattttataaaatgcctcttcgtttgtagagacaattcaccataaggcacttattagacttttttaaaatgcctctatagtattgtaaaggcatttgaaaagtgtctctgtagtcctagaaaaatatctctataaagtatttttcttgtagtgtcggtaagcaatattttactggatatgagttcagctaatcaaaggtttcaagcaattaccagtcccaggtccttcatttggctccaattttatactccttctatatgagtagctgcagcattacttttctggaactccttaagctgtgtttagagcgctaactacttaccagaaattctccacgcaagcaatactgagaaatcttcccagctgcatcctgcgggggatagggacaccaaagaaaagattcagcaccgaaacacatttgtgacgattcatttaccagagtaattttgattgcttgtattcagatttatttgtttacactgacaagtgattttgtagcttagtactagtagtaagtagtattgacttggcagatatactcttcacgaaccaagtactagcattagaacgtacgggggatataggacgtgggtgcttgtttaagaatgagaagtacaacaggaaagctatcagacagttactaataggtgttcgacagtattgatatgatacagtcgatatgaacaaaactgaaattcctataaatgagatgcaatactcatctctcgactattgtaatccttgcactcccaaggttgaaggttctaatttggaagatacagaattcagtaacaactggagtactcctatatatactgcatagagaaattaaaatgagtggcagatgtggaagcaggacggctggacggttttgtgtagttggttcgccgccgcccgccgagcaccaacagagacaagatcatcgccgagatttgctttacctcttgttcatcatcgtggtttcattttgctgtgtactgaatcgaggattgcggcgatcacgagaggagggaaccacggagggtaggattggagaggagtggggccgcgaaggaggcgtgccggcgaaagaagcggcggctgtggccggcgacagtgaggtggcgtttacgggacgggaggggaggggcgtgacgcgaggcagcagaatagacgcacgtctttcatctaacggctgagatctccctcacccgacatcaccagttttgcaaaaggaaaaagtaccccgaagatcccttaacttgtcatcgaattacaaaatcgtcctccaaccacaaaactggatacaacgcatcctccaacttacaaaaccagtgcaaattagatccatcggtggttttgactacggttttgtccgacgtgacggctgactcagcgtggaacccacatgtcaggatgccacgtcagcaccctctctcttccatttcctctccatccctcctctctctctctctctcacttttctccttctctgcaactgcaagcggcaagccgcccggcgggtggggagaggtcgtcggggcgaggcgggagaggaggaggcagcgggcgacgaggcggcgatggcggaagctgcgacgctggagggcaagccgcgccgacgctggagagcgaggacgatggtgacgcgttgccgccgtcgtccatccgcggatccccttgggtgtgccgtcgatgtgagccactgctgctgccaccataggctgacggccttgtctccggtcatcccagcgtgttcatcaccgcgtccttggcgccgaccaccgtgctcttcacctgctcactcgcctgaaacacaaacgaattctcctcaaaatccacaacaatggtgttcgacaaggagaaattaaccgaggttgctaatggtgtgtacttgttggaggacgctaccggtcttgtccttgccagcgacggcggattccttggtgtactacgccgtctcggtggtcttctgcttggcggcgccggcggaggaggatgaaatcctgatgcagcacacgcgcttctgatccatctgcgtcaagtggctcaagcgggacgcgaacctacagatgcacatgcgtagacacagtgacaagtacaagagcgtgcccatgctgacaaagccgccggcggcggtggtaaggacaagcagcagctggagcggcggtactcgtgcacgttcactgggtgcaagcgcaacaggctgcacgcaaacttccagccactgaactactgattactgaagacgatcttgtgcattgtttcatcatccttcagtaaaaaaggttgtgttcaaaaattgatttgataaacaaaaacgatgattagaatataacaaaaggcagccggcatggaaattgggacaggtgcagggagccgatgcagaaccctccaccgcgccgtctcgtcggtctcggtggccttctgcttggccttctcggtcttctcgccgaggaagccgctagtctggtccttgctctcggcggccttgtccctcgccgcctacgccgtgccggaggtcttgtccttcgccgcatgtgccgtcacaccgccgccgacttcctccggagagcccacctaaggcagctcactgcgttcctccgccggcggcggcgtggggggaggccctcctgctcccgcgtcgtcgccgccgccgcctcgtcgcccgtcgccgaccgccggagtcccgtctcccgcctcccccaccggtctcctccccacacccgtcggttgccctgctcggtgagagaaaggaagaggagagaggtggagaggggaggggaagaagaggctgaaatgtgggacccatgtggcccccacgctgagtcagctgccacgtcggataaaaccagagtaaaaactgccaagggatctagtttataatagttttgtaagttagaggatgcgttctccggttttgtggttggaggacgattttgtaatttgatgacaagttaagggaccttaggtatactttttcctttgcaaaatgccccctcgttcggattttgctgctgcattcgcaaacctagcagtgtcttatgtttttgggctgaggcccagattggtttaggaagccggaaaaggaggagcaagccgtcaatcagttagatgatggatcatagtgggctgaaagaaaatatgtatagcccgtttcggcctaaagcgaaatgcaagccagctcagactgagctcgctctcaccaccactgcaccacaacaactcctggccatacacgtggacgtggaatagaagaagaagaagagaatattccctgggcattgggcgatgaccgacgagtgggcccgcctgacacgtgtaagagcaagtttaatagtatagcccactactagctccgaataatctatacccgatgtaatagccaattcatacaatagttgcttactatactattaatatctggtcctacctgttatacatacattacgtcttggagtccgtgctgcagctggctatagatctgtaacccgctgctcttatctctctttctttgtttttttaaaatatgtttatagctagcttatagtcttttattgtacttgctctaagcaaggctgagaagccaagcaaacaaaacgaaaagcaaccgtcaagtggaaataaccagcggattaattactaccactaccacaaataattcattaattcattcatccatttattcatttaaaacaacaagcactaagaagcagaaagaaggaagaatccatgttgcattttatcctactggtaccgtttcttttctatggatggaacattttattctagcatttgcttgctttgcctaacgtactctcctccttaattatccattcaatcaaaacaagcaggactactagaaagcaagaggagaaaaagaagaaggaagaatccgtgttgcattttatcatactgtttcttttctatggatagaacattttattcgctagtattgcttgcctaaattaaatcgcgcacaagaaacgtaaactcgtccataccttaattaattattatccaagcgcaaacatgaaacatccctcccgcattaaattggcatctcctaataaatctcacggacttccatatctactcccggtttctgctggattccttcctttttctcatcgcctcgcctgcctcttggccttccccatccccatctctcatcagccgcaaactgctgcaaaccccactagcgctcgcccccaccgtaatctcgcgcgattctcggaggaggagatgggcgagtactgcggcgctgctccggaggaggaccctgccatggccctcgtcacgccgctccccaccaccaccaccaccaccaccacggcggcggcggcggccatcaagcaaccccactactacggctgcttcgaccgctgctccaccaagcaggtcttcgacaacctccacggcaacatctcgctcgacccggttcgttcgttactcctacccctaccatcccattctgcgggattcgttcctcttccccaaccctccgtctcgccctatctcatcacgctggatattgcttctactgttcatttgcttgcttcagattgtttggttactagtagtaacttggggctagtttttgtctcccttttcgatcggttactgcttccatactcggatgatgatgtttttgtcccttcgtgatgattcattgtgccatgcttggatggatggatgctgctgcgatttcttccgattgtcctcgctgtctctatgtgctccattcctccatagattgaacagattgcatcctcaccacgtgtatttccacttaattcatgtgcttctagtagccttgcatgtgcatgcactttctcctttcccttttcttttcaggtttatttattttcgcttcatcatctatatgtgttgctgttggtgtagcgcgtcaacattagtttactaggagacgcatgcgcatttttttccttcatattttaaatggaggggcaatagctgtttatgctccttcctctcttccttccttcttagacctttgctgactagaatattttacgtccacattcacagcgacatgaggtattatggaggtagtaataaattatctgcttgtttattactccttcgttgacgcttgggtccttttagatatgactgctttcaattaacggggtcttattgttaattgttgacattctaaagggtttttggtcttcactcttcagattaaacgggctaggctacctgaacaaaattgttcagttttttttcagatatattttgggtgggttggcagttttaccttgtgtacgccactactgatgtgtctgaaacacgtgctctccttgtcatgtggtggtagaacaaccaatggtgcgaatggaaagtttattatatatagcagttgttctcacgtgttggatgatcatcatgtttacattcagttcccatttagtttccgccatgtagtgtcgcatgttgtatctactagtatatgatgacattagcactgaaaccttttgatgattctaaacattagcactaaaaccttttgatgattctaactcaatgtattgttgattcccacttttaccttttcctgcctgcatccgtttcaacttggaagtacaaatgtttcagttctactgtgtattttcttcaggttgttaccctgtatttaagtctaaatcatacatgcattcagggtttgaagtaatggcatgctgaatcatatacatgtgaataatcatttacttgttcagtggtgaacaattagcccgctctcattttccgttttggatgcttatgctacaatgacactttatcatactgagtgctgttttcacaccgacatatcgtttctcttattagtgttatttatctatttaatttggccattgagtcattaaagctttaagcaacttctgttcctcccacttttccttctcagtaacaccgataactttctctgatgtgcagttggctcgtgagtttgtggatacgaaggagtttcagaggtgactttgattaacccaaattatcgttgatcgtttgtttattcaacttattcatcctctttatggcttcatttgattgcattgtgtcattcaggctgcgggatctaaaacaacttggtgagttattttatcatcattgcagaaatcatttttagcctaatgtattcaatatagatgaaagtgtcaaaatctaaattgaatttcaaaccttataattgtaatttgttgctttttgggtttagaaaaattaaggctacacaatggggtcttgtcctggaaacattttatcccctttactcttttttttcgataatggaagctttattaaaactcagtcaaatacaccaaggtgatacatttcaactgagcacactcctggcctctgcaaaagatgcacacatccacacacaaagaaagacctatctagacccccttcacgaaacagagatattagtggctatcaatccgtacactagatcgccaaccatgctcctgggtaaaaaaactcccgtgacacctagtccaaacgtcgcgataccaccacaatagtatcccgaaggcccggttctttttatcccctttactctatctgcacagagttatttttaatcaaatttactgttaaccacatatcctttcactgttgtggataattttatttggagtaaagtccataaccggttgctaaacttgtaccgctgtgtcatcccagtccctaaactcgcaaatcgaccgttcaggtcctcaaacttgtttgactgtgtcatcccggtccctaaacttgcagatcactcgtttaggtcctccaacttgttcagttgtatcaccccggtccctaaacaggacggtctaaaaactttatatcaaaaagtaattcataactttttcatgtgaactctgaggaatccagacaaaatattcaattgtttgctgtggtcaccaactaaacacaaacatgcatatatttgctaaagaaattatgcacccattccaaaaagtttaaatacgccggttagaccaagttgattaagaagttgaaaagacaaagtacaaaaccttggttgggccaagtaacatgtgcttaaaactctcatttacctgtggaaaaaattatcagagttcctataattcactttgattaaatgacaaacaaaccttctgtgttcttcaatcagatttcagagggaaaaatattactgggataggatagaatctctgcttgcttgctttaatacaaacaggggttgatctcactagagatataatatcggcgcaagtgccccaattggcaaggaccggttgaaattgatacttatgacgattgccatttattgtgtaataaaaacttcccaaaccggttggtctgagttattaattccctcagacatagtcgtatttt

SEQ ID NO: 70253 - DNA, 668 bp, Oryza sativa
  unsure (1)..(668): unsure at all n locations
tggtttggggtccggctatgtcggcgacgataccaaacagaagcattatccgtatccgtaccaaacaccaacactgcgaattatatatatatatatatatatatatatatatatatatatatatagatatatcttcctctacatctacacgacgtacacttggatactgcaggtagattagattagatgatcggccggccatggccaccttccgggaccacctcgccgtcatcgccgaggcgctctgcgcgatcgccgccgacatgaatgcggncgcccgcgccctcgacccctccaccgtcatcagactcgtctgcgccgccttcaccgtcgccatagtgctcgtctgctacgccgacatntggggncgcctcgacacgctacactcgcagacgcagacgccggcgggggaggacgaggacaataatgccacgccggcggaggctcctgctgcttctttccttaaaggaccgcaagcgctccagcaatggcaccgacacctctttcttctcggagtcgtcgtcgtcgtcttcgttttcatcaaccgagttctcgttcttcgtcttcgtcttcatcatccgagtcctccttcctcgtcgtcggatgatgacctagcgcggcgacgtcagcagagaaaccctttctcctccgcggagtacaagaggaag

SEQ ID NO: 70254 - DNA, 7476 bp, Oryza sativa
  unsure (1)..(7476): unsure at all n locations
cgggtttaatacaacacgaagagggaaattgcccccccgaaaaataaccccggtggcccagaaaggttgccagcagacagcgcctcaaacaggtattacagccaagtctcgaattacaacagtaaagggacccaaaatatgtgcacatgccttataaaaaatggaccctaaatctaaacatgacaatgtggcaccaaaaatcccttaaattaaaaaaaaataactaccaagttttatatagcgtcgagggctacaaattagaaataaagtttgtcttcattagagttcacatgaaaaagttatgaattattctgaaaaagttatgaattatttttaaatataaagtctttagaccgtcctatttgatccagatgatattcaaatccaagtttagagactggggtgacacaactgaacaagttggaggacctaaacgagtgatctgcaagtttagggaccgggatgacacaattgaacaagtttgaggacctgaacggtcgatttgcgaatttagggaccgcaatgacacagcggtacaagtttagggaccggtgatggactttactcttttatttgtctaaatgggctcatgcttataattagtgctaacctgtcccatggctactgaattttggttagtttgctgttatcatttgtgcaatagcacttactattatggctaactgaatgttctaatgtttagttctcaaagtaacataatgtgagcccttctctatgtttatatctactttttttttaatttatcatagtttataatcgatatttgtggtaacatgctctgtgtacctttcaggccttacatatctggtctacccaggagccgttcacacacgttttgagcattcattaggtgtctattggctagctggggaggctatgaacaatcttcgactgtaccaggttcttacctttgataaaaaagtccaccgatatatttccatgtagcagtttaattattttgtatgaaactaagttttgtttttcttttgacagggagaagagcttggcattgaccgtgttgatatgcaaactgtaaaacttgcaggtctgtttactgaatcataactctgccaaggtttccatattgacaatccttgtgttattctgtttaggccttttgcatgacattggacatggccccttcagtcatttgtttgaacatgagtttcttcctcgtgttgttcctggatcaacctggtgattttcctttcatatatgtggttatgttgtttctaatttgttagttgttttacatatattttccatgtccttagtatgagaagattcaaaatttaaagcaatacatatttatgtcatggcggattacaccacttaaaagactctggtcctatgattattatactagcattacaacttctattttcttcctatccaaactatgaattttagtgtgtatctatgtggatatgatgacatagggtgataatttctcatatttcttcacttccacatgcacgttagcctgttgaaacattgtgagactgcagttggtttcttaattaaactggtccattttgtctattcaggacccatgaaaatatgtctgcactgttgctggacagcattgtcgacaaacaccaaatagacattgaagctgatcatctcaaaattgttatggtaatccacgtttttattcagttattgtggcatttatcaattgccatcagattaacccatctccttctgtcactaagaagaatggctcttagaacctcttatttaatgttttaaaatctatgaatttgacctttccactcttttttcttgtcagccttaagtattcacttcaaaatgtgtgctgttctaagttgacaaagtgtaaccctacatcttgacaagcctctctctctcttttttttttttgcaggaaatgattgttgccagctctaagttcactgcaacagaagtatgtaccttagtctgtattactgccttagttatctgtcagttgaaaatagatgtactaaaattcgatgcaatgaaacttgtttcttcacagagcacaaaggagaagcgctttctttatgacattgttgctaatggtcggaatggtatcgatgttgacaagtatggtccttctatacttctaacttctgatattttctgcattgacatttgtttttcaatcatttggatatgccataagatagagtaaccatgcaggtttgactacattggccgtgattgcagagcatgtggtctgggttgtaatttccagtactggaggtaccttttgttatcatgttttaagtttttttttactaaaccaatctgttaaatttgagagtaggaatacaagaattaaccaagtgttttacatcatattataggaaaataagacatgactgaggaaataataaatcagacaaactgtctgtaaagttttatttacaataaatgctaatgtgatagtcgtcaattcaacggtacttgccaattggcgcaccttggccgatattaaactctagtgagatcaaccctgcttgtattaaaacagacaagaaagattctatactattacagttatatttttccctctgatatctgattgaagaacacagaaagtttgtctgtcatttaatcaaagtgaaatataggtactctgataattttttccacaggtaaatgagagttttaagcacatgttagctggctcagacaaggctttgtactttgtcttttcatactctttatcaacttggtctaatcggcgtattttaaccttttggaatggttgcataatttcctttgcaaaaatatgcatgtttgtgatttgttgctgaccgcagcaaattactgcatattttgtcttgataacccatttgatatattttgacatgtactggcacagttactaacttgctatcatgctgttgtggttcttacctttttgcactgcaggctcttacaaggcatgcgagtcatgggtgatgaaatatgctaccctgccaaagattgtaggtctattattatcttctttttttgtgctatttgttccttttctttttgatatcatgtgacacttgacttgttaacttttcattttgaactacagatttgagcatccataaattgtttacgacacgtgctgatcttcaccgcactgtctatacacatgcgaaagtcaaggtaaggataattatattatgctggccacttttgtgcagcaaagaaccacactgtcctgtccattgccttctaatatattgttatgtaccttaggctgttgaactgatgcttgtggatgcacttgttgaggctaacgaatacttgggaatagctttgcatgcacaagatccagcggacttctggaaggtttggtatcattgcaatttttattatgtatgtagttttattagttgccttcttacttcaaacatctctggaaatttcagttagatgacacgatcattaaaagcattgaaactgctcccaacgatgaactgaacaaagcaaaagggatcattcaacgtattcgccgaagagagctctataaggtagtactactttcggtcatgaatttactatgttcttttatcatatcattttacatgtttatcagagctattgtggcttaaaatatgtgtctgacatcttgtacttggatagctaaatcttccttttgtggtagtatgaaacaactttgttttctttcaacttgcagttctgcaatgaatattctgttccaaaggacaagctggagcactttaagaatataaccgcacaagacatagtttgttcacaggttcatgcctactttgatcctctgaagatctgattttttttcctgaagaatattagttgtatgtttatgattttacccatcttcagaaatcttccaaggtgctgctgaaggaagaagatgttgctgttagcaatgttaagattgatttgacccgtggaaaagataatccccttgaaaggtttttgatttataaacccacttttcagactcttatatttcttagggcgacatatcagattctgacctgttacttttgttggtctgcatatctactatccccagcatcaagttctttaaggtaactatacctgccttgacagtggaatgtcctcataattctcatgtggtctaaagtaggaattcttgttgagccaggattttggttgcgatgagaagttccccatcacagatgagcgggtcagccacctgctacctgcgtacaaccaggacagaattgtccgggtctacgccaagaagcacgagctggtgagtgacaaaacattctggcagagccgctttaccatggatgtattatcttgcagttgcataatgtgttgagtgaaatattgggtgcaggttgaagcggtgtcagaagccttcgagaacctacaactgaggatgtatggtgagaagacacaagttcatgacactcccaggaagaagcgcattagattccactaatcttcagcaactccttgttgccaagtactgtcatcagtgttagttagtagtagctcgtagcatactagtacgacaaaggagaaaggatcataggtagacatacggaaggaaggaaggaaccttttattactgagcgggagcatccaatactactaattacgggttttgtttttgctggtaatctgcacgcataagtaacgcgcagattagttgtacaggtgataggccacagaaaatgtcttgggcagtggtggtgtcacatgacggctggctaccatagcagatagtagtagctgatacgccagtatcgtgatcttctgattttttttttactctgagcctgggctgtctgggactgatggcgttgctcctgctttgctagtgaatggatatataattatattatatatatatatatattggcaaacaacgtttgttatgcttactattctctcattttgtaatgtgtattagtcatctcacgagccgcgagtaaaatggcatgtgaatggattttaaatattcgtccgtgtgcattttgatgcagcagaacgaaatgctgctgtgtaaaaatgcgagtactaataatgtcggagttgttagcgtaatataggggtcaaaatgcggtgaattttaggctgtgtttagattggaatgttggaattgttaagtgtaaagttttggtatatcatatcggatattatataaggtgtcgcatagggtattcgggcactaataaaaaaaatctgttagtaaattgcgagataaatttattaagtctaattaatccatcgctagcaaatgtttattgtaacaccatattattaaaagattcatcttgtaaattagttgtaatatgtataattagttttttttaagtctatatttaatactcccttcgtcccaaaatgtttgccgtcgttgacttttaattatgtttgaccgttcgtcttattcaaaaattttaagtattttttaattctttttctatcatttgattcattgttaaatatacttttatgtatacatatagttttatatatttcataaaaatttttgaataagacgaacagtcaaacgtgttttaaaaagtcaacggtgtcaaacattttaggacagagggagtactttatgaaggggtttgaacgtacgatgtgatgtgaaaagtttgaaagaaaaaggctgatctttcaaaggtttgaacatcgagcacatttttctcctatgcccttttgctgaatgtatttgggatagcatcaagcaacattttgatttgaagctatgcaggactgatctgtcaaatatgaagcagtgggattttgatttcctggggagaagttcaagcatccaaaagacggcgctggctgtcacgttgtggcatatatgggaggctagaaatcactccaggaataatcctaccttagctaatccaagacaggtcatccagaaaatcttggcttatgtggagatgattgaacaacactgttgccgtgctgcgcaggcggttaggctggatttttcacattttgatccttttaaaaaacttatttcgcaaatagacccctgaaaaaacttatcccagaaatggtcctttttggggcgccagagtggctggcgccgtcatccaacgggagtcctcctaccaccgtggcgcacgcgaaccgacgtggcaggaggagggcgccatccatgctggcgccgccccagggaggagggcgccagcatggctagcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcacattcactaaaattagaccataactcctttagtaaaaccctttgatcagcatgttaaacataatgcactctaccactatataaattacttaatctaattcaaaatataaccacatgaaatgacatatataagttaaacagtacatagagatgtaatttttttatttttatttcatttttttgatatttttttcacacttaggagaacataggaaccaaccgtataaaaaataaactcaaacggacaaaatatgtgacatgtagaattttccaaaactctaccgaaacggaaaaaaatatgccatctattaaaataggcgtaactttctcatacggactcggaatcaggcaaataatatatgaacggacatctacagaaaaagttctgtagattaaaacctctaaattctgcttgcaagattgtgttttcgaggagagaagtttttcggtggagctttggaaaattccaaatgtcacatatttcgtccgtttgagtttattttttacgtggttggttcctgtgagttcccaagtgtgaaaaaaatatcaaaaaaataaaataaaaataaaaaagttgcacatctctctcctctgcactagttcggagagaggagaggagaggaaaaattctacatgtcacatgttacgtccatttgagttcaatttttctatggttggttcttgtgtgtccctaagcgtgaaaaaaatatcaaacaaataaaacaaaaataaaaaatttcgggggggaggggggcgccagccactctggcgcactccccctagccacctcaacatcgccccaccacgtcngcggtgggaccgggctcnnatagntatancacattttttcctacccggcgctagagcccgctatttgtttgagtatccaatttcaaaccatcgatttcttttttacggctccctaaccgttccctatgtttcgtttcaaaacaccccatctcttgacttctccccgtatatgttttcctttgtgaaaccttccgtttgagccaaatcatggctggtgcccacacccttgtcctaaataaatttcggatgcttcccgcttttggtttctttaacacaacactcctcg

SEQ ID NO: 70255 - DNA, 691 bp, Oryza sativa
cgagctcggtacccgcaataccaaatcattggcaaattttggtagtaacaaatgttttggcaacttatgtgtcttattggcatattttggtagcaaaccaaacactagccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatctcccctcttcttcctgagtactctgggccaatctgccgccctccgccgcacgcgccatccgatggaggaggcgcaggccgccgtgatggcgcacctggaccaggtctcgggcctcgtccaggcgctctccgccgagctccgccgcgggatcggccccgccgccgacagccttctcgccttcgtccgcgccgtcgactggacggtaactaactccccgatccccagattagcggagatcaccgatttccagccgccgcgccgtgccgcctcctttctcttttgctgatgattcgcgtgccttgtgcttgtggcactgaggctatttcaggaaccatggctgatttgcttgatggtattccatgcgactctgttgct

SEQ ID NO: 70256 - DNA, 598 bp, Oryza sativa
cccaaccaggttttcacaatacacacacagcgcgcaataatcaatatatttacctgtgcctcggtaaatattataatcgccctgctcggcgtaaatttgcctcctgcgtgaggacttaaagaagaaccactgtacagaggtaccacctttgctagataacctactttgctaagtctgtccccattctagaattggcggtcgtactcgttcgttcttcagatgtacttggcaatcttatgtcggttggaacagtatgagccacccggaaatcatgcatttctaccgtactgttccaatctaagttcgttatattttatgcaatctaactaggcatggctaagcaaaatctagcatatatctggtttgctatatgttcaagttatgcatttaaaatcatgaatgggtaatgcatggaataatagagatatagaatataggataataatgctcaaaggggaggaataataacttgccttgctccaacgcaaataaatccgagataggcaacctgattatccgatcctcgaaataccacaggttgccatccaaaataaaatagattctactaagaaagacgaagaaccattttcaataaaag

SEQ ID NO: 70257 - DNA, 1259 bp, Oryza sativa
tagggcgaattcgagctcggtaccctgttgggcagtcgcagagtgcgggtaaagtgtacatccactacagtgtgagtaaaccaaatctattcgaatagccgtgctcacggttattgagtaccgggacatgtattacacttggctagactataaattctttaactggtgtgggatgggatattacatgatgatttttatgctgatggagccacttcctgagaggtgggaatgtggacgtcctcagaaaaccatgacgactcaatggcggtaagctattcttgggatcacaatggatggtggacagaaccgtcggtgattaatgtgaacactggtattaaaactagatcagtctatgctaggatttacgcttatgaaaagaattacaaaacttgctttgcgcaaaagaaccatagccatactttgaattcttctgtgatgtgcattattgctgcggtggcttgctgagtacgggtggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgatt

SEQ ID NO: 70258 - DNA, 551 bp, Oryza sativa
ctcactatgggcgaattcgagctcggtaccctactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaaagttcactggaatcggatctacggtttaagagatatgggcttctaaagattgggttttgaattaaat

SEQ ID NO: 70259 - DNA, 2728 bp, Oryza sativa
accacaagccagcgtgggcaacggctttacctttcgtatagcatggttcattgcggggcaccagactgagaagtggcggagatagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttgggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagatttttttttttccgctgcagttttcttcatggtgaggactaagtgcctctttagtaagtatttatcgttttagatattttgatgaatctgtatattaaattgttagtttgtgtacctcggctgattcctggacgaggattttatgcacaaataagttcggaaattactagtgaattttcgggcgtgacaacttacgccatggagtaatcttaacaaaagataatctgattaaaaggaattggagaggaaacaagtctagttctttctgccacaaagatgaaactattaatcatttgttctttgattgttattttgcccgcgcggtttggtctttaattcagtttgcttcgaatattagttttatctaatagtacaactcatatgtttgggcattggataagaagacaatcacgcaatttgagatctttggtcttattaggtgcaactaccactatttggtctatttggcttttcagaaataatgtggtttttgaaaggaaaaaacatatcttctcctttgcaggttatctttttgattacacattggctccgctcataggctatgcttcagaaggtcaatttgcagggtactatcattgcggtttgtcaacaattagagttagtggccatatagtagttttctaccccagcacatgggtgacgttctaggctacggttagcgggctcctaaagttctttttgtttctgctattttggatgatgagtttatcttttgtttctttcttgttggctgtgtgtactctttggtgcagaagccgaatgtgctctcagaataattgtatcacttgatgaaatttactgagattaataaagcttccattatgtaaaaaactggttctgaataggctaaaaaaaacaccattccacaatgctttgctgaaagggaacaagttaataaggtcaaagaattctcctactaatgaccatgaaactgtgttaccagaaccataaacaattacagttgctctcatctaaatctaatactgcttaatcaaaactgtaacataacatatgatgaaatagagacaaacgaggttagctccacaatcatttgggtgttgctccttaatcaaaactgtaattctcttgaaaaaaacaagctatgtgtggcaaatggtttggtcatcactcccaataaagcaacgtacagaacatccacgatctaattactgcaaagttactgcaaagtttccataatgccaaggttaggcttgttgcgcacagtaagaaaagatggcgattgtccaacatgttctagcaatttcttgttttttcccatcggatttgattttttatcattgttcaaatgactttagaatgtgtatctgcacttcattgttcaaaagagagtagtggtggctcgctagatgatcaacagtaacaacgaacaggtaaaaaagagtttaaatatgaacaactgcagatgaaagagtaaaaaacaaaggagttgggacatcacgtcttaccttgggtgatcagatgtagaatacttgtaaatcttggtttgattcttctaatctcttgagttgatccttcaggtcgacgctgcaacgcattgctagtagttttttcagtgaagctgggatgccctcctcgggcaacgatctgatttcaggacatccgacgatgcctaatgtgcagatagaagaaaggagatgcaacccttcgggaagggactgcagacggtggcactcatagaattctagatttcggagggaggtgaggagctgaagtgcctgctcctgctcttttgtgaaatttttcatccacaaatcataagtgaacctcaacctgtagagggtggaagcgaggaggctgcaaatgggggcaacaaacaccgctgagatgctgtccacctcaagcttcttaagctgttggaatgaaccaacaggtattgccttcgtcgttgacaccgctgcgaacaaatgtgctgctacggagcagcgatg

SEQ ID NO: 70260 - DNA, 1653 bp, Oryza sativa
cgttgcaatgcctcagtagcggcctcgctgttaaaggaggaagagagaggaagagaaagagatgagggcaatttggtcatgccatgtaaaaaagtaggccccttctcgcttagtcagcacaaaaatattaatttaatgaatgaagtgtcccctagcaaataaccacattttgagagtgtctttccccaaaagtgacttcgtgcggtgccctacagctaaaaccacaaagtcgtgatatcttgtagcaaaatttgccaaaaaaataattaatctaaacatataagttggccatagctgtatacagtatacgtaacatgtaacttgtttttgtttgtctgcaaatttaaatggcaaagtttcataattagttggagttgaaaattatattttgtatagctgatttgattaccttaggaacattacaaatggttgtccacaagcacgagcagggaaagtctcctactacagcatatctgacttaatcaattccctggaagaaacaatgcttttgatctgttcttcacacgtcttcctgaccaatttgttaaacaattcaataaaaataccttctttacctatatgcacactctttttctgctaaatattaattgctattgtatactagtagtgcactatacttactttatactccatcatgcagataacccatgagccagtactggtgttttactactctgatctaccagctatttggttccttgatgtgaatgtaaactggaaggagcaatgcaagaagcttccttttcattgccaatggcactggttgaacatgctcttgtcttcctgtagaagtgttgctggcatttgtgatttctgtacttgattttactgataaaaagtgtggatcatgcaatttattgataggggcaatgtttgccggttgaaaaaaatgagatgtgatttgttaattgtgatcgttcgggattacaatttaaacagataatatgctttcagagaggagatcgggtaggttacatcaaaaggaattattctcttgtcatgaaaattggaattaaaatgtacgtagaatcgtgtgttcagctggtagaaaatgctaccagataactgatgcaacagaaacagtagagtttcaagagctattagtctaagaataattgatattgtgcaagaacgtgattgtccctgatgaatttcaaaaaagaatttttaaagcacctccagagcttcacactgccaagaagctctctctgtatcagatgtggcacatctagcttgattagaaactagaaaggttaactccaagcagcagatctgcaacacccgccaaggaatattttgatggaatattttgcttgcttatttgcactcttggaattaattgataaaggaaacaagctatgggcctaatcggcccatataacatctgactattacggtccaacgccagaaataggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcggcgcttacgtggcaattc

SEQ ID NO: 70261 - DNA, 570 bp, Oryza sativa
ttagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacacaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatacttctcaaatgacttttctctcaaatcacgcatgtggtttaatttgtggatccttaccaaggcatattttgccgaattgtccctattctaaaaggttgtatatgtggagcttggtagggatcaatcggggcataccttgcatacatattttgcaaagccaaaaggtcggacccaaggagatagcgagttatacttttttgatcaagaatgtgcatgtgtgtgatatgtgtatggg

SEQ ID NO: 70262 - DNA, 737 bp, Oryza sativa
  unsure (1)..(737): unsure at all n locations
gtttaatgcacattcagcttagaaattctggttcatgaatttctaggcgagacatcctagcttcctccacgcccggaatccccgcctcatcccctctcgcaggcgatcgatcctccaccctcccgtacgcggtaggcctcccgcctccgccaatcaacgccgtcgtcctctcccgtctcgccgatgggatattgacccggcaccaacgtctttctcgctttcgtctccccgcgccgacgagagtggcgtcccgaccgtattcccactttctcagttccccacgagaaaatggacatttcgccatgttcaaaacgcggtttcgctagaatgccatcccgaagacgtgattcgataaactgccaatatgaagcgtgcgtctaccgccactttgccattttcgctattttattcattttcgaaaagattttctctcctctactaggtgttgagacaaaatttccccttatcaactcagagaacacggtgagagaggagacagaaaaggggcgccgacgccgctgctgccggccggcgccgcctctccgcatcatgcgcggcaacatcgtgtgcgtccgccgcggcggcctttgcatgctctgcccggcggcggagcgggtgaccgacgaagagatgatgaggggcaccaacgccgcgccgncgncggtgcccggaacgggatcgatcatcgacgaggccctctgcctgatgaagctccgcgagaacgtcgtcgactcgat

SEQ ID NO: 70263 - DNA, 13748 bp, Oryza sativa
gcaatttgtttcactgccctctctgctctttttactagaggcacaataggtgttataaatactcttcaaattaaagaaacaaatacatccaaaaaaatggtgcaacagtttcctcattaaaaataaggacaatttagtgcaaactgcaaaggttagttcacttcagccaatttattaactttagtattgatgccaaacaaagattgctaaccgaatagcagtatatgctgtatgcctacaaaaaatatatacatgctaacatagttgttggacttacattttgcgataaatttgtcatcccattcatcataagcagctttgtccatgttgccatcctcatctccctcgctgtcatcagtttcattctcagaaataccctttttttaaataaaaaaaaatgttaaacagtgccaacagatagaaaacaaactgattatagttagttaactacataatcaaaagaggctgctaactaaagagaagaccacaaataaatctctggtgatcatggtccttagagtgaagtatattttatactacagtaacagctcaagtgtagtgaacaaccctcaactatctaaaccagttaacatatcccatgtaagataaaaaaaactggattaagtggtggtttcatggttttgacatcccgtaaatatactttttgactaatatggcaactattttttacattttctattaattgggtgcaatattatagagaacttatattaaagaaaaggttaaaatggggctggatttcccttgggggtattttaaccggttatgttggttgtgcttgagggttgattttggaccaagatcataatgcctgctattgctatagtggtattcagtaatatcaagattgggaaatgtacccgcaccccggaccccggtacaggcataatggactagagtaaaaaggcagtagtagagaaataactgatcgtcatgtgtatatatacgaggcgattacccgaaagagaaaggaagggagcatagaatagaaattacctcgagatcgaagacggggtgttccaggtcatcctcagactccatatctgaaatccatccatccattcagtaaaaagattcaagtaaaaaggaagaaaaaatgacggctggtacatgaaaaggaagaggggcggaccgtggtcgtggagggggatcatgtcgcggtgcttgtggactggaaatacccacccacccacccaacacagatggataaagcgtgagatgctggaggtgaaagaggaaagaggagagagagggggtcaggtcaacgttgtcttacaggcgtcgatctcgtcgtcgtcggaggcggaggcggccatcaccggcggcttcacggtcgggggcctcttccacttccccttccccttctccttccccatgcgagcagaagcagagcggatgaggcggcggcgttgttgttgatttgtggggttttagggttttggagatgttgcggcggtgcaggagaggaggcggggcaacacccacatgggcttttctgcctcctcctattgggcttcacaggagaccactggcctggcccagtacgtgattatttctctctctttccatttttttatggaaaaagtgcacccaaggtccctcaacttgtcatcgaattacaaaatcgtcacccaaccacaaaaccggatatccggcgtcccccaactaaccaaaatcggtcataatagatccctcggcggttttaaccccggttttgtcctatgtggcgggtgactcaacgtgggacccacgtgggccccacatgtcaggctgccacatcagcacacgaaccttcttgtgcttggcgttgagctccttagagacggaggccttctcgttcctggctgcgctgcgcgccccccgaaatccctcgaccccaaatggaaactcctcccgaatccgaaggcaaaccaggcgccagaccaggattcaccgtctcggtgcccttcccccctctcctcctccctgatctcgccgcgtcaaggggaagagagagagatgggcagcgaggagaggggagggatctgtgcgtgcgtgtcctccccggcttgaccttcctcccctcctcccccgatttcctttcctttaccttctatattttttcaattataaaaaaaatacctgtgcgttgcaataggtgaaggctattttaatcttattattattgttatacggtttaactaagttgaaattaactctgggaatttgattggatatttttttttagaaaatcatgagatgtaattaggagtttgcatgcgagttttttcaaagagatttcttatatgactccttatgtatttctaaaagcaaacaaacttaaaatccgacttaaacatggatctgtatttctaaaagcgaacagactttaaaaaccgactcaaacacggatgacatatcaaaataatagcaaaaacatctttaatttttataatagtaaagatatatctctgttccaatatgtaggatgggtctgagtctaatcccatcttagtttactaaattttggaacgaagagagtatgtggttttctttttgtctccatcagcgaagtaaaagactaaaaccaattaaataaacgaatttgttaaatgtcattcgacataaatctaaggatgatatctatagattttggaccattatctcctttgactcctgtgagcttcccctcttctccagcactggcaacacccctaattccgacaagggacatacacaagttcatatgaggtcccttaacttgtaaatgaatctgattttcgtccctcaaccagaaaaccaaacacaacgggtcccttaactattaaaaccagtgcagattagatcctcggcggttttgaaggtggttttggctgatgtggcgtctacgtggctaatttgactcggtcttcatctgacgtggcattgacgtggcgcttacgtggcaattcgatcttggaaaaataataaaacctgtgggacccacatgtctcagtttcacccacaaattaataaaaaatagtggggcctacatgggccccacatgtcttcatcttctcttccgcatgcgagcgaggcgggcggtgacctcagtgacgcgccgcctcactccacctctgagccgccgccttcctttcccctcccccgccctcgccgccgctggcgtgtggcgccagacgagacgactgttggatcccgcgtgcaccttgctgccgccgacggcgagctcgacgtaccacatgttgagcgccatctgccagaggacgaaacgaagcctccctgctcgacggaggcggcgtcgcggccgctgggcccacggttgcagcagctggtagccgcccgacgccgccatgtactgctgcagaatatactgtgccgacgccgactcttgtatttttcacagtgagtgagtaccagatgcacagccatgaatcaaccacatcgatctcctagaagcgaagcaccaaacaagcaggtgaagcaagaaatgtgccgtacaatgagggtccccttgatagagaggagaggcaggggatctgctagcttcaaagggatgggggccagcggcgtgcccatgacgcgggggaggaggtggagttcgaagcagcggaacgagtcgctcgaagcctcgaacccccgggaccggcggtggctcggaggtggagtgcggcggtggcgcgcgagatcagcgcctcgccgaggtggccgcccgctgccagcctcgctcgcatgcgggaagagaagatgaagagaggggagaggaagagaagagaggggacatggagagagagagaggaggaagaagaggggtgagttggactgacatgtggggctcacgtgggtcctactattttctgagtgagactgacaggtgggtcccacggggttttattatttttccggatcgaattgccacataagcaccacgtcaatgccacgtcagatgaagaccgagtcaaagtagccacgtaggcgccacatcagccaaaaccgccgaggtacctaatttgtaccggttttgatagttgagggacccgaggtgtctggttttccggttgagggacaaaaatcagattcgttgacaagttaagggacctcatatgaacttattccgagtggttataggagggggaagagggtgtttccccaacacttagagagatggtcggtggacataggcaggcagcgatgtgctggagccacgaggttggcaacgatggtggcccaacgttggcatcgtagggcaaatgatgaaactggttaagacgtggtggtggatcccaacaacagggagccgccagagactgggaggacgacgaggtaaaggcactcgtagccatcaccttgggaagagaatgggaaaggaaaaatggagggggccttgtcggcattgttttaccacttacgggtaaccgacgaggccaagcatggaagagttgcgtgtgcaagcacgtgaaagtagtgtgcggttaggtggacttatgagggaaggagaaaaactagggtttaagtatgttgcacaaatttcaaagtgatccaatggtccaaaatttaggagttatttttatgtcaaaagctacatagacaatcccttaaaaagtcatttataggtacaacttgtttatccgtattattaagggtctaatggctaatgctgagaatagaataggacaaaacaaaacaaaaaaaacatatcatatttcaaattttagaaatgggaaaaaacattatgctaaggatccgtttggtattgagtttaggagtgtcaatttgctcgttttcagttaccatgtttcaggaaccgcaaaaggtgtgttttttcaagaactttttttatacaagttttctttaaaaaatgaaatataactgttttaaagttagcaacaattaatggttttaaaattcatatttaatctaaaataagaagaaaatggtcatccaaatgatttatgaagctaacattatccaactgcataaaaacttgaataagggtggtgtgtactgcgaaatttgaaaactaaatattatatggcacaacttaaaatatatatagttttatacgatttcgacaaaaatcctactatttgctaaagaaaatttgtttgtgggccttgttcacgtcgcttaggctgggttccttcatttttgcttcccaacacgaagagtgcacacggaaacggaacaggcaattggcacgtgattaattaagtattagctatttttttttcaaaaattaatcaaatatgattttttaagcaactttcatatataatatttttataaaacacacaccatttagcagtttgaaagtgtacgtacggaaaacgagaggggagagttgggaatcggctggaacgaatgcagccttattgttgtgttagccacactcgcaaaaaattaaaaaaaaatgaaatttaattttagaagttttgtttatcgcaatttattttactaaaatggctttcaaacggcaaacaacaaaatactactccctccatcccaaaatataagcatttttagcatagtaacatgtcaaacatttttaactttagccattaatagcaaaataaaaaggtcaatcatgtaaacaaattatcataatatacaactcttttatttaaaatatcttatttttataaatattagtgatcaaaatagtatctcagagaccattgccaggatctataaatggttatattttaggacggagatagtatatagtaataaaatattttattttgggctgaatcgttttttttgttggtgtgctttgaatgcacaaggcatgtcccggtggtgctcgcagttgcagttgcttcgctttggttctcccaaaaaattgagcaccacaaataggggtgcgctcggctcgtggtcggctcgttgagaaaagctaacgagctgagccaagggtttagctcgagctggctcgcaagctgctcacgaggccaacgagccagagaaacaccaggaccaggagtccactccgagccgggctacctaaccagaaaagcccattagtggcccaatagcctatttccttgagtaaacaaaccctagaatccctaattcacagagaagaggcacgcagacagtaaggaacacaggcgccgcggccacaacccacacgcgaaccggcgaacacgagcgagagtgcgagagcgagacgcatcctgccaccaccggcgaccaaggcccgcagcgagccggtcgcacggtggcacctcgcgtcctcggcccctcctcctcgccatccgcccatccctcgtcggtcgcggcctccccgaacgagctggctccgagccgagccagctcggtacactaacgagctggagcgagccgagccgagccaagatatccacccctagtgtggccacaaacaacaagagagagcagacaccaccacaccatccaaccaaccaaattcctctctcctccgccgcgcccgcgccgcagcaagcaggagggcctccgcccgtgcgatgccggcggcggctaggctacgggcggcccggtgatggcgaccttcttccgcagcgccaacctcgcctccagggtcttcgaccgccagttcctctccccacgccccggcgctactgtacgcccaccgccccccattcctttctctttctacggactatatattgactagtattcctttcttatttgctgccttcctttcttattgagtatatgcctgacctacctacccacatagaatttcccttttctcgcttcaacaattgtcaattcactattatcatcgtcacacgtctcgactactagttcgcatcgcgcactgtctattcaattatactagcagatttcatcatcttcttttttccccctcttgttgacaggttaacactgttagacagttctatgagaacttggttccgagttacactatatgtgacatagattgcccagattattcatttcgtaaattcactgatgatggcaactatcttgtggcttttagccggaaccaccaagatttaatcgtgtaccgtcccatctggccaacattttcatgcaatgagccatgcgactctcatgatcttccacccaaagcaaagaaattcgacagcttctttaagcagctctactcaatttcacttgcatctagcaatgaatacatctgcaaggactttttcctttacatggagtgccatcagtttggcttatttgccacatcaactgcacaaagcaacgattcaagtgccactgagggtgctattcatggggtaccatcaattgagaaaattactttctatcttgtcaggtacaatcatcttgtttcgctaggaatgcacttttagttgtccgttatgatgtctatgtattataaccatcctttcctttcgtttgaatggttctcgacttctatatttctcttgttcaggctagacgatggcgcaatactagatgagaaagctttccgcaatgattttatcaatctggctcatagtattggagcttacttgtatgaggacctgctatgcattgtctctcttcgatatcaaacaattcatgtcctacagatacgagattcaggcaaccttgttgaagtacgcaaaattggtgcattttgccaggaagatgatgagctatttctccattcacatggtcaggtacctactgatccctacggcaagattgctggatctatatttagtttacatcatagttggtactggtcatgtattacctgtctaatcaaattggtgttgattgcactggaaccatgggcattcatagttcaaataatagtaactagaaagaagcacgcgctacgctgcgtgtgatctaacaattactgtttgcacttaaaacaaaaatcatctttcaccatacttcgtacttttctttgctctgccatccaagcatgctctgtaatatgatcaaattgtaaataaaaaaactaaattgcatcattaaggtaaaatatggtataaatttatcttgcttcccccaaaagatagatatcaccgtaacatctgaacttaacatgttcaccaatcctcgataatgcaaagggtaaagaatagaagatatctttgcattgatccaattcaagattattcaaaattgacttcagagtcaggataacacattagttacactgaccagatataatctgatatttgagatttatttgattgaggaatttttttcataaaaaagaattagtagctatggccagtaaagatccaaccaccagcttgcaggtgcttgagatgtactgcacgcttgctgatccctatcaccatctacaatgataataataagagcaatccatgagaattggtctagacagtttttacaatagaaggtaaatatgcccacaaaatatatagagaagttggtaagggaagcatgactaactcaaaaaactaaaatatgtatggctgtgaagtagggagaaatggtgtttccatacgacttaactaaaatgcctcatttgtatcacaaagaactaaactgcattgtaataattaacctagtgaaaacttaatatgtggtagaaaaataacagatcatgtagttagtgaaatatggctatcgttccatattgagaaggaaattattgctcaggtaagtggtcatgcaatccaagatataccatataagcctctatcatcttagtgtgcttggttcttcaactgatagcttcgttcattattttttttcatgagctgaggacaatgggttgcccctctcaacaaaagtaggagttttgttttgcaagaaggatctgtcaccttgcttgtctcaagataaagaacaactaagacataaatataaatcatggatgctgtatacaaaagaacaattttcatgaactcctatccaaaaagtaagtacacttgctataacaataggatattttgtaaagaaataggaagaacatggagccgatggcaactatattagtggtacatgcgctcatgtgtaatcaaggaaaactaatgtatatagacaacccatcatagaatgaagaagcgcatctagaatttctcataggatctctttaaaaaaaatcaaaactgaaaacacgttgcagaacctttcatgtgggtctgaacttatcccacaatcatttatgaatattcttcatttgtatcttgtacatataaattggaagacctacaaactataactgtcactttgtcagataggttgttgctttctcataggtgggacagagcatatacttgacatttgacatcatgatgaattaagcctaaatcattttgctgaaatagaatagaacattgctctggaagtttggatacctcaatataattcaaatgcaagcatcagcagttgctgaaagtgagatgtcttgttcattttccaaaatgatggtcattcaacagtttgtcgatgagataaacattgcatgattgtaatattctgcaaattaaaaacatgatgaaccaaaacttagttgatttgaaaatttaatatgacaactaaagcaaatatgaaagtactggattaaggagctgaattctacaacttccatatacaaagaatggcattatctgccatgtaaatggggtgaaaaccctctgcaagttgacagatcaagttatagtcgaactgcaatacacagacttcttatcagaagttacctctgtccttaaacttgatacctgcaactttgcagtttttcacattctctgatttggacttcaaagattgcaaatatcagctagatgtaaattgcatactaagaaaagaaaatcatataattgaaattaggatgaagcatgaaccaattacctcataaattggaatgtggtctgaatataaataaataatgtagtctctgaaaactgcatcagagtagcacaatcttttgcccatcttttcccctagttcctctattgctcccttctcacttcaattccattgggtctagcagtagcacaatgggatcaccctcctctgctttcttcagtaggaatatcgctgtaaggaaaaaaaagaaagaaagagggcagccgctagcatacctctcgttcgggtggctggatcttccgatgtggcaatgacggctagaagagcgcggtggcggcagctgcggtgatgtcggcggcggcgacgttggcggcggcgacaacggcgatgacggcgtatgcgaggggaggagaagagcgagggagcgggccggcgcgcatgagggaggaggaggcgaggcggcgcgcttgcgcggctgcgggcgaagcggacaatgaggctagggtttggtgcaatctctgccgtccgtttgtgatccgacgatatcacaggtgtggaagcgccggcacggtaggacagatgtacgacccagatcgatcgtagcacaagatcggacggtggggtagctgggactggcacataattaactggaagttcagggacctttgtgcaaaaatacgctgacgtggcgctctaattctcaagcatttccacggcgtttaagtaaactaatatatgagagctactggagcatcaccaggagattatataaagaggagtaatcattccagttttaatgggttgccagataaaacaacaaataggtcaataaccactgatttcaacacccattctttgctgaaaaataaattaggctataaccaagaatatttattggactgaattgatcttctagactgtagcaagcaatatttttggtgctatgttaaaaatagagagaaagaaaagaaaattgtatgcctgcatctgtccaggagtgcttttgttctgacatatttgattatctatttgctaatgacattcttctattgttttcatattgtttctgttatgtaaacggtataacttacaggagactagtgatagagaagcagatatgcacttccccatttgttgcttgaaatatatttctcgtaattttatttccaccatgttcattcattcattcattcattactactagttctttggatttttttttaactttggctccttgtttcccccactatttttattgcacaaaagcgccttctcagtctaggaaaatattcatgtccatgatctattattcttgatcaacaatagttgatattattctagttatgaacttatgcacgataaatctaaatcaaatctacgtatgaatcacaaactgtcaatgtacttgatgcctgcaggctgcacgaggtgtttcttttcttcctggcatcaagcaacggttgttgtcatttatttttcgcaagacatggaatgaggaatctgatcagaccttggttagccatcttttctagttcattcatttggtattagttttgaattaaggtgtgcgttgtcttctgtgccatggtcctgttccaaggttgatcacatacttttgaatattgatgtaaagtagatattatatttaagttgtcccaactgacatgcccactgctaaaagtaatatttataccttttttccatccttctcttgtatatttcctctttcattggtactgttgtgttctgtctttggaacttaatttgttgtggagcaaaatattttgttttaattgtttgttgaaccaatggatttgtttacagagagtccagcatctgaagaagaagttctattttcactttcaagactatgttgatcttatcatatggaaggtacctacatacatccactgctcactttgtctcttactctctttccctacttttatttcttgaaaagtttcttaaccctttacctggaaccaatatagttaattttagctaactctcagtaataacacaaccttgatgatagagcatgtgctgataaccaaacattccatattctatcaaatatacatatatatatttttcgtaaaggtgcttataacatgatagttgaacaggtgcagtttttggatcgtcatcacctatttatcaagtttggtagtgtggatggaggggtaaatccatttttccagacatcttaccagtcagttgtgcataacctgatgtcatttaactgtaagtacatttatgtttctttaggtttctcgcagcactgaacagaattcagcattctttgctgtgtacaacatggagacgacagatattgtttcactctatcaggtacctattctcattgaaacatgttgttggagttgtttccgtttgttacgttcagcctattatgcaatttatcaacagaattcttcggaggagctctattcattgtttgaatatttttatgaccattttcacacaaatccacaaaattcatcgcatggaaattttatctcgtcacattccaataatgttcatgctctcgatcaacttcggacaattaaaaataaagcaaacagcacctcacaggtaatattgatagcatcaggggtatgatttttattttttgactcactacagttcttggctctgttagtctgtttatattgtttccacaagatgtgagattgtttaaaagttattgtgctaatgcctacatcttttgcaatgttctgattagaaaccgtacgagtttcaattattaagtcaatactgctcagttctacatgcttggatataatgtacagcaacactaaatcaccaacattgaactgaataatgtagagcaacgctaaatcccaaatgcataatgaaagttttcttaaacattgaactgaaaattttctgaatcgtcttggcattgaactgtatgtgaggaatttaaaaggtatccctgtattaccgttaagccttgaaccttgtgagcttgagcagtcttccagtaagggcctttttttatgtctgcttctattaacaccaggacaagtggtttgcttgtgaaaattttagaatgagccaaatctttgtgatgaaaagctagaggtgtgaaattactagttgatgatctttgatatttcttgaaatccacatttattttatgttactcttactatttatatatggcataaggcatatgctaactaatttgtgatgctgacttttggtaaatgcctgctctatatttagcagtttgtgaaaaagatgatggcgtcactaccttacacttgtcaatcacaaagtccttcgccatactttgacctatcattgtttcggtatgatgagaaggttcgctcttcaacttgtttgaaataattatacatcagaaagcagttgatattttcgaaatttatttttggctacttttacagtttacagtttacagtcaagttcaaacacatagaagatgctaccttgactaacaaatatgtgacacaatcttctctaaatataagccatgcgaggcacttttgtctattttatcccccttttgactttgctaaataaaaactaccactggcatgaattatggttgttcttttccatgtgggcataactgaagggtaagaaaatcatctacccactttcataggtccctttgatccactcctatgaataaatgttagttttttttcttattgttatttagttcttgacatttccttgtccctcgttttcagctgatttcagcgattgatcggcacagacactgtacagagcatccaataaaatttatatcagtgaaacagccaaatgttgtcaaattcaagataaaaccaggtatttcttactagatcatcgtcgttagcaattattatctagattctgaagttcgtgcttgtatcttcatataattatcaaggacattgtgtaatattacaattacgaaggccgcatcatatgaataaaccaaaataatggttaacatgttgtgaaca

SEQ ID NO: 70264 - DNA, 4413 bp, Oryza sativa
atatatatatatatatatatattcagtgcgatttatggacgaactgaattagcatttgtagctatgtaaaggtagagaaaaaaaggaagttgtacgtagctagctagagctttcatttgatatgtagctcggttgctttttaattaattcctgcgaggaaaactgcatgctccatgatcacttgctcgctgctagcttttagttattgtactacagtagattgccgtactattaattgtacttgaactgttaatggaacgaatgccatcgatggatggatggattgatatatgtatgcaatcaattcatcgacgacggaatcgatcggatggatcgatgaaatgcatgacgatctctatatatatatatatatgatgctgatatgattaataaagtcaatgaaggtggggctaaataggagtagtcactaaaagctagctactgaggtcctgtttagatgggactaaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcaagcttttcgatctgcagcttttcgatctcttctctcttcattcaattcagccctgtttagatcatgtcaacaaattttatcctgtcacatcgaatgtttgacacatatataaaaaatattaaatataaacaaaaaaataactaattacacagattgcgtataaattacgagacaaatcttttaaacctaattgctccatgatctgacaatacggtgctacagtaaacatttgctaatgatggattaattaggcttaataaattcgtctcgcagtttacaggcggattctataatttgttttgttattagtctatgtttaatacttcaaaagtgtatccatatatccgatgtgacacaccaaaactttacacccctggatctaaacacagccgacgattagttgatgtgcacacgcccatgtatatatgcatgctcaccaatgactttactcccgtgctgatgaattgaatactccctccctcacatgatataacaacctaataccagatggaacactttatattacaaagaattcgtgcatactttatgtctaaattcgttgtactataaaacatcccatccaattctaaatttatatattatgaggcaaagggattatatattatgtctttgactatagtattcactcgatcctaaatatgtgtttgggttgagaatgaggtgggataaattggacccatccatgtttttaggatgggatagtcacatctatccgtttggtacgagggatgtgatgatcctacttcttaagggatggccaacatatcagccagagaagaaaaaaagtggttagaatagtatgccagtttttgcggggcaaccgggcaaagccaatgcggatcttagggcaatattcctttctagagatcatccttatctcacatatatattgtcacaccctgaagttcttctcccgagcctaaattaattaataaatggtctcgagaaattacctgtgtaaaatcaagagaggaaccctaattgaagtaatgcaaataataatcgaaaatggcatgtgggatttttcttgagttctacatgtcaaaatatgctaacaggatttttagtggaattttcagagctctagaaataattcaaaccaattaaaatcgagcacaagcattattttaatccctgggaaatccttttcttttttctttccttttccccttcctttttccctaatgagctgccagcccatttcctcctccctcccgcgcccttgctgggccggccgaaggccacagcccagcagccggccgcgcctcctctctcacccggggtcgccgataggtggggcccacctgtcgggtcctcccccaaccttcggacgctgccgcatccgcagccgccgccccgcaaccgcccgctcccgcgcttcccgggccacgccgcccacgtcgccgtctcccccgcgcctcccgctcctccactaccaatcccgctcgctcgcgcccacgagatggccgggattcgaatttcgaatcccgcctctctctcctctcccactcccccacgtcaaccggcgattcccgcctctcctggccacgtccagacccctcctcccctatttaagcatcaccgcccctccctctccctttttccccatttcaccgagctctcccatgccctctaccgccctagagccgtgcacccgccgcagtcgccgccttagccaccttcggctgccgctcgccgccgctagaaccgccgccgagcgcgccgttgccaccttcgggttcgcgagcccgagggctaccccgtccaccccttcgccgtcggactccgcccccggaacccactctgcaccatccgccggtgagttcggccatggccgcggcttcggccagcgttcccgccctctgtgctctctttctctctctccctctctaatttctcccattttgttccttaggtcctctcgaagcccgtccacctctcgccattcgccatcggcgaggaactcccctcccatccctctctatctcccgtaccgccgctgccgcttttgccgcgccgcctcgcttcggggccgtgccgccgtgcgccgccgcatagccgccgccgcgccaccgccgtccgccgccgcgccaccgccgtccgccgcatcgccgccgccgtccgctggtgtcgcgccgccgccgcgccatggccgtcgggccggcttgaggccatccaccttgccgcctgagtggccaccgcgtgcccgccacgtcagcaccacgtggtgcgccgcctccttcccggtccatggacccggtccaccatgaaccggtgccccgagcctatgacatgtggggctcgcctgttggcgccgccctctctctctctccgatgacgtcaccagggttaattattgcgcaataaatacattgaggacttttctgtttatagaaaaaacacaatgaatcttctaaaattcatagaaatttcatccgagctccgtttaagcccattcaagtctcagtaaatcaataaaaaaatgcaaagaatccattaaaaatggttttgttctctgtttcagtagtcttatagcctgtttgtattgtttgctttgtatgtcgcttagattccggctctcccgacgctccggtgtactttgagatagtcgccgaggtccctctagcagcagagcaaggcaagtaatgcttgtcacttgaacatattggtcccatattgcaaatgctctattgtttttctttaaatactgcattgttttataatgatactatgggatgcctacctactgtttcagccatgctatttgttaccttgctcctttgttagcttggggatataacatgactagatattggattagggattgcgtagccatgcttagttcaactagtacacaatgggggatctacattaatgcatagatatcagattctagtattgatattggtttagtgccaccgttccggtgttggttaattaaaatatactaaatggtgggctatgggtgcatggttttgctggtcgcacccatggcaattaaggaccgttcgcgggatgccttggaagaacttatcgtacttaccaccgaacgcgctgatgaagcctagaggggggggtgaataggctgtccctgaaaacttaaaaataaatcgcagcggtaaaattcaaatagacccggaacttcctggtaaggaactctggaacttccggcctgccaggcctggaacttccagtgttcttaggacaggaacttcgggtaacagatgaaagatgaaattcaaatttcgaaacaggagactaagccaatcttctcaagatgatgcacaggtattctaagcaggagatagatcacagaatcatccacagaaacatcacagaaagagacaagaacgatttttccccaagttcggatcttgcgatcctactctccgttgaggagctccaaagagctgggtctcaattaaccccttgcctcacttttgcaaaaaccccagaggaaatccacagctttcaaccacaaacaccctaggcaaatttctagaattaagtgaccaccaagatccaactcaacctacttctagaaattcgccacaagtgtaggttgctctacttggaaaacctctagaatctcagcacaagaacttcatt

SEQ ID NO: 70265 - DNA, 1284 bp, Oryza sativa
gatcatctccaagagtaataagcaccgagatgacagcccacgagatattccaagtactcacccaagatcctagtcttcacacctctccaaatcttcttctctccctctcaatctcactttctcacaagaattaggctctagattgagtggagaaggcaagaaacacttgggagaggctagcaacagctctaggttcgaaaagtgaaagtggaatggccaaagaacgagctggaaacgagctggttatgtataacagctaggtgacgtcatctagccgttactcataattttgaactggaaactagacaggaagttccggatgaactggaaactagacaggaagttccggacctggaagacaggaacttccggactacacttaggaaaatctttttctcaagaccggaacttccggacctggaagacaggaagttccggacttgcatttttggacatattgagtatttgcaaaaataactcctagggaaacttgacacttggttcacactaagagcacttgacatatctaagagtatcacctggaacccctcttaatagtacggtttttcctaaaaactcgattgcaataaataaactatcctatgcacttctcgagttccggtccgctttgattttatacttttgggggggtctccaagcatccatcttccacaccttggactaatacacctgaaagtaactcaatgaactcattagtcccttaaccacatttgtcattaatcaccaaaacccactaggggaattaatgcactttcaaccacaagccagcgtgggcaacggctgggcttgtagtatagcttttctctagctgacgctcctaggcaagggtgggcgtgatggagcggggtgggccctgcgacggcctctgtcgcttccggattcacctaggcaccatagggaactgtccgttgcccgctggggacgggggtgaaacccgaggtgtggtgtgcttggctagagagggttatgcgaagggtcctgtcacagcctctttccggtatgtcgtggtggcatgtcggcgcacggtaacgtgtcgtgaggctgtgtcttgtgggtacagttgtacacctctgatcagagtaaaactattcgaatagccgtgcccgcggttatgggcggtcaaccagattcaccgtgattagtctcaccctagcttagtctaatggaattgattagttcaggtggtgggttgggcctgttgcaacgtggtgtagcgttggacagtggatggttactattaattaattacttacaactatttta

SEQ ID NO: 70266 - DNA, 546 bp, Oryza sativa
tttataatagtatagataagtcatttgatttttctcttagtcaacttttttaaatttgatcaaatttatagcaaaatattgtaatgcctggcaccaatctcgttgattagtacttagctttctcggatgggacagtgccaacgtcattgacgtcatcatgttagaccacggcactaatgacgttggtgctgcgaaaaaaaattagcaatagtgcccgtgcgttgcaatgggaaaaactacatgcccaaaatatcagctcgacccatttagcgcgagcgcacggcgagcggtgcacggcccatctaccggcgatggcccgcccgaggcgaactaagcgcgacccaaagactgcatggcccaacaatgatggcggcccgacgcggggtcgatctgagttgttcgattggtcctgcgccgatgaaatcgctggccggaggggggaggggtgcgaaaaccctaaccctaatcccctttctcccctactctctctgatccaaactccggcagcacgagagagtggatggtggcgacggtgctgacagcggt

SEQ ID NO: 70267 - DNA, 1055 bp, Oryza sativa
gtccataatccaaatacctaattgcggtccagcttccattgcttcaaatatctgcaagggtacatagggttgctagctatacatcccccctcgcttgcaacttgccgaaggttaattgctcacactgttcatcattttatgatgaactaactttagcaacttggaaaggaaaaaaaagcgcatttcattaaaaattagcaccccctattaatctataggatctaatggaagtagagaactgtacatgacaatgtagggtcatactaaggcaactattatccaaatagaaatattcatacgcacctcgagatgtaaagccaatgttattgcccataaggtttggttgaagctgtgatgaatgattatccatttttcatccaaaaaatagccatatggatcagcaattgcacatactaaaacctagagaaaatttgctgctttaaaagcccagcccagctgagcattgaccaaccattaacagatgtcagagaaaagtaagccaatgaggtttactgtcaatttgcggattaagttattcacaatgcttataaactaagctatttacatgtaaactagcatctttgagaggaaagcgaggtagacatcaatacattggaacaaaactctcaaaaacctggattcaatgaccaaaggaaccaaagatctcaagtccagatatagatatgatgcttgtcagcggtagcaagaggtcctaacccacaccatgaacttgaaactaccgacgaagaatggccctgtaggatcgtcggtaccccatcctttttcaatcttgaccatatgtaaacagacccatcattagcaccagcagctatggagttttcatcagggcttatgcaaggcctgccccagctgctaaccactctgttacccatggccttgaattttccacaaacttccattgttctaggatcaaaaaggttgtgcacgttatcctttccacttgtaagaatgaaatttctattccgtgacacactgacagagcttacgtcaagatgagcgaatgtctgggtaccgagctcgaattcgccctatag

SEQ ID NO: 70268 - DNA, 690 bp, Oryza sativa
aaaaatttaaaactaaacacggtgcgtatctcttgacctttctgatagtatcacatcgttggcttgtacttttttcaagttctcggcaaactcttgtacggttctcaaatctcaaaccatatttttccacaaacaaacaacggtgttgtttacgtttccgactgactacccgatcccgcgccatgtggtggtattttgattgcatttcgacatgtgtttagttcacgttgaaattgaaaatttggttaaaattataacgatgtgatggaaaagttgaaagtttacgtgtgtagaaaagttttgatgcgagggaaaaattggaagtttgaagaaaaagtttaaaactaaacaaggccaaaacttggatcaaactactgtttcaaatttgaatttatcaaagaccattcgaaatccctcccagatattgattttgagccacgtcgaaaacattgaaaatcgcaaaaaatcgatcgggtttcgttgatgaagtaaacccaaccttcttgcccataaccaagaatgatacgcatatgtaagtgtgctttagatggaaattaagtaagatcgaatatttgcctctagtctgataacgggaaaaaaaaagaagattctttatgtgaattattgataaactcactgctgtaataccaagggactcaacatttttttcttatacttattataagcaaa

SEQ ID NO: 70269 - DNA, 686 bp, Oryza sativa
cttcttcgatcatctgacatctcggaagcttctgaatttttcaaatcacgtaaagctcaagtgtccatgtcactgatgcaagcagatagattagctcgttctcttttgactgagatcatcattaatgaacaagttattttggagccaaagtgtttaatcaatactccagttgttaattagtagatactcctactttgctgtgaaggaactaggaagccatgatcccggatcagaaaaagggaacgcagtctttagcctgaaaaagtatgttacacgttgcaatcatcgaaaattaagcaaaatgatcatcttagaaacaatgatccaaagcttgagctgcatgcactttcactttctccaggtcacactggatgctaccaatgtccatctgagatgcagcaatgcagtgccttttgtctcaagatcagagaagcttgtaacatacacacatctttgagtgacatgtatcagacaggtgctaatttgatttcacttcaactgtgtcatccctaataatttcagactttgagtggaatggttagaatggttagaagtctgcagatcaagttctaccataaaaggaaggatcattaacagtaatttgtactggtgtagtatactgcagtgccgttctgaagatgatagcactgccatttcctctgggagacagaattcagcaatccatg

SEQ ID NO: 70270 - DNA, 886 bp, Oryza sativa
ccagtgatcgcagatgctgcaaatattcctcctgccagagaaaaacatttacatgtgaggtagtagctgctcgtttccagctctgcaaaaaccatcgggcacgtcacatactcacgttcaaatcagtatacatggaaagcttttgcaacgcaaagaaacagaaagcttgtccttaccgtcgtcatatcgtagatcatgtcatatactgtacaccacgattcagagaaagagacaacacagccggaatcctcatgctctttagtgattgatctttacgtctcagccatcagttgcgatcacgacaaaaaaagtgatcagcgtgcagttaaatcagcagcaatttgatgcattgcaaaaatgatattatagcgtgcaattatcattggatagcagcatggttaatatagggtaagtaacatttcaaatcacagataacagctgctacaggtagagcagacaacaagaactgcgggcatttcgactgaaacaacaggcatcagaattcagaagccgttatgctgtggcctatggataatgagaaaagtgtttgctagtagatttaatcttacagttgtgaatgtcaaaatgccttttgttttccaagcctctaatggtacaatgagaaacaaagaactggttttgctgaggctgtaggccgatctacttcttgatcttcttatcgtttctgccccttttcctctgctctctcctttcctccgagtagtgcttctttaccagcatcttgtgcattgatactttcagtgcagctagaactgaagctaacacctcttcttgctttgcaatgtcaagacttccttgcagcgccagaaggagcttctcaccatgtggcacctcactgtcttccaagactgtaggaacatgatca

SEQ ID NO: 70271 - DNA, 797 bp, Oryza sativa
aagttgtattgattgatagttatgtaagaatttataaggagtattgaaaaataaaactcattgatttactgaacaacggtaaataagaagataaaagtaaacttatttcaagacaaatggcataggctagagataaacttatttgggaatagggaagtatacattgctagatggatatgtgtcataacttaaccaagggcggaggtaaagtataggagggggaggggggtgctgaggaacccagttaagaaatttttttagctatatatcacctatttttcactatgtgttcaccccccctcagtacaaaagacttaggaacccacatcaacttaaatttgatctaaagtagagtaaattaagcaagtggtatccttctcaatttcattctacccctgcccctgaacttaacgagagtgacatctttatcgaaaccctcggtgatctattggcacttataaataaaaaccatatatagaattaaaggtgaattaagggttcgaccatggcggtgagctgattttcactaacaatatacttccattcttcatctaagttgacattgtttaggatatgattatacagtatcgaagcacattcatattattttttattgaagttattaataagatataactacacgcaagcatattaatgttgtttttagatattgttaacgccagaatttggtaagcccaaagtaatcatcggtctagagttagtatcggcttcagagtcttggaatcagccgatgggaatcgtcaaatcgccagcagttgtgttcttggtggagtcgg

SEQ ID NO: 70272 - DNA, 2111 bp, Oryza sativa
ttattcgctctcatgtaaaaatgatctatgcacaaaaattccgctcttattcgcttattttacttgagtcctttattgtttattttataattggatttgagcatgcattgattctccgtcctttgtcttctatagatggccgactgtcccctaatgcaccaaggtcagactatgggaggctttgttgcagagttgtcccgcatggcgtttgtgatcggttttccaagggagccgcagtacaccagcatccaccctctcagtggtgagttcccgcactaggtccacttggagattcacggcatacccacctacctaccctccatggaggtgacagcttgtgggggcacatttgagcatgcttgtgaggaggccgccctcagggtgatggcccatctgagggagctgcatgacgacactctgaacgccaccgcctaccgcttccatcctcgccgcggttccagctccaacaccagcaccttcaagtcagcttggggagagaacgatgtcaccttcggccacatgagtgacgtgatggagggctacgacaagctgcacgccatgctccacaaggcaaccaagaggctcaacgaccagaagcttgtgaggatcgctgagttgcaggatgagttgtaggatattatatacatcatttgtcccataaataatttcctgatcataaacctgaacagttatttgttcatatctattatattattaaaacaactttgaaaggaggcaccacgttcgctgtgggggctagaaattctcacattaatcggagaaaaagaaaaggagagtccaaatagaaatacaatttaaaaatagctgaaattcgaaattaaaaataagcaatattgagagaagagtccatgtaataacccaatacgagattaatcaaaattcggaataaaaataaaataaaatcaaaaattagaaaagaaaagagtccaagtaggaatacaatttaaaaataaatgaaattcgaaattaaaaataagaaatattgagagaagagtccatataagatcaaagaacccaatacgagattaattaaaattcagaataaaaaataaaataatatccaaaattagaaaaattaaaagagacttcaagtaggaatacaattttgaaacaactaaaattcaaaaattcaaaaataaaaatattaaaagaacacttgtattaattaaaatttgaaaaaaaaattctgaaattagaaaaagaaaaagtatttcaattaggaatacaatttataaagaactaaaattggtgataaaaaataaagactgttgaaagaaaaggccatctaaaacaaatgacaagataaattaagtaacatgcttataaaggagtagagtggtggcggttgatacgacatataaaaattgtcaataaaacatcaaatagaattttaataacgattaaaaggagggatgacaggcaggccgtgaagcaaacgggcaaggcggttgctgggacttctagaaagtaaaaaaataaaccccattgataatcatattcgatttttaaaatctcaatgacaataaaaaggaaaaacaacgggcggggtgtataggagtatagttgcagagccgacgacggttggcgggacttatagaaaataaagatttagaatcccaatgacaataaagagtaggcagtggatgggccgtataggagtatagtggcatcgtttaacaggatttctaaaaaataaaacccaacaagacagtaaactctaaaaactacaaagtccaatttttaaatgttcagaacttctaaaaagtaaaaaataaacccaatgataatcatgttcgattttaaaatctcaatgacaataaagaaagaaggcagcgggcgagccataaaagagtacaattgcaaagggccactgacagtttggcgggacttctaacaagtaaaagaacgataattatgttcgatttttaaaatgccaatgacaataaagagaaaatacagtggacgtgtcgtagaggagtataatggcagcgtttgacgagacttctagaaattataaaaacgaaacccaacgagacaataaagtctaaaaactagaagctccaatttttaaaggttttaaggagaatgaa

SEQ ID NO: 70273 - DNA, 12793 bp, Oryza sativa
ctaagttaaacttctcatttttcacccgaatttacggaaaaaataaacacattgtcatctataacattaaattagttttattaaatccatcataaaaggtgtcttcatagtgcattcaattattattatagatattgatatatttttctataaactcgcttaggacaaaacaaaattacgtgaaatatgtaatgaagggagtacgttaaagaaaaaaaatactgtagactgacaacaaaaacccccagcccagcccagcccagcccagcttagtgaggtgaacatatgttggaacactagtgggccgaatgatgagaaataggcctatttatatgttctttgctgtcgggctctgcaaacaaatcctactggatggcctacttcagatgacgcatctaaaaagatcaatcaatttgacagaatttattaaatagagaatttgaggacgtactttggcagcaaatcaacgtcagatacatacaaacagtgttactatttaggagttaaagtaggcatattctagcttttaacggatcgctgtctcgtggtctgctttctcctgcagtgcatctgcacatctgcattcagataataataatggaagagagcatcttaaggcaaagggggaaaaaaagaagagaaggatgtggagaatggaggggacaggtgagctgatgtgaatctgatccgatccgatttgatctagaagcaagtaaaatagcagtagggccggagatattgatgaatctgatgctaccactagtgaaacagtgagcaataaaatagtacttcacagcagggttcccttaccgttttggcggggttatcacacccccacggtcaggtggttaccccgctccacagtatactgccgcagctagtatggagtagttgagttttgtgtgatgttgtaatccgacaggcagaaaagtcttgcgatgcaaatatatctttgcacacaaatacagtacgtagtacgtccgcaacacaattaaccaacagcagcttgtatgcaatgtacgtagatgcatcacaagtaacagtatcacacacacacagacgtgacatgttcatattcgtaccgggaccaaattttatggatcaacaacaaacattccaaacaatgagatggctggattattacagagctggaccaaacaaaacaaaacacttagctagggccagtcgagcgaccacacctgccggcccctccatcgatcagaggcgcctcttattattccataaacctccctcactcatatgtagagatagacagatagatttgatttgatcctgcatgtatgcattgcatgttatgagtttaacgtatacttgcagtttgaaattaccaacaatgtttatgtagctagtgagattgtctgtttgagaaagaagaaaaaaacagagcagagatagtgtctgagaagtataacttacaccagggaacaatcttccagcgctggttgtcaccctcgcaccactcccagagcaccagggtggttccgtcgcgcacgccgccgtggtccttgtctccatggagcgcgtcgaagttgaggtagatgttgttcaccatcctgatgcaccgaaacccactcccaacgtccctgctctccgtccacagcacagactcgtccatgtactctggattgtagcgcaccaaacggacctgtccatccatccatccatccatgacatattatatattcctcctagcaattcttcactgcagtacatactaaccagagatcttacaacacttaacttattgaacgggagttagcgagtgattttacttaactttcgatcagcaggaatggtacagcttgagatcccaaaattgtgttcatggcaattgcatactaataattctttttcacatgacagacaagcacatggacaccccaccccaccaacatgcatgcggcacatggatcatggatgggtggatgccaatcccgaactatcacagatcttaagttgttggttgcgattgtaaggatgcagtaacagagtctcgcaatattttctagacatgacaatgaacatgcaagcatatactattaattgtcccaaccaaaaggaagataaaatagtatcaatggtgcgagcgagtagaagacctcagactaaaaaggatattttaatcctagtgatacagtttggacaagttgtgaatagaaatgtgatattttagtcctgtagagtagcaaatccttaaattaataattcaattccaaactggtttaatgtaggcaagctaatttggacttgcacggacggggtgacacgcacgtctctggattggtgttggttggcaaaagattgtaagagaggcagaggaaaagaggaaatacgtacagggtgggattggccgatggagtgcttgagggcgtcgccggtggccttgttgacgagcgccatggcagggtacccttcctcgtctttcactctcgtgctgtacttcatgtccttcacccagtgctgcatccatcatcacataaataattactagcaattgttttgactgaagatgagggagggggatgaatcgcgcgcgaaattgaacaagtagggagggaggtaggtacctgcgtgtggtcgtcgcgatcggagcggacgaggcagaccttgccatctctgacggcgaggctgtagttgtcctccccggccttgcagtagatcctgtgggtcaccggtggggctcctccgccaccgtggtaagggcgggtctcttggacggggctgatgtactcggatccaccgtagtgcggcgtgggcctctggtggtcggagacctcgtgggaaacgtggacgacgttgccgtagccccctcccccatacgccggaggaggatgagcgtagtcgtgggaaggcgggtggcgagcgtagggatcagccggaggaggcgcttggccgtagggacccggcggaggggctgagtcgtggccgtaggcgggagcgggagcgggatggcggcggcgatcgtcgtcgtcgtcgtcgccgcggtggccgtggtggtggtggcgatgagggaactccatgatggatggatttgggggaatggaggagatttattagagtcaggaggtctagaggagagatggccggcgcctccaatttatgattgggtctcccgtcccgtccccggccccgcgcgggtacccacggcccataatacccccggtaatcgctacagttacagtgggctcaatcacaaaaagttcagagaagaaatcaatcaatccctcaatccaagcatgagctatcacagtgctaggatggagatcgacgagaacgagacacacgatttacaaataaataggactagtttactttgcatgcgtacagatacagatgtggagtaactagctagctagtctccttgcttgaagaaatagacgtacacacaggctatatgtgtgtgagaaagataggacccacatgacaggcaggcagttaccgggtccccatccccgctcacccgatgggtatgaatttcgcccgttaacatccccatggggattatttctctcctgttttggcaccctagtagaggaattccccaccgggtgacggggaacggggccccattgccatccctgcaacttggggttattcacaccatcaacatctaaatcaatccaaattcacccctaaacacgtctaaaataatcagccattcgtatttcctcgattttaaatatctatgctaccctttctgtactcctttgaaattatgtagtgacgatgacagccaatctaccgtcccactattgcttttgccgcttgtacaaattgtcccacaatatcttttaatatcatagagtactctaacatttgattcaaacgagtgaataacaaataagcaaataagtgatactagatattttttatgatatatatattatgatttttgttgttagctagaataatttattgttgagccattttgaaaagaaggaactttgtttaatagtaaatggttgtgagaaatattacattatcacacaatgaaatagaaaagtgatttcagacgtttaaagtcgatctagacattcccatagtgagttgctggttttcgtatcttttaagcatgtgttattagagagatgtatctgggtggagtatgcgcgtatatgtcttatatatgtaactaaaataaaatatacaagaatttctgtatgtaatttcatgagtaatactagtagaaactagggtaattgtgttcctaccattattttatagtttaattatgattttgctcctgttttttgggtttgtgattttgcccctactttttaagtgaagcagccgtctgcctctactctgttaactcatggtaacggtgttaaatgtgtggtgaatggacaaatatacccctactattgaaatcaataattttggcatcaacactggacatgttccaagttaaatttgtgcgtatttcaagttaaatgttgacaaattttgtaaaagttgacagaacacaatatttaggacaattttcacagaattttagcaataattttaacacaatttattatgttaacattttgaattgatgacagaacttgtcctcacagatatacaaaccgaaagttcggttaatcgatacttcggtctcgatcatcggtctgaccgaccagactgaagtatggtatgcaacacggcatgaaggtagccagcttcgatccaaaataacaaatcaagaagatcaatcaaatgaaaatccttgcaaacgaaagcccccaaactagaactcacaagtcaatacatcagcggcccctcgtcttctgtatttccatggcaatcacaaatatagagatagcaaaagggagaagataagagagacaaagatagccatgaactcagaaacgaagagaaattatacacaagtataaagtgttgttgccgtgtaggattagaagctctgggcccttcccctcgaggatgagttgctgctgctcgatgaggaagctgccaccaccatgtttgcggacaaggacgtcgacgctgccgcggtggaccgtagcgcttgtatacgtggaggacgtgctggggtggtgacaagtcggtgcgcgcagcagccggcggctggacgccgggcagtggcgacgacggctgacgagcctggctgtgcgcgcgcccgccggtccgcagcgcgaggatgccgctcctcttcgccctccctaccagcgcgcaaagcgccgccgtccctctccaccgcacgctggcccgcggggccgccgcgcctccctgccgcgccctggccttcgcgcgccgccgcttctcgctagggttctagatcttttcgatttggggaaatcgttccagcaggttggctctttcagtgaaccaagggtaggatggtcattgacaaattagaatatcactttcttttttcgtttaattcgaaaattctaggcccacctaactaccgtcaaaaccagaggcagacggctgcttcacttaaaaaaagcagagacaaaatcacaaaccctaaaaagcgagagtaaaatcacaattgaactgtaaaacaagggaaaaacacaattacccctataaactaacgaaatcttagatagaaaaagaaaatcaataaaaggcaacacgtagtacgttctaccgatcgatagcaaccttcgtgactgaatattcatgtagtacagcgtgagtgtgaggtggcattaatttggtggatgaagacgccaccctcctcgaacgtacgtgaccacccccaccaaattacacgtcctcatatatcaacgatcttctcttctcttctcttctcttctaccactgctctcccagtctagtactccctaaaaaacgaaaagttatggttaaaatactatagataataaagtaagtcacaaataaaataattaataattttaaaattttttgaataagacaagtagtcaaatgttacaattaaaaactcaaaatcccttatattatagaagagagaagtactgtcacaacaaaaacatacacacaccaaggacagctcattgctccacctgatgaaaaaaaattctctgcaacaccccccagactagtggcgcgtgtccgatatctgctgcatcggaccctctttggagcagagccgagccgagcccatcctgctggcgctgattagagccaagctgtccaggaccaggagtacatcgagccgcgccgttttggctgtctttttgcttctgcaattcagaccaaatgaatttacatgatgctgtacaaatatatatggtgttgtgaacctctcgccatctgattttaaatctccgaaacaacaaaaatctccaaaacggatcaactgttggtaactttttttttcattctgccaatcatgaccaatgcttgcataaaaaatgccctattaaaaatctaaaccggctaaaggacactatacagaaacaatttttctatacgaaaacttctatagtttgcaggcagacaggcgagcggcggtagccggagtggcggcgggcctcccccacgtcgctcgtgaatccagtggttgttggatgttttatttcttttgatttatgtaggtattggtggcataaaattggcatttaacagccgccaacagcgatgccggccgtcccccacctagttccgacggtggcagccctctctcgcccggcccgcgcggttccgccagcggtggcgagaggagcccagagaaggaggggagggtcgacgacgacaatggcgggaaagtccctcacctagctagggttttaattttgggggatttttattttttttttggattttgatttttgcgtacgcataagcacttgcacgcgaaaattgaatttttgcgtgcgagtgcaccacccgcatgaaaaaataacgattttcgcagaaattttcaggcatacggacgcctcaacagcacgcaagaataggttttgctcgtttggaaaaatgtttttttagtagtgggagccgatttaggccttgtttagttcccaaaaatgtcacattgaatctttggacacattcatagagcattaaatatagataaaacaaaaaactaattccacagtttgcatggaatcgcgagacaaattttttttgagccaaattagtccatgattagctataagtgctataataacccatatgtgctaatgatggattaattaggcttaataaattcatctcgtggtttccaggcgagttgtgaaattagttttttcattcgagtccgaaaaccccttccgacatccggtcaaacatctgatgtgacacccaaaaattttcttttcgtaaactaaacaagccctaatacgaaataggataaacatccgtctcgtgaatagaacggaaggtttttgggacagaccggacgacttacaaggcaaaccgacgaagatggataaaactagactaaaacttggtaaaaagtagatgcgatatttaaaaagaagttagaccagccgggtcttttcaaattcgatcatacttttctattcccgttctatttgtcaaatttagatgttaacactaatatctgaatttaaatctccaaaacggtggaaatggttgataatttaaatctcgtgatggcaagacacctctgtccacttgaccctagaaaaatccccagaaatattatcaccaatgcttgcataaaaaatgccctattaaaaagtgaaattattcagactttatgtgcagctggtagatgctgctcggtggctttttcaacgatcaagtggacagaggtgtggggtaggagatcggacatcggctcggctccgaagctagactcggctacagtaggaatattggacacgcgtcactagtctgctcggtgtcgcatgggtggtgtcgtgcactcgtgcggcactgccgcagagaatttttttcccacctgattgcattcgattttgaatcttttttccctttttctaattacacggtaggcacccacgcccacacactattacacacaccaaggaatatgtctcctaacacgagacaaaaaaaaagcagcagtatatctttgataacactagaaacccgccgaaagactatgtgtatgtgtgtaatattagtgggcaccaggatttaaactatggctggtgatgccacccactcatgactctgccacaccattagtgcattcgattttgattttgattcttgttcttatttcgactttaattaatttccattcttgctcatgtcttctccagcctaaagtcagtcatctaagaaaggaataagttcactttagatctctcatcttgacgtcgagtttggattacatcctcgaaccacagtaccagatataacaaattcctaatcttataaaaccaggttaaacgaagtcccaagacagtatcaagggtggttatgactcacgtggcactagaaacaaaaatacaaaattaaaccctatgaaacccacgtgtcagtgaaaacaatatattcttccttattactctctctcccctatctagaggaggagaaccaggatgacgccttcaccgacagcgggctagagcgaaaggacgcacagttgctcggcaagtgcgttgtacaagtcgcgctgcgggatgctcggctcgacaccatcgccaccacctagctcctctcccgccgattgcttgtgcgctgcccttttccttgtaagccatcacccaaagatggaaaagagagagaaagagaggtggaggaaggaggaagaaaaaattggtagctgatatgtgaggcccgtgtggtccccgtcgattcagtcaaaatcatacataatactgtcttgagatctctgttaatttagttttgtaaattagagaatgcgttacatctcatattatggttcgaggatgtaaaccaacctcgatgttaagatgagggacctacattgaacttaatcctctgatacatgatctatgtagcgtgtaaaggccaggccggcccactattcgttcatattggcccaggacgtaatacatggagtattcttcattgtcgtctctcgcgtcgcggcattcacttggcccatataagtaaatggagtatacggtgttactactaggaaaaagtacatacaaggtccctcatcttgtcatcggattacaaaatcgtcccccaaccataaaaccagatatacatcatcccttaacttagaaaaccggttcacttttggtcctcaggtggttttgaccccggttttgtctgacgtggcagctgagttagctcaagccccacatgtcagtgaaccctcatcctcttcttctccctcctctctatcctctctctcccctgcaaatgggcgacaggacggagtggcggcggtgggcagtgcggcagcggcggagcaggtgggcagagcaggccgacggggcgcccccaccataaatcccacctcctctagcatcggggacggctttatcagtgagaccgccgccggtggcttggccatgcgccgcggtgtccatgtcggctgccacacggcgaggttctgcgccgatgggagctgtggcggaggcgagaagtggtgggcgtcgctgctggggtggtcgggacaggcggactacatcaacgcgcagccgacgtcgaggaaggaggcgcggccgtcgatagggaacccggcggcggagcagcagggtggtgggaagaggttcagtgtgctgatggaggagaaggcgtggcagccgcaccgacttgctggcatttctccccatgcgccatcatcgaatctgctggcgaatcaccgctcgacgacatggaagtgggggcagcgacgaatggtgttacctgggaggcgctgccggcgaggtagatgacagcctgcgcgcgagatgagtggatggcctccaccaccgtgcggacctagctctccattgtgcagtcgcaagaagttgccactactcctacggctgaactcccccgtcggcccgccttgcccacgcgcagccatggtgcccccgatagcccgtggttcgacggtacgctcatcctcccttccaccacggctataaagccagcacgcgcgcgcactccatgtcgctgccaccatgctctacatcaaccgccgtcatctgccatgtcacatccaatgtggattccacgtatggcagccacgtggcttggacgatgcttgtcactagccagctggaaagcaattctgtgacgagcacctttatcatggatagaagcatttctatgacgaaatctaccgtttagtcatagataaacttatgtgacgcgagttctacgacgaatcctatttcgtcataagttcatcatagatgttactttacgacgattatcacatcttccatgacaaaagtagattgtcatagatgtgctgatctctactagtgcatcttcagtgttcaatcgaccaagctgccaccaccaccaagctccttgtctctccatgaccccatttcactcctcgccggcgcccaatgaccaccaccattgttttccccaaatctggccaccaccgccgccccaaatccccaaatccaaagttccaccgcctccacgctgagagcccaaccgctgctcttcctgccgtcgctcgtttgcacttgagggccacttctccaagccccacccggccaccgcccttcatcgctggagccgcgaccaccgttgccttgccgcgcctcacgttgttaggcgcgagtgagaagaggagcacgaaagagacaggagaaaggagaggatggtgacgtgtcatactggcatgtgggtcccacgctgactaatctgccacactagacaaaactaggttcaataccacctaaggacctaaagtgaaccggtattgtaagttaagggatcctgtataactggtttttgggttgagggacgattttgtatctcggtgacaaatgagggacgtcagatgtactttttccttactactattaatttcaccatgtacgtactgccctatacttagtagtactgcatgtcttcatagtagatttaattatagagagattccatgcgtgcacctgatctgcttgcttaattcctcagtacgcacgtatacaagcgcttgtactgatcagctgtcagcaagcaattgatacctatatataccttacatatacacttgctaattattagcttgattgtgtctttccattcatatatagatcaatatacatcatcatacatataaattaatggtttgtcatattcaggttcgacatcagctatgagctagatatatatatagcggatgcgtgaggcaataacaatcgacaactaacgtaccaacacaagtatgtatgtacatatatctcaaattaatccacaccctttttaatttgctaccttaattatttcgttctcggcctataggaagaaatggctttgattactaaattaaccttgcaactggccggttggtcaaacatgcatttggttgagaatattctccttctcatataagtatatcaatcggatcgatgcatggtttaattaacaactactagctagcttgattctactcctagctaggtaactttcacaagcaaacggttaggtaacagtacatgcatggtttacgtataaactcagtcattctctttatatatatatatatatatcgatcatcgatccattattgttacgtgtgagaattctctatctatatgatgcatatacatatatgtaacgggaccaattggcacgtaattaatatctgtcacgcgcaagttatttactcctaattaattaattaagctcgatcggtgaaggctaatcaatagaaaaattaattagttaccctagctaggacaataacttacaaaagcttctgccccatcgcggttcttgtgttatactcccctggttttagcgtaggaacccattgattttgtgcatgcataacatttgatcatttatcttatttaaaaatttagtataaatatgtggaagtataagttaaggttataatttttctgatgataaaacaagtcacaacaaaataaatagtatttatatttttttaataagacaaatggtcaacgtcacattaaaaatcaatagcatcgggcattaaaaaccaagagtaataaaaaactagagttcagaaatccacaactctcaccctagctagttttttctttaaataattcacccttagctatatatattatgaaatttatacataataatatataataattccacccttcattaaggttgtggacgtttagttcacgccaaaatttaaaagtttagttgaaattgaaacgatatgacggaaaagttggaagtttgtgtgtgtaggaaagttttgatatgatggaaaagttggaaatttgaagaaaaaatttgaaactaaactcggcctaattgctgctggatactcggacaacctgtgatcgagtatgcagtattgagccaaccgtctaactttcatggaattgaagaaagccaaacctttagtacggattctgaattgcaatatgatccatgctagcatgcgtgtatatgaggatcaaactagtgtaatatattaagccatccgaatacatatatatttgtgttaattcccagagacaattaatttgttgtaaaacactgctatatatttggcacatgattaactgttacttacaacgacttacaacaacgtatataattgacactaattgctagctatgtactccagtacacatgtatgtatgtatgtacattcctgacaattaatctattaattaattatctatcagtttgtgatgaacaagaattcaattcaattaaatccaacccctccaataattgtgaacaagcttgg

SEQ ID NO: 70274 - DNA, 2614 bp, Oryza sativa
ggcctccttcttcttgtagattctgcacagcacccactcgtccagctgcgtacgcgcatgaatataattgcgcatatatatatatcgatcagtggatggagtatatggaagaggatatatatatatgtagttagcactagcaccgtagcacgtacgtaccctcatgctggcgctgctggagctggacgatgatgatgaggccagctgcttcatgttactagtataggaggaggaggaggaggcggcggcgttggcgaggcggtactcgtgcatgatccagctggtcttggtgcccttgggcgggcgaccgcggtagaagacgagggccttcttcacgcccagcagtaccgtctgctgcgtctccgagatggagatgggcttgtcggttccggtggccttccagtagccggagccggcggcgcggttgggacggacgccgttggggtacttgcggtcgcgtgggctgaagaagtaccactcgccatccgactccccgaacaccgccatggccggcagctcccacgggttgtacttgtaaatgtccacctcggcgatcaccggtgccgggcagggcgccgccgcggcgcgcttgccgaggtagtggaggaggagctcctcgtccgtcgggtggaaccggaatcccggcggcagccctgcccctgctgctgtgtgatgatcaccgcacgccgccgccggaagctgcaggtcgatggtcatcatatatatatggatatcaatcaattaatctcgtgattgatcaatatttgaatgcaatcgatggaagaagaagaaaaggatagaaatttgagagttgtggatgggggcaggccacctatatatatacacctagctcgatcgatcgatcgagagaccattttattatatataattcctgagtacatacgttaattaattaattaattcttcctcccaagtgaatacataaagtacgtatgatctagtacagtgatacaaatgtcaataccatggggttaattttgtcaacagtacgttgtatatatctattgtccgaaattaattacttactagtaaagttttatatatatttcttccgacccggccgtaaaattcaatggtaagagattgagactcctgttggagcaagtttaatagtatagtcaactactagctccaaattatctatagccaatgtaatagccaattcatataatagttgcttactatactattaatacctggtctcacctgtcatacacatattacgtattagagtccgtgctgcagctggctatatccgctgctcttttctctctttctttatctttttaaaatatgtttataactagcttatataacctgcttctgtacttgctcttaagcagcagcaacagcttgtgtatagtatagagaagccttcgatccgcacgcccagcctctagtactagattggtaaatacagtcctacacacttaattacttcctccgtaaaaaaaaaaaagacaaaccctgatttccgtggccaacgattgaccgtttgtcttatttaaaaaaattatgaaaaaaattaaaaagataagtcacgcataaagtattaatcatgttttatcatctaataacaatgaaaatactaattataaaaaagtttcatataagatggatagtcaaacgttggcacggaaactcagagtttgtttttttcttgacagggggagtagatttttagtacagttccggccagcacccatgtaggagtatattcgatctacaagctaaataattgttatgttgcatgcatggtagcccaaattcgcaggaacataagtaggagtatattatatctttgacagaaacacaagtatttcttccgacgcgcacccaccgcgccggatatacatacgtatatataccggcagagtacatatatatgtaacgtgactgattcgattcgatcggtcactcaaccggaatcgacctccaaacgtgactaaattaagatgcatggaatgacacgcaatctcttagtaatttatactgttcggttcggttcaatcaccatcgccgcgcgtaaatcgaattattcctactctatctacctgggccagcaaatcaggcctctcttaattggctcatcagtttgatctatcatatcacaaaattcaataaaataaaatcaaatcaaatgaattgagctacaccaccatcggctaatcggctatgcaaaacctgcagaccatgcaacatttccaaaattatgtggctaaattcctgcagaaacatcaattaggctgtgttcgtttgtgtgagatagggtgagaaaacacctcgttttccgcgcgcacgcttcccaaaccactaaacgatgcgttttttataaaaattttctatagaaaagttgcttaaaaaaaacacctcgtttttcgcgcgcacgcttcccaaactactaaacgatgcgttttttgtaaaaaatttctataggaaagttgctttaaaaaatcatattaatccatttttaaaatttaaaatagtttatactcaattaatcatatactaatggctcatctcattttacgtgtcttcccaatcttctagactaataaactagctagctgtattctgcacaagtcaaatttgc

SEQ ID NO: 70275 - DNA, 625 bp, Oryza sativa
acacaagagtttggcaagatccttaagctatcatcaaaatcatcagcttcttgctgcactcaaaggaacaacacctcaatcaaactatcaaaggtagaagatgaagaagaagaagaagaagagggagaagaagacgagagagaggttggtgatgaactgatgatactaataagcatatagtagcacaatggggaggttgggagggtggcgatcttaaagaagccatctcctctcctcacagtgaatgaacatgatgtcagtgttggtttgtgtgtgcttgcatccaaaggggcaggtccttatcctgagttttttttctttttctcttttgtttttacacatctttttcattggcaatggtcctctcctcctgtcctggccatgcttctcttgctgctgtagtgtgtgctgtgctgcattcttgcgctgggtgttactgtccccgtttgagcccatgcacgcgcacacaaatggtagattccgttggtacagcaggtagatttgctgtcgacctatggaaagatgcgaggctctacgtcaatgaaatcattcatctcatgctgctgaatcgctgatcagatgataatttgagatgattcatcagtggtatagcagtagtagaact

SEQ ID NO: 70276 - DNA, 1122 bp, Oryza sativa
ttgggttttgcccctctctcccggtcgtcacttcatccagcacggggacgatcggagccatccattagatcggacggctcagatttgcccagcgtcgggccaccgccgccgttgattacgctgcgcccaacgggccgcgaaagtgcatcggaccgtccccacatatgtgtgctgcgtcagctgcttggcctgcgagccgtcgaattgactcaactaaccaaagatgggccagcccaagtttggcccggttgggaagacctgggccaatagcaaatttgatcaaacaatgtggctcagattttttaaattaaagtccgtcagataaactcataagtagattcgaaaaataaatctaaaactaaatcctaaatcctatgctaatttatcaaattagactcggtcctacctatttgttaatatatcaaattagacttgatttttaccgttttgaggttttcaaggtttcccactatcgaacggtgtttttcccgttgcaatgtacgggcactattgctagtaaaaaaaaaaagctgaagcccatgacgccatcttaatcctctgctcgtactgtccaccaactaacaggcacttgacctccgccagtccaatcatacacagccacgtgtcctggcacttcaaaagttagttaatgtgttcaaccaccagcagctaaaccccgccaacctttgcttcccgccattaatttctcctccctatttatgctcccccatcctccgcccaattcttcccccaaaacgcacaccccaatccgatccagaattcctccgtcgcgaatcctcccttgtaccctgttcgatctcgtgcgcggcgcggagcggcggacgacgacgatgccaacggcggcggcgatggccggagggatggcgacggggccaggcagccgcgtgacgcggtacgccaagtcgacggcggcgtcggtgacgccggtccgccccggcaagacgcacgcgctgtcggcgctggacaacgccatggagcgccacgcggtgtacctggtgctctactaccgcgccgcgccggggctcgacagggagccgctcaaggagtcgctgtccgacgtgctgtcgcagtacccggccatgaccggccgcctcacgcgcc

SEQ ID NO: 70277 - DNA, 1166 bp, Oryza sativa
atagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgattacgtaaataatgagagacgctatttactccgctagatcagccaccttctcctcgccacgtacgacacaagcagccactcgcgcgcacatggccacgtcacgcaaaacccgcagaattacgcgattcgctgagcccttttctgcaaaaacacgcagcctccctcttctccccaatctagcccgtgacctcctcgccggggctacttctccatcgccatcgacctagacctcgccgcctccttctcctcctcctcccgtgcgaactccgggctcgtgccgagggggtggacgcgccggtggtgagagcgaacgcggtgcggtgggccatggcggtggggtggcggccggcgatgctggtggtggtggtgacggtgacggcgtggcgcgggaaggcgctgtcggtgacggtgaccgacacggagtgcatccacgagttcgtgccctacgagggggacaccgtgtcggggaacttcgtcgtcgtcgaccacgacatcttctggagctccgaccaccccggcatcgacctcacggtgcccgcccccgatcctcctcgtcttcgttgtgcttttgattttcgatgcaaggatctataactagatgggtttatgggtttgttttttcgtgatctggggcacgctggattggggatcaggtggaatcgtggtcctctttttgcgatctgcgatttcgcggtgcaaaagtttggggaaatttggtgatatgaagatatttcatgaataggtttcgatttgattttag

SEQ ID NO: 70278 - DNA, 688 bp, Oryza sativa
aaattgatttttccatgcgggtccttaagtggtccacatacaaacaaatgaaaaaaattcaattattaaaaataaccactcaaatttttaaaaactttcatgttcaacccaaaatttaaaatattcaaccaattttcaaaaatttcaatgtgcatgcgaaaatttcagtgatgcacattaatttatttgttttatgataacataaatttgtatggaaagtaaacacaacattttctatctcccccttgcccttataaatagagataaaatttgaaaatggtgatgttttgtttttgaaaactaatggctacagctcttccttgatttaagaagcttattttgaggggtcttaatattttgataattattcgttagcgtattcgtttcaattcgtattcgctccatacctgtattcgataatattcgattccgttttcgtatccaggttttcgattccgagaaaaaaatatgaaaacaaatatgatagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgt

SEQ ID NO: 70279 - DNA, 679 bp, Oryza sativa
atcaaaatcaaactacttaactataagagtaaattgagatccgacaataggcaggaaggcgagccacgagcgaagagaggcgttccttacttgagatcgaacacgcggagctcgggcccgacggcgacggcgacggagcggccgagcgggtgggcggcgacgagagccggcgcgaactccgccgcgccgccgctcacctcggcctcctcgaccgcggcgtcctccatttgcggcgagcttttgcttcgcgcgtgggcttttgctttgcggtgggattcgaatcgagcgcgagaacgcgagatgggagggaggcggggaggagggggagttcgcgaggattagggtttatgagtggctctctcgttgggcccaccggtcagtgtctcggttggagatttggaggcggctttgagattgcagcccggcccatgaatacttgggcctttagttaaactcgagaagttttcttagatccactcaaaactcaattaataaattgtttcaacatccaaaacctctgctgtatctagatgccatatgttgttttttttttgtatttacaattttgccactggtttttttaattttgtaaggatgccaatcgaacaacagttctaattgcattttttaattatctggtggcaatcctacaatatatagatttaacccagtggcaaat

SEQ ID NO: 70280 - DNA, 716 bp, Oryza sativa
tgaaccaagtgcgatggtaccttttcagagctggaagaacggaattcttcccagaacctcctgaagtccaactccaactcattttttcccctgcaaatacaaggttaagaacatttatttaacaatgggagtacaaactgagaaatttttgcaggaaattcacttgaaacagcagataaaattctggagaataattgaagcaaagggatcaaatgcctcgttttgtcattcttagtacaatccatgcatcagaaccatgtgatgcatatataatgtgaatgcctgacatgacacctacaaatacatgaactgccatgcaaggattggaagggcaactagccaactaacaagtacgagagagaactataacattatacaggctctaatattatccctttcccagtgccagttaccatacaatacaagtttaagttacagaacaccttgaaacaacgcacacaacgaagttaccaactttaacaacataatatctagtggtagtccagagtccagacaaagccacaaaggaataaaggatgagactcacgatatctcattagtaatgcaattgcaaaagtcactattctttcttggtaggttaatgatatttattgaatgctgaagaaatgacaagagaacatctgaataaagaaccaggtatcaagcatatacaaatgaaaacagctcataaatctccattctacagtaaaatatag

SEQ ID NO: 70281 - DNA, 3440 bp, Oryza sativa
  unsure (1)..(3440): unsure at all n locations
aattggatggtgtggttaatttgaattgaggtcagttcagtttgatcaagacatggatggtgggtgctgtaaggtcctgagaaatctggtcattgtttttctttttcgaaaaagagaaatctggtcattccgtcattgtatttgtaccgtaaaatattaccactaaaatcttgacttatacagcgagaatactcactcccgggcaaccaacgtgaggcgtcattatcgggcgctccccccggacgccacgtgccccctagcccaccatgtgtcatgctcccacctgtcatgtgtctcaaaaaaaagttttatctagtatactcacaatgtttcactatgcatagatctaatgttacagtgaattgaaaacattcttttgcaacaaatcaaccacatattttagaaaccctctattaaggaattcgtttcattttttgttacaccaaaaatgtttcacctagtgtacttacaatgtttatctaatattgcactaaacgaaacattttttcccaacaaatcatccacatattttagaaaccatctattaagggaatacgttttaattttttgttccaccaaaaatatttcacctagtgtggatcaaatgttgcagtgaactgaaacattctttcgctatttgctgaaacgttgtttttttatataaggtgaaacaacgtccgatttaaacgattgaaatattttcgatctacttagtggaacaattccgatatacctgatagaacatcgtgcaacatttaaaaataatttaataataagctaaaaaaatttcatcggaatatatccatgtatggtcttattttgaagatttaattacaatgaatttaatggtccaatcggatcatgatttggataaataatttaagagaaaaaatagtttaaagtgtttttgcacgcatcgtctgattttaaccccctctcatcgaacggagcgagagtcgcttcccttatacaacgatgagacagccagatatatttctcactcggaacccttctaatccgtttggttgggggagcttttagaggaccgaaagtttagaggatgggggtattacctattctgtttgattggagacatgagatttttctttatgaggctggaaaattgagggataaattcctacttttcaataacttgtaggagtggtatttggaagagaattcctccttgagaaaaaaaaagtgccgtcctgaaaataagcctgtcaaaaagggcgaaaaaaccgttagaaaaaactaaacagtctaaaaaaccggtatataccacgcaagataaaaaaaactacgcaatgcgggaaaaaaaaccagtccgattgcacgcaacgcaagaagaagcccatccgattctacgaataaacttaaaaaaaacacgtaaaaaatcgtttcacgaaatgtaaaaaagagtgattctcgggaaaaaaaccaccatcaaaaaaagttcacgaaaaaaactattttgcagcgttaaaaagaagtctgattctagaggaaaaaaatatcgtcccaaaaaaaacaggtttggcaccacaaaacattatatatatctctatttctttcaaaagcgaaacctgtttttttattcattaatatcttcttcggatcggtttctcgacgacgtactttttggatttttcatacatgcgtcaacgtatttttcgagtactgcgggtatcctcggggcatcaccaaatcagtttagatcaactgcgagtattttgtatgttggtagagatcacgtctattggcaaagatcaaccgcattggtgccgatcaaatacgacaccaacgacgcatcaaatactaacacggaacagaaagcagcagactgccggcacaaggatctctgttattacagtattactgatggactgattgttaagctccaaatagccacagacaacagaattttttttgaaacccgacagacaacagaatgcaacaggctgcgagacactggtctgaagaggcaaagcacttttaacttcagcttccttggcatccgccgaacgctccgcgacaacctttgacatcccaaacatctgagatgcgaaacatgaagcacaagaaatgcttcatcatcaaaatgtccaaaatgcagaaagagcaaagaagtgcagtatctgagtgtttgcacatctgaccttttggatggtgtttgaagcatgtcttgtgctcatccatggaggcatggatgaactcctcgatatggtctttcagatcttcgaggaaagtagcgccatcagtcctcttccggcaacaagtcatggatgggtttttgggaactgaataggcagaatcttgaggttgtgcattgctagattccatcttaagcctgaaaaagaaaagtcaaagggaagttgattagtatgagtctgaagaagacatcaacattgttagaataggtgcaaacacaagaacgcatatagtagtaagtatatagcagaaatgcagagtagcagcggcacaaaattaactgactgcacttcagttatcaaatcatagatgctactaccaaacagatttaaaggttcacatttatttttcaggtagaaacatcagtagctactactcagccaaccgtgtccaaactacgacggcctagaattacaaacaagatgacgcagcaaagaactactcactgatcgataagatctcacagctccaaaaattccaccatcgaatacctaagaggatttacacttgtctcaagttggttatgatcagatgcgagcccccttcactgagattcgactgccaccggagtcacctcccgcccttccctggagctgctgcatccttgaccatgggctcgaccttctttttgccaaacacctgaaacacatcacaggaaacctgcagattatccctcaagatccatcagaggaaacagcatgttataattagctatcaaattacaccataaagagaagattgaattaacttcaatctgaaagaacagagaacactaagtatagcaagaacagagaacaggagtactgccatccgttgnnnnnnnnnnnnnnnnnnnnaattagagtgtgttgctaacttgaattgcaaatgcttgtatacactactgcagttaactaattgtctatgtcaaatactcaggagatctcctcacaagctaatctataatttgccactaattcaacgtgactgctagcaacaaacagatctagatgtacgcacaggttaatagccaccaccaaatgactcgacaacaacaacaacaacaaaagcatcacaaatccacagggaaaaaaccgaatgcctctgctcctctactactcaaatagaacagcactgaaccccaccacaaacgacgattcaaatcgcgaacacaggaacccattcacgcaggccttcccataaacacaacgaaggcactaatcgaactcacattgctgcgttgttggtaa

SEQ ID NO: 70282 - DNA, 7896 bp, Oryza sativa
ccgccctcgcccgcccgcgtgccctcccgccgccacccaccactgccgcccgccgactgccgccgccgcttgccgaagagaaagaaagagagggaggatgaggaagcatggtttatgtgggtcccacccatactttggtggatgacaaatgggtctcacacatattttttatttctaatgccacctaagtgccacataggcgccacgtcagcgaaaccgctctccaaaaccactgagggagtcaaattgcaccggttttaagagttggagggtcgagatatccggttttgtggtttagggttacgaattagatttcgatcactttgagggtcacaaagtgaacttattcctttcagctactgcggcttatcctctgtggaccacactactgtgatcttctttcttaacatacagaggcccatttttttagggttctggagacagtttgacctccacacagtttgacagatcgcaatgtcttttgacacaatgtttaaaacatgcaactcaaatatgtgttcatatccaaatcggacagtacgagactcctctggtcactttcattacagatgaaagtcagacctggcagaactaattttcacgatactggaagattggtgcatatatactttattcattattgtattgttctggttaagagtttctaacatgtgttacatacttactatatgatacttgtatttttttaattagatacggagatagtacttgtaaaagaatttcaaaataatgagtacttatgtaactgtttaggttaccttcattgctcgtgtaaaaactaattaataatagtaaattacacctttcactaagcaaaatgtagtccatcattccactacatctactaggtgatatatgggcttgtttggctagttgcccaaacgaaccttacctaaaatttgacatattttacattaccaaatttagatgttgtttggtttgtcttactaacttttgattgtgtttttatgagaggaaacttccggaattactaaagtttggtaggataataatggtaatattatgtttagtttcttaccctacaaaaatttgatgatttaagagtaaattatattagtggtatataaattttataggcggatgtaatctaatacacaaacttgcaagatgcttatttcagtgcacagacttgcatggtctgtgtgaaccaaggctaagcatgcatggttaatcttactgagttgaacctttattaggatgcaacatatgtacacatatcaggatgatgccatctagaaacatgcatgtgctcagttaaatatataatagtagatgttgattatacaggggaataatatatagaagtatgaaggataaaatgaattgtaaacaataaaaaacacaaataaatactaagtagaggtcattcacaaatgtggtatgccttttatgaccttttgatgcgtgcgcatgccattgtaagtaggtttcaactcacaattattagtcatgacgtgtcgctccagtattgtttcgcacgtactggacaacttcatacactaaataggcagtttgtaagcttgtgcattaggtggcatgcacctacctgtaaattcgtgtacaaccagtgcaatttacttgtaatataatttaaaaaatttttaaggttgaaagtggcaggcgcagtgttctcataagatgtctactagctatatttattagctatatttattttctagtgggttatttgtttaattatatgtagcagatttgggtagttaaaaatttgatacaatacattatgtacaaaggtatatggtaatttaaatgtcacttaataagtggtatattaaaccgtctgtttaaatacgagtataaatgttcattccattatttaaaaaaaatacgagtataaacagcggacatcctcgcccactctgtcatcaggtgtaggattagcacacagtttcgacgagacctctgtatcagcagatggataaccgtgtcgtcaggtgccgctgataaggaatggagcgtttactttgcgttaagaaatgacaagcgaacaatgttttaattaagcgaatgtcaaaatgggtcttgaaaggaacgtgaccaaggaggagagatcgctagctggctaaaatcaaagccgagctccccaggcgcgccgcgcgccgcgccctcggcctcgatcttttaactcccagacacatcacgttgcgccacgcgatcgagttcatcgcttccggtcttcgatccgccacgcgatcgccggccgccgcccggcatgggcaccggacgcaagcctgtcgacggcgatggcgacggcgctgcatcagccgtcgtcttcctcgtgccgttcccggcgcagggccacgtaaccccgatgctccacctggcgcgcgccctcgccgcgcgcggcgacgtcgcgcccaccgtcgtcctgcccgatttcatccaccgccgcgtcgtgcgggccggcgggaacggcggcggaggcggcgtggcgctcgcctccttccccagcggcatcccgggcggcgacgacggagacggcgatccgggcttcgccagcatcgtgcacgccatggagaaccgcatgcccgcgcacctggagcgcgtgctcatgctcatgcgcgacgacgacgacgaccgccttgcagctgctggacggagggcagcgtgcctaaccgtcgtcgtcgacgtactggcgtcgtgggccgtcccggtggccacgaggtgcggcgtggcggccgtggggttctggccggcgatgctggcgagctaccgcgtcgtggcggccatacccgagctcatcgacagggggctcgtctcggaatacggtatgcgctgctgcaacgtccatgcatcccatttctggctttctgcttttttttcttctattttaactacaattctcgatctggtgcaaatgacttttgaattgtcataagcacatcacaaaatactgtactacgttaattctatagatggctagtactctttagtaaaaaaaaaatgttttgaacatcgaaattatcttcaggttgcaactttgaatgttattttttaaaatagtaaaaaaaatccaacaaacttataatcctatacatatcaaggtagtttttgaggtaatatatcacgcatacaattttatactcccttcatctaacaatatactcccaacatttctcaatagaaggcataattgttcctgatgcaaagaccaactaaacaagtaaatatttctaggttatttatcatggattaaggatatttaaggtcgaggagaaaaaaaatagtgctcatttaggatgaatggggggtttgagaataattggggcaaaaagggaagaaattttagtaattaagaagtggttgatgcgagaaatactagtgtagtaatttatatattattggataatatttaaatgcttcaattgcttatatttttggacagacaatgtacatctaatctaaaaattttaaataatggtgtttttaaaagctttgcatatgaaacacatctaaaatggcatgttttaaaataactaatagtatgacatcaaattgttaccatgacttatttaatggtactacccgctcacacatgtatataataacaattaatgatgtaccataaaagactttaaaatagacagatcgaaagtcttaaaaattgcattgacatacggatgcaattcaagcatggaagaatacaagtaggacaggccgttgggaacttgagaagcatcttactgtatttattcactatagcaattaatttagtatccttatttagcaatttgtatacccgtgtctttcttttaagaagtagcacgttgaatagtggtctaaccaaacctattattacatatttacatccactctcaatttttaaatttttcaagaataatttcccccagtcatgtgccaatgttcagtttacagctgcgattagggttttacagatcaatacctttaattttttcccctttctttttggaaacaggtattcccatattggcaaacggattcaacaaaaaccagggccaagtaaaagcaaacctccaggctgaaatcatcagcttattccccgaagaactagagctaagcaccacagatttgccatggctcgtcggcgacgcggcgacccagaaatcaagattcgccttctggctccggacaatggagcgcgtgaagaccctccgctgcatcctcgtcaactccttccccggcgaggccatcgccgccggcgccgaccagcaacagccattgccgcaggaccagcaaatcctccaagttggaccattgctagccaccatcgtcactgatcgagcaaaaggcaacagcaacttgcggtgttcgccaatgaagacgacgaagaacgacaccagcacgtgtcaggcagacgacagaaccagctgcatggaatggctcgaccagcagcgtccaggttcggtggcgtacgtctcgttcgggacatgggtcgcgccgatcgcgccgggcgagatcaccgagctcgccgtcggcctggaggccaccggccggccgttcctgtgggtcctcaaggacgacccgtcgtggcgagccggcctccccgccggatacacggatcagtactccggccgcggcaagatcgtcgcgtgggcgccgcaggaggacgtcctcgcgcacggcgccgtcgggtgctacctcacgcactgcggctggaactcgacgctggaggcgatacggcacggggttcgcatgctgtgctacccggtggccggcgaccagttcatcaactgcgcgtacatcgtcagggcgtgggggatagggatcaggctgcgcagtgccgaccgtggcgaggtggtggattgcgtcgggaggatcatggaaggcgaggacgggaggcgcttgcgggagaagctggatgagctgagggagagggttatggcgggtgaggcattgtgcgtagcaaagaggaacattgaggaattcattcgtgggattagtggacagagattacaataggggcttgttaatttgatcgtgaacgttattaattgccgtgaaagaaaaaggatagtttgatcaatatgaagcatcttaaggaattaaccgaagcgcttaatgagtcataaaaaaatgtgtcatgccgctgactcgttcgtgtaaacattttgttgcctaagagcgaagatgtacattaatcctaaatcatgcatgcttcatacatgtggtgctctattatattgttctacaaatttatgtttgtttatgtcttttgtattgtgatactgagagtctataccctagcggctagcggtatgacatttttcacaaatttcaatcaaattctagttgaacttggatcaatttttacgtttcaaatttgaattctcgaaaactgtagcacccgtattttatttgcttttatttaaaaatcttgtcatttaaaattttggagttaatttggttcttaattgattttgtgccaaatagatctcaaatcctctcttagaattgcctttaaaatttctgtgacatcctaggtcaaattcaaattcaaatcctttgaaatctcctcaaaattcaaactctacaaatccttgagaaattgtgaagcagtactgttcagttcgggcctcatcctctctttcttttcccctcggcccaactcctctcctccccagtcggccagcccagcccagctcctattcacctcttcttccttgaggcagctagccacgtgcacacaaggtgttcgacgaaatgttccgcccggacgccaagtcgtgccgagccgtgtgttgcaccaaaacaccctcccgtgcgccgcgcgtcgtgccaacacccgcgccgcaccgcctccgcaccaggccgaggccgcgccacgccaaaatcgcgtcgcgccaagcccgacctcgctccggtttctctccgggagacacggagccacgtcgcctcgcgtcaccccgtcccgtcgccgtccactccatctatcccgtcgctattgtttctctggtttgagcttgttttattgccttttgtttattagctttgttttcgcgttaagagcccgagttcgaggaagctccggacgccgctttcgaaggagaagaccccaaccctatgcaaggcaagcctctttgatcactttgcccctatatttgcaaagatatgttgtttgaaaagtgcattacttagcatacacgattaacatgtttaggcctcggattgtttatacaaccgacggaccaacctagtagtcacacttatattacataggttgatgtttctatacctttgatagctccacaaatgtttgtgccggtattgttacacgattaccgaggtagtttcgcttagccatgcttacgttgttgccgtgtgggaaacttgggttattccaaattacctgattaaagtagttgtgaaataaaatgtgttgtgaaagtggtgatgatgcggagtcaagcctttgtggtttggccacgtattgtcgttaaggactgattcctttgggaaatccatccgaacacattacagtgtgaccacacgggtatttatgggatgcctctggctgagtaaattgttttcacatgggagttggtgtgccaatggttgtgcaataccgaggatgaggagacgaagtgttacacatttattgcccatcatgggtgtctttttgcctctattgtggcgtggtaccagtaggagtaggaggcatcctcggtatttcctgagtggatgacggctgtcattgcctgatactcggctatggatctttgcccaactaggtggtatgcgattttcatgggttagctttggaaaggccttatcacgaacttccggtaccggccagtaccggtgtaagtttcgtgtcgtgtgggtaaagcgtgcaatctctgcagagattaatgaactgttttaacagccatacccacggtcaagggcgagtgtaaggtgtttctcatagcgtagatttgtttgacaaaggtttgtggaaaagtggttactgaaaagggaacgttaccagagtccgcctgtgtggcagacagctaacctttgtggttaggaacgggtctgtgtgacctgaggtgtcgtccgacaccgaggtgttgttagggccatgatggcgttgatgtgctgggataaccaggagatttgtgtgaactgtgttgttgtgaaaaaggaactaatagagaaaacaatttaattgttgttcgttaattgtgacaagttgttgcaaagcaacttgtggaatgggtcgaggcgtgagcctcctcccgacaactaaaacttgactcactcactaggagttttgtgaaataaatcattttgccaaaatggcagccttcacaaataaaaccgtagcctccttgttaaaccgacatgtcattcttttccctgatgtagcgcccgttccgtcgtggcgcctagcgggaaaattatctcttaaaaaccctagttgcgaaatttgtttccttgcttgttgtcgagtgaccgagccatctcagatctcaaatccccgatctatcgtcgagttcaatccagaatccaaatctctcaaatcaaatccctccgcaaaaggctattttgcctcccccgggttcgatgggccgaatctctctcggcccatctcccctttttttcccggcgctctctctctctctctctctacctctccccctccgctccgcccgcgcgccgcgcgcgcgtgcgcgtgagccgcccgcgccgagccgagccctcccctccgctccctcgctgccgctccccgcgcgtcgttcgcgcgcgcgcccgcgtggttgccgcccgtgccacgccgttcacgcccgccgggcccgctgacctaccgcgcctgcagccgcgcagccgctcgggcccgcggagccacgcgcgtgcccgagccgcgccggtcaa

SEQ ID NO: 70283 - DNA, 2390 bp, Oryza sativa
tgtcgtagatcgcgagccccccggtgacgaccccgcccgggaagttgatgtagaggtggaccggcttgagcgggttctccgactcgaggaagagcagctgcgcgacgacgagcgaggcggtctcgtcggcgattggcccgtggatgagcacgatccgctccttgagcaggcgcgagaagatgtcgtacgccctctccccgcgcgaggtggtctcgatgaccatcggcaccaggccgaacgcctggtgcgacgagtaccccgccggctgctgcggctgcggctggtacggcatgggcgacgacgagaagtacgcccgcggcgccggcgccgccaccgccagccgccgcagcgcgggccccgccgccgagccgggcctcgccctgggcttgggggagaaggcggggagcggcgaggcggaggctaggtgggcgagggcggagggcgtcatggctgccgctgccggttcggattggattcggggatttcgagcgaagtgaaatttggggatatgagatggggaggaaggtgagttataacgaggaacggatagggcgaggcgaggagagaaggcgagacggtgcgcttcggcttggatctttttgtttggttgggggcttggggctctttcctgcggtgcctgtcgtcttgggccttgcttgtgtggcaagaaagaatttggcccatataagaatagtagtagtatattccttcttatgttcgtggcctttcccctctgttttgttttcttctgtcagtttcgctggattttggtcggatttgactgaattttgtggcgtttctgcaacaaatgatggaaagctcacaagttcagaccttgtagctagtagtgtactactagtgcagcgcaacctgtgcagtttgaactgagttaccgagcttgttgtggagcggcaggagccaaaagatgagattgttcagttcggcgtacacacaggcaaagtgagtcagtgacacggtggtaaaaacaagcacgttaacccgatgaaatccactcctttatcttccgtcgccaagagagatcgacggccgagacgggtccaagtcggcagggggtccaattggccgagaaagcgcagcaacctcgtggcgccggagcgtgcgatgtggcatgcggcggcggctgtacggcgcgaagctgatgcgtgaaagaaggctcctctcactttggctttctctccgacttggcgcgcgtgcgggtgacaatcgccgtcccacgcacactcctggcctcctgggctcctggctgctgctagtctgctacggcgatgtccggttagttatgcagctacttttcagtaatcagtggcttggtttacagccagagaaaccggttagatttttttcacttcgatatttttttcagaaaccagaacagacaaagagggcaaactgccgtttcatttcttctttcctctttctaggtgaaagctaagctcggaaactttcttttttgcacgtttgttgccgaaatttttgacaaattgatcctcaaaacatatttataaaatagatcgtatcgaaaattaattgtaaagaccattagcgccaaactaaggtggcacctatttgccatgtaatctaaactcagcgtcacatgcatagcccggctgtagagaccttttgtttctacccaaaggttcaagacttgaatctcctgtctccctttttttttcactaacgtagtagcgtggtcctcatctagttcaagttttaaagaatcatatgttatcaattttattgtatttttaaacttcgaagttaaacttaccttacataatatttatcctttttgtttctttacgttttggaacagaatcttagcatcaatgttttgatacgatgtaagttcttttttcaaaaggatatgtcaaaattttggcacttgttggcaatactctttttttctggccatgtcatgtttcattttccatctccaagaccctacatgggccttgctagtaccaccaatttatgggttttcagctaggaataagttcactttgtgaccctcaaaagtgatcgaaatctaatccgtgaccctaaaccgcaaaaccggatatctcgacccctcaactcttaaaaccggtgtcatttgactccctcggcggttttggagggcgatttcgctgacgtggcgcctacgtggcagtattgactcggtcttctttccatgtggcgttgacgtggcgcttaggtggcattagaaataaaaaatatgtgtgggacctatttgtcatccaccaaaagtatgggtgggacccattgacatgtggggcccacataaaaccatgctctcctcatcctccctctctctcatactcttcggcgagcggcggctgagggatgggggctggcggtggcggcaacca

SEQ ID NO: 70284 - DNA, 12499 bp, Oryza sativa
tattaccagcaaaaaattcttcaccattcttctgatcagtgtcatcatcggcattctgtttaggcacttcattggccacaattgtgtatgtagtgataacaacatcatattttgccaactcatttggatctttggtccttgagccaccatgatagaccaaaacagacaatttagcactttcaccaaccttgtcagtcaattcgttcgcccattgcttaagaacactagctgggcacaccactagagtacctgcagcaggccttgtcatggattgcatagtagatgatgtgcttgccttactcttcttcttacgttcaacatttctttcaaccgtcttatctggagcagtattcattaggctagcacatgtttcaacgtcaccagtaccagctgctgttgatgacgaaccagctcctagatccttcctgggttcatcattcttagtctgctcccccttattatccgcaacaggcgctgcctcatcgtcatcatcaaggtttagcgcttcagcttttaaacgatctgaatcaacagacataaacttagactgctggatcctctgtttctgtataagggcaattgtagacactgttttgccaagaccctgttaaaagaaaactgctcgactttaaggatggtaacacaataagaaattgatctttgtcaagaagttgtgaaatcagaagtaacctgatcatctgcaagaattccacctgcacaatgagagctattctccttcgaaaccatccaagccaatgccattttctttcaaaaagaaaaggtatgtaatgaacatggaatacactatcaatcataaagtaagccaataaataattaatattatgtgagaaatatttacctggtgcctaagcagaggtactgacagaacaccctcaggcagatcatcttcccttttatcctggataatattctgtataacatagtataaaaagaaatatcacaaagcagactcaaaataaagaccaacatatacctcaatcactaaagtacataacttctacctggaaaatgtatcctagactggataaaaacttgtcatggacaagataaacatacaaatgagaaatttatatgcctcattcaaaaaacaaaaatacaactttcatgattgcaatataattcaacaaaaaaaaatcaaaacaaaatatgaaacaggtttgaagtaaaattagaagtatgtataatcatcttcaaagaacttctatctttctacttgaagaatggagaataaatagtatgattttttcaaggacaaaacaggtcaaaaaaattgagggcagctatagtatgttcaaaggtcagaaaaccaaataatttgaggagcaaactgaggaacccaggagattgataatgagcaaatctaaacaaatttgcaaatttaaacaacttaacaccaaactagctatctgtggttctcttcacgtcacaagagtatccttttgattattgatgaactaggaaaaaaacattatggtgccaactgtttatattatctatcaaatcaactctccaatttgattcagaaaacgtagaagaaaaacaactcaatcatacaaaattgcctcaataactaggaacaaaggaacacatgcctgtagtgcttcctggtacaccgctctctcgtcagaatctataatcctattttccaggttcagacgaccttgcatatcaatgccattagcaaattcgctgtgattagcagaactattgcgaccaaaagatggaggaagaaccctatgtgaactggagcttccatatacatagacatcctctggcaaacacaaaaaggggaaacattagtttttcagagaaaacctggacagatttcaagcaactgtaagaatgaattacaatcatttgagactaggtatacaaaccattgtcactgtctgtgatgaccttcttgttgtcagtaccaaaagaacttcggctcggaaaccttgacgatgaaggctccccaattccattggcaacattttttcccatcctattttcagccaatctttgtgaatttccattggtaaaagatggtgggaatttgcgtgtctcacttgcaaccactggatgcatagcatttgttgtgcggccatttgaaaaggatgagggaagaatcctcttgccattatcattttcttccgatgcaaaaccattgtgcttcttgactacaatatcagttctgttggaagcaggagttgcccttgcagaatcatttggtgaccccctataagaacttgaatgcggataagctctgtcacctgaacctaacgcatgacgagcgttatcaacatgtctaccatttgtaaaagaaggtggcagagttctatattgaccatttatattttcagtaggcctagaagaagatgaagctagctcctggtccaaaccaccaactgaatcatctgagtcgaagtcaaaatctatatcactgtctgaactcaagtcaatatagttatcgttgttcatattgccagcaagcatgcgcacagcatctgtatagtcagaactccaattgtgcttagcagtacaaactgtgcataaacatgatcagatcacaatgtgccaactactagtttgaccccaaatatttccaaagcaaacccacttcctggtttatgcagatgattgggaagccaaacacacaaagcaaaccacagaggtcacaacagtagacggagttattagctatgctgacttaacctgcaaggtggatcaaataatggtgtagatgagtaaatattgaactgtgagaaaacactaaagaaaaaaaaaacagcaacgctaaacattttttaggaatttatttgcccttctcaaagtcgttatcaagcattatccatgaggggaaaaaaatactagcataggtaccaagtcatttcttccctaaaaattagtcatattaattaggaatggaagttagtaaccgcacagttcatacgaaagcagtattcacatggtacactcccgaccagttcaaatctaggaagcaatcacacatggataaactaaagcctaatctgatccagacagagagctacaccctacgaactggattgaattaatcaggtcatttcaaaaaaagaaaaacagaaatgcgcaacgggaccaaatctcgccgcgggacacccctaatcgacgggatcaaccaatctcccatcccaaccacacaccccaaacctcgctaacctcccagctatcccccataacccgatccaacaccgccaaaaattacacgcgaggaaaaaaaaaactcccacaccttcccccacacggcacgcccaaacaaacatcggggcctcaaacctcaaacccccccgaccaaccaaccaaccaaccaaccaaccccctcgaaaggagccgctacgtggggggggggaggagccatcatacgaggatacctcgatgaagccgtcgaatccgcggagatcgatcccggcggcgggaggacacgggcggcggcgagggaatcggcgggtccggagggatcctcccggattgggaggcggcgccggaggctgcggctgcggcggcggcggcggcggcggtgggggaggtcgccgccacggagtttcctgggagggggagggggagggggaggcgagacaggtggaggaggcgccccgagaagcgagcgagtgagagagagagagagagagcgcacgaggaggaggacgcggagcggggggtggctcggaggggggccgtgtcggatgttgtaaatgcgatgcgcctgcggtttgtttttctactgaatctactgctgtgtgagtagagtaggtgggtcaccttgtcagtgtcacagtggcaaaagaaggtgttcattttcttttcttttatttaagatgcaaaaggtgttcatggctgcccctctttaggttttgctattataccatctttaaaatgagttttgaaaaaaatatcaatctcaagcccgcgccggattttgtcattttctcattttcactaatttccgaaatctttttgtctctttttttggtgatcatacgaaatgtttttcgctcttcttcgacgagatgagtgctgccagcgtaaccgcctcgcctcacctcgttccatcttccaccaaacaccctcctcgccaagccctcctctccgccgcaccggagccctcccatcctcgtcgctgccggccaccacagccagtccagtccgcctgtgcgatgccgtcgacctagcctggtgtcagacggcatccgctacacggcaaacggtgatgacggtcgcatccgctggtaggggatgatctttgagggcgcttgtccaagtgctcaggccacggggggagcaagagggggtttgggttcctgatcgcatacggacctatgctagacatggagttgtagatggccataaggccaaggcccaacggcccaacccaagcacggcacggcccgatagttcggccatgcctgagccgagcccttggcacaatgggccggcccgacacgacacgatcaaagaaaatagtagagggatccaaatagacttaatcaactatagttggcaaggcccaaagagaagaggaatacaaaatagacttatttctagccatataagacatagcccaaagagttgaggaacgaaaaatagatttattctatggagaagcacgatgggctgttgtgcctttgggctgtcccggcacggccgcacggtccgagtcttattaggtcgtgcctaggccgtgtgtgtagtccatgggctggcacggcacggcccgacgtgtaggtcgggccaagccggcccgactgacctcagcctaggcatggtcgtgccaggctgggcgacccatttggccatctatacatggagtgcgtgcgccgacagcgcgctctccccgtcctgcagcacggctacgtcccccacgagctgtccagtgagccgctgccgctgggcatctacatgtcgaaggcaccatcgcctcgcacggtcagattcagagttgtcctcctgatgcaggggcccgccgtcgccgccgacacctagtgggaggtttcgcatctcgaggaggccgccactggttcaggtggatggccagctcaacccgaccaccctggcgccatgtacattggttcatcagtgactctatgcgtgacattccacatacttcatcaaattaggcaatttttgctacaggatatccaaattttgtgtaatttatttatatactaaaaacgtgtcacgacttaaaatatatctaaaaaactgataaaatatgctagaaaacactttcaactcaatcgtaaagataaatcccccctaggacaacatgcttcaaacgtggtgttagagtataaattaaaaattatgcaactttaaatttatcatcaccccaagtacatcattcatatacatcatatttcatcttctctccaatctcagctcaaaaacttttaactgtagaggcattctcgtttttctaaagaatttctttctccaattgaaccgaaagtatcctctagcaaattaccgtttttttagtgtcattttgccttgatagttttttcgatgtttactagcaaattacacatttttaaaatgtcctgtagcaaattttgccatctggtctagcaagataattgtgcatttataaaagttctctttatctacctatctggccaaatatctaaaacttaacattacatatcagacatttgtgaaacttatgcaattccagtttggctagggagagtggtgaatgatgcaataacagcatgcatgtgtatcaagcaagtaatttggacccagaaattgcactaagaaatcgccgaatcaaccagctaattaaaataaattgcgccggcacccacccagcttcttcttcccctccccttgcccatgagtgaagcagcacattatctaaataaaatgagtgaagcagcaacgattacgaacatagagaggaacttaaacctaccgtttgtcctggccgacgacatcagcagcgacgacggcctgctccgggcggcggcgcaggtagctgagataccttgtcccatccatggagacaaactttaacctcgagagaaaaaaaaacaaccgattttgtacggatttctggaggctgtgatcagcttaaggccatattttagttcgtgaaaagaaaattttttggtgtcacattggatgtttgaccggatgtcggaaggggttttcggacgtgaatgaaaaaactaatttcataactcgcctataaaccgcgagacgaatcttttgagcctaattaagctgtcattagcatatgtagagcacttatgactaattaggttcaaaagatttgtctcgcgatttttcatgcaaactgtccaattagtttttgtttttatctatatctaatacttcatgcatgtgtctaaaaatcagggccagcctttaggaggggcgagcggtgcggccgctctggcccccgactcagaggggccccacccccaccctgcaggcctgcgccgagcgtggcccaaaatgttacaggcaaagcatcaacatcgaacatatcacaaaccagaaaccgactcgtccgcgtcgctagtcagcgagattgtgccgccgcccacgtctcctctaagagcaggtacaatagcaggctataagccagctataaatatattttattattttataaagagataaaggaaaagagagaagagtagcgggctacagatatatagccagctgcagcacgacaggtgggactagatattaatattatagtaagtaactattgtatgaattacatatcgtggatcggacataagagtaaagttttgagaaattccattagcatttgatttgaccatgttatgtgcggacataagagtaaagttttgagaaattccattagcatttgatttgaccatgttatcacataaacaaactagtagcatgtgtgattgataggtataggagacatgccaattttggttctggattcagccctgctggactgcatcagctcctgctcccaagctgggattatggacagttgtttataagaatagattaaccattatgaatagggtttagaaaaagaagtattgtgtagaaacatcacaagcctctcagatttgtggggtgctagtggtactattcacccttggaagcaaaggcctaattaatcagctgccttgacgcccttcaccatagtcgatactgggtcagcatttacacgacattactcctcatggctccaaaaagagacattactcctcatggctccaaaagagttgcagcaggcagttcattcaaggaccagcttccagcagtcagcagagtgtacatatgggtgcattattgatttattgtccacccaaaaggagaaaagaggctcaaggaatcccattctgacattcatgtattaagccaccaacacacacaaaaaaaaatgtcatgaactgaacatgataggaaaaacagaaagcagctgctacccatttgcctgcacatctatcctaactgcacaagctcaaggtgaagcatatgttttctcctctcatgcgaaactttcacccagcattcattatcacagaccacttctgtatcactcctgcaaaaaactacttcctgaaacttttattaggtcaaacagctcgaaactgagcaacagaaatgcaacgtccacttcctacaatctgtaacatatcactggaatttaagattgctactgttttgcatttacacatgaatatccacattgcacattgggaggtgacaattctacgcaacgggaaaaggcgctacattaaatcaatgatggatctatcagttaataatggaacacatctctacaaggtaaggggaggagggggctgtacaaatggggaaggtgagagagactgttgttaccctgccatctaaaagctaaatccccatgattaggtaggaaaggtgtgagtaggaagaaaaaagaatggtgtctgactaaaatctccaaaggaaaaaaaccaataccctctgcctacaattccttggctagcctaggaagacgttggatcttgtcttgagccaatgcaccatctccttgtcaaggggggaattattcaatacggcatccatcattggagtaccaaagaatcttgggtcactcttgaaaacccatatccggtccttgggccatggcctttgtgcctggttctcctgtaataaaaccacgcagtttcattgagaaagatgggagtcagggaaagaaactgtaatatattgcatatatgaagagaaatactcaatccaacagaagatgatttaatattgtctagaacaaatattctcttttgttttccacactgaacgagttccaagaacaaaatttggaatattttagccacaatgacatataaaaggtaagcacttaccatgcgcgctaacatgaatctcacagttctgctgccatagactcgctcttgtgttggttttactgacttcacatagaaggaggatacatctggcaatgacatacaaccctttctagctcttgtcaatctagattcaggctccgcattctggctataccaataaatgagttgacctaagcaataattttctgggtatgtcttacagtactcctggaagcctggtcccagtttatctgcatatttgggacctaaatcaagaggactgataagaaccggtggagattttaccgtcttgtaatcctgcatgtggtgatccttgagtcagtcctttggtacagagaaaaatcacaaacatttgttgcaaaattaagaggaagttttcacttactcggactctgaaaaaacactttgtgtaagcatacatgtgaatcaaatcagcagcagcatcatgccgacacttgtatgtgcatgaaagagttctcagctcatcacgcaacctgaagaaaagggcggtcagattccagatacaggtgactggagggaagagtcagattaatggtcaaacaaaacaagaatatattctaaactcaccataaaagagaacttcggatttctccctcaatgtcctcggaaccagatggatcatgagcacgaattttggctttgaggtcagtaagtacatcttcctcaacatgaggttccattgactcaagaagttcatcaactaacgagccttcccctttccagatggcagaaactagacttctcccagttagcctcaccagtggaggaggagcattcttgggatccccaaatatgcatctcatgacatatcttacctgaacataacaatgatccataaaaatgcatcagaagagacttcttttgggttgttagtgcatagtgcatgttttttgttcacttatactgaataacttcaagctagggggcataaaatgcgcaccttgtcaagtgtatgagtcaaattctgtaatcttgaattcagaactccctcggcctgagtagtgatgacagaattagatcgattttatgtaaattacgttgcaacttgtagccgttcgaagacccacctgaacctcggcatcattcttctcggaatccatgtttatatctgtgaaaaactggcgcttctcgtccacattgtgtttaaagatctcatgaggaagtttctgtctctcaaagaatataaaccgcacctttgtttacaggaaaaatagccatgagggatcacgatactgattactgtatcaagaaaaaagaagctttaagaaaatggtaactacaattaccaggtgagcagtgtaagcaacaagccatccaggcaaaccagcaagcaaacaggtaccaagaccagctctccccaagtcaattaagtcttgttgagaaacagagtttgcttcacaagcctgtaacagaagactatgtcgatcgagcacaccatggaattccatcaagacctgttccaaatgatattagtagatgagaggaaatgatgcagtataaaattcagtgtatgacaatttgataaactgcaagtgtcagttcctaaattactgtaaacaagaatgaagtttaccttttcaaaagctccttccccagaaaaatttaaatagctgcccctgcatatttgacttccacagagacaaactgacgcttcgtgctcttctttactctggcataattagaatgtattcataagataaagcaatttacgttagaacttatacagaaactagaaatggcaatcacctcagtaacagagttgtaatcaaaagtgatttcctcgccttctgcaattggtcgaacagtgtaaattccaatctgataatgaccatccacagccgttactctggaaatatattttaataatcgtgagttattattacaggtataacatgtaatcttatgagtgcattttactaatttataaatttgactagcatggaaagtgggctttgtggaaaccaatatgggccagttctccttcaatcttaagagtccttcaatattaggtacaggtgtacagaaaatgcttaaactataaatgtgcagttcagtttttataaattgttagccatccattgattgctgcccccttccctgtttgttctcaatttctgaatttcactactggaacaacaaaaacaggccatcagggactttgttcagaaaaaaatacaacagcgcatggtgaaccaaatagaatgaagtagacatgcaggaagagtgaaatcgcattcccccactacagttcaaagcataggatggatccaccacagaatacaacaacaatgaagtcacaaaggcctttcaaaatatgaaaaagacaatagaaggtagttgcgtaaatgatagggccaagcatatatcacgtgcaaactgcaacaccacatatataaatttagttaacagagtaaaccccttccacaaatacagtccaaaagtacaggtcaacactaaaaaggtactccctctgtttcaaaacaaagggcatattttgtttcgttaggacgactttgaccaacaatcgctctattagaatatcatttgtgatacaaaagtataatcataagtacttctggatatgaatctaataaatttatgtgtcgtaaaacttatatcataatagagtaatcgttggccaaactcttgtcctaacgaaacaaaatgcacactatattttgaaacagaggaagtactataggaggagtgataaggcagtacacatacaccacacaaggtactaatctgaagattaagaagcttactttgcttcacagttagggttgcaggagtgacaaattctgctcgcatagttagccttatgcattgcatcaacgaaaaccaagtcatacccatcacggtctccctttttatcataacaaaggtaaaacgatcagttatatgtaccttgacctggaataacataagtcacatgcaaggtcacattaaaaaatttgagattgcactaatacctttggccgttctagcataatgttgtaaaactcaggagcttgatcgtcgctattgttttgtatatgcttaatgccatcttgtttttcataccatctccaagaagggtatacctgcagatattgcaatttcacaaatattataccattgttatatccctttgcatgtcatctaggaagatttgttgatcgtaaaaatcacatacctccccaaagaactcgatgacaaagtcgtctacaccaaatccacccgttttgttacaaacaactccaagaccctgaaagaaaatgcagagaaaaagttaaaaagactgaagttagttaagatggtatgcagggattagttatcacgaaatgcatgccttcctataggcgacatagttatattctgggtggttcctcatggcctttagcattccaaggcacatctttgaagtccgtctgtcaccactctcctctgcagacttttggatttcttcaattacaggtttaagggggtaaaccatgggagtatttccagaaccagtgaactgcctcacttgcttattcaaggtgttcagaagcaactgcagtgaaaaaaaaatagtacaagtgcaaagaattaggcctgcatgtaaactaaaaacgaaattaaaatggctattcaccaggacaaacctcttcaacaaaggtatgtttgtcagaggatggccaatcaagttcagtaggcatcatttcaagtaggagattatgtgtatatggatctattccatacacttcttgctcaagaacttcatccccaggtacttttctaggttgataatccttaacctctggtagttccaaattttcagtgccgttcttctgcgagagcagtttctctgaatagtcatcaggtaaagcgacccgcatctttctcagtacttcctcctcatctgctacaattaggtacttctcaataacctcatacttcctagtcactgggggaacaaggcttgcttttgtcatgcgagcaccccatccacgatcatccgtcaaagactcgcttgattcaaataacttcataccatttccctttaaatcccatgctcccgaatttacatcaagatcactctctgtatcagaaacagtagtttcact

SEQ ID NO: 70285 - DNA, 1145 bp, Oryza sativa
tgccctggacgtgttcgagcgtgtagccgttgtccggcgtgacgccggcctgaaggaggccctcgcgcagcgcgcactgccaccgcggcacgtcggggcggaacacaagctcgcgctccacccacgggtacgacgcgttgacgaggcgggggtcccagccgacggcgcgcacgtagccgctgctggcgcgggtgtagaagccggcgttaagccagctgccgccgccgagcacgcgcgcccgggcgttcacgacgccgtcctcggagacgaaccgctgggccggggacctcggcgacgtgtcggccagcgcgtcggcgaagtggtactcgctggacacgttgcggttgccgtaggggaggccgccgcgctccaggaggagcacgcgcgaccgctccgacagcgtcgccgccagcgggcacccggccgtgccgccgccgacgacgatgtagttgtaatatgacaccagcggcgcgtcccgcgcgtgcctcgcgaaccgaaaattgtaccctttttgcgctgccacgacacacgcacgaccacattgtcaaagttctataaaaaaaacacaacacatgagcaacacgtacgtgatttctcatgtaccttcgggtgaagcggtgaggctaaggcagagggagccaagcacagtggctactagtaggagtaacaccactggtggcactgagccgtgcctatgaccaggcgccattttggcagagtaatcttgagatttgaagataaaggaggaggtgtggagttaatttatacatgacgagttgcgattcgattagatgaggagtagataccaattagggtgcagcagatgtcaaagatggacaccgaggaatacgggcaatggtggtcgaaatatttgagatcagcgtcgatcagagcctttgcatgcgttcccatcaagcaacgagttcaccaacgtggagactatttttctgcgtactctgcagagtacttactagttcctggactgggccaaatcactcaattattgggcccaaatctactattcctcgaaggctcgaaaggccgcagccatggcgtcgagctcaacgtcggcagcggccagcaaaaccctccgtggactgcttcccggaggagtccgacctccaccgccgctaacttcccttcgt

SEQ ID NO: 70286 - DNA, 575 bp, Oryza sativa
ccggagtgatcaaaccttcccaatccgccgcgtcggtttgtgtagtccgtcagcagtgaggtattcatacgaaggtgatggattttgaagattccgtcttcgaatctgaaaatcacatgattggctgcacaaagtttcggttttaaagctgtcaaagttttcatttcgatgactatatgtgatgaaactgtatttactgtgtctcccagagaccagtaaatgataatgttactctatgtgatgaaactgtatttgctgacagtgactgcgcctataatgtatgtgatgaaactctatgtgatgaaactgtatttgctgatagtgaatgcgcctataatgtattactacaagtactatattgaactagaaagtaaccgcggcttcgcgcggaagaccagtccaattggacgcagtgtatatcgtattaattattaagccttatcagctaaataaggcattaatcatgttctgattgccatatgctcatattgcaaagcctaaaatcccttagttcacctcggaaaaaaaacacactgtcagttccatatttatcattgtgctgttctacagaaatg

SEQ ID NO: 70287 - DNA, 703 bp, Oryza sativa
tatatatatatatatataaaccatgcatatatatgtttcaatacatatatatgcatacatatatatatatatatatgtatatatatatatattatattatattatatgtatatacatgcataatatatatgtatttatacatatatatgtatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacatgtaatagccgcacaagttagttccctgcttttgctttgcgcactacaaataaatgacaaacaacgagagatctaattaatatacacttgtatgtatttgaat

SEQ ID NO: 70288 - DNA, 688 bp, Oryza sativa
atgcacgtgcagcatgcagttgtgacatgcttgatctgaagtttctgaacttctatctgaaccggccagattttattttagaaaatagattaaaacggggcctctacatataaaacagatgtacacagccaatctaaactaagggtgtgttcgctaacagcagatgggaactttgcacagtgcacacggaaaacggagcagctcattagcacgtaattaattaagtatttgctattttttaaaaaaattagattaatatgtttttttaaataattttcgtatagaaactttttttaaaaaaacataccgtttagcagtttgaaaagcgtgcgtgcgaaaaacgagggagaggggatgggaactttagcatccgaacacaccataaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgctatgctttgcttggctgcaggaatgtgcacgacaggaatctccgtcgtcctcctgctcctcccctgcgtcatctacgtcctcttcgttgccgttccggtaggacgcgacagcgcccgagagggcgagaggtcgacccaggagcggcgtctggg

SEQ ID NO: 70289 - DNA, 708 bp, Oryza sativa
cgccagagttcgacttttcatccctgatgatacaggctaaccattcagtggccctgccacgaagtgcttgcatatcttcagtcatcaaggcgtcttgtacccttgtcccgccatgtagttgcgcggcggcgtaccatttgccaacttgcgctaggtcttcaatagcgacttggctcaccttggccctctgacattagactacgtccctgatttaccgagccttttaggtcggggcaatcgccaatgcatttgatgttgaagtttttacaactgcatggcagggagcatgctctaggtgctctaatacacaataacttgagtgtgagatgaagaagacgttttacgagtttttcgctggcgggggcatggctcatgccggtctcggttccggctggacttgcgcgtttgcaaatgactttgatgagatgaaagcgtctgtttacgcagcgaactgggggaaaaaaaatctcgtgggtcaggatgtcgccacgctactttcatcccagcttccggggcatgccgacttagcgtgggcttcgtttccctgtcaggacttatcccttgccggaaatggtgcaggactggatggcgagcgaagtgggacgttttggccgttcatcaacctcatgggccaattgaattttgagggcaggaagcctagtgtcatagcactcgaaaatgtttacggtgccattacgggctgcagga

SEQ ID NO: 70290 - DNA, 23769 bp, Oryza sativa
  unsure (1)..(23769): unsure at all n locations
tatggtgtaccggttgttatgccaatagcagcgccgggcagctaagttggtatggaagaactgctgcgccgcgggaaatccttctctatacaagttctcgtacgaggtttttgaacagaacttcgataggcgagaggtgtaagcaccgcgaggtgtgaagcgatctcgtactaaacgaatggaactttccaaccttcgagaaaaggtcccatccttcaatatcatgattgggtcaaccaggccagatcataagtgaaatagtttgatctggtcgaccaggtcaggcccgatcaagcgaatttgtaaagttgtaagatgaatcgcctttttgtactatttatttcacggtttttcgggaaaatcttttttcattttcccagcgtcctagaattgcctttctgttttttccttctccttttgattttcgtatcattattattactttggtttcttaatagggggatgattcatcgtggaacccgttcccccaacgaattggattttcatttttttttatttttgtttacctataaattttgtttagagactgtttttttagatgacggagagaatgttttaccaaatccagcaggggatcaggctcaacccgcggatgcaccccttgctcctgcagtgcaagtccctgccattttgaacccaccccgggttccatcgatcccgtcatccctggatccagggagaacgccagaagatcgagtacgagagggaacagaggcagcagtcacgggctgctgctcgtcttttgtcgagtgtctctgttctacctggtgcgatagcttttagcggggcgcagatgtaggaaggcgtttcttgcctgctttctgaactgcgtccctttcactccatgtgaaggtagtaataattcttttctttaagaaagggatcgtaggtgcgtgaataataatcttggttggtggggaataggtttttgacgaataagtaaagtagttgtgattagtggtataggtcatcaagcacctgggaataggccctgcccaagcgccctcccgagatcggactcgagggagggtaagaccggaacgaggtctagcccgagtggaggccaccctcgaagggaaagcaagcactttcgaaagcaggaagtaggtatggtttcttgagttggattcatcaacccggaacaagagtggaggcgagcccggatgcagagatagatggtgtactagggattaggttaggtagctataagaggtagctggtttcgaggtaaggtcagggcgctacagaaatggcagatactacgttctcccgccttgatagatagttctgctagaaagcgctcattagaagtcgagaaaacatggtttctggctctttctttgtcgtaaggtctagagttggacaaccatcatagcactcgcttaaacagatctctactgccttagcaattgaaagcaggagaggtagttgcgttgcccttaatgtagcagtcaaaacaagaatcccttatcaagcaaacccggcactccttaactaactactgttcagttgaaagtaggtggatcaatagaaagcctcttcaaccctcgtcatcaagagcaatctgatctcgctttgattcatcaacaataggatgaccgataagatatggttactggtctagtcagctcattttactttcggagggcttgtcttttttcttagacttaagggagcaagctagaatcctgcttttcccaaagagagtgggatgcgtctaccaacttgtcctctcaattgaatgttaccaacttgtccattaatagtaaggaacccagggatatcgggacgggaacttatcgataccgatacactcaaagtcttgatttgtctaataacggatattgaacggtattcagcgagggctgctgtcatttcatttctatcacgtaatgcaagagagccagcagtatccaagtcggcagggcgttgaataagcactactctcctaatttcttattttaacccatccacaaaacaaaagtagtagtgaatatttcaggatcaatgttgaggttgtgtgctagcatttggtgcattagggtcttgaaattctcaatgtagtcctgaaccgatccagtctgcttcacatgagttaagcgccggatcagtgcctgatactgcatcttttaccaaacctaagacacacaaagtcacagaactcatcccaattcatactctctaccttattttctacagattgtaaccacattttagcttgacccgtgaaatacatggtggagtaatctttccaagtagtgtaaggagtgtggaacataagaaaatatttatcgcaattcttcttccaccatcaaagataggaaaatctggcctattgggtgccgatccactcgatcctatgctatgcatttgtgaccaaggcgaggtaagatcatgaatacaagatggcgatgagtcatgccaagtttggggagtgttgctcgtaccctcattgcatgttttaaaatagggcatactgcctgtgatttactattgatttccaagtcgacacgagattctatttctttccctctacactatgtacttacttttccggctatgcgagagagactttatccttggtctataggcacaaatccagtagaaaataccaatccaacttcctcctaaaatcacttctaacaggcgagcgtgacttgtgcgctttttcgttaaatcgagcaaatggatgtgtttttccagccactgagtatctagggtcattccctttaccaaacattggagtcgctgctcgctcgaaagcttttgctttcttcggtactggtacttcggaatccggtgccaagctttctgatctctctccgtgaggagaaaattcctaggattgatgctcgattagatagttgatttgattttctattactagagcttggcagtgaagacagtgcagcagattttcgcactaccggaatgggtccttatgattctcaaagaatgatgaggggcaaggctgatacctcgcaggtgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagagcgttctatttctagggtcggccgtaaaagacggatttgtttataactgacccatttataatataccaccaaactagtcactcatgggaggcttcacttgtgaactacaattcccgtactacgtagtatgattggttgctcaactgccccttaaacgaagaagacccctgggccgccttgcgaaatacttactgctcaaaagcgaagaaattaaaatgctttacctctctcttccgatgaatccacttcacataaacataataagtgttttggcatgccagcaagcggttgagactttcgttattccaaatttacgaagggaaggttccgaggtatcggaatgtggtaagccagctccacctagggacatcgccggacggtaggcatcggttgctctaaaacttctcacctggttttcctattgtcaactttccttacgcaagcggtcagtaaagaaaagccgagtcgagtacaagaaaaactaatagcttcctttcgttatctgcatctgctttcctcaaaaggtctagctttgccaaaatcaatagtttagttggttgggtcctgtcgatcaagttataggagctgcttgctatctatcaaagggtagaaaaataccacgtttgcattgaaggaatgtcgcaggaagctgccgatccgcgatttcaagtagttcgtgcttcggcggcaggggactataggccatgaaaacccaccccaggtatctccacctgtggattgagagtaaaaaccagtgaatttcgtatctcccgctggcacacgatttctattacttttcttgtttcccgtttcggagatccgataaaggaatggtaaatcgatatctgggctcgagccagggtacttatcctcccgtctataaatcaatgaccaataaaagaccaaaggggtgataaatcaaggggcggacaggagcagcatcgtagctaggagcaggtgtagcaccgtagctagtaggaagaagtccagcatagctacattccccttcgggttggcgcccgtcttctccaatagaaatttcatcatatcaagggctaagctatctgaaaacctactaccaatctgaatgtaaaagaagaactaaatactactatccatgagatcatcataacaaaaactagaattgcccagctaaataggaatagaaataaatccagggtaacttgtatcatgagatgggtcaattccaatttgaattccgtacggctacaactctttttaaacgagtcgaagtccagtcttgtcactttccccctttcttatcctcttttttatccaacctcttttatgtattcttggctatcagaaaatccttagaataaaagtttgtcagaagaagaaaaaaaggagctcaattggcattcattcaaataaagtttcacaaacaggaggccttgctttcgcacggggagagagatagcgatgggcggctgctgtcttgtcaccgtgttcctgtataccgataagatgatgaatggtgatgcaggacagtcgaacttatcctttattcgtattgtcagctataaacttgttatcagatctataagggacacaatcctgtggtgaaagccgccatcaacattcgcgtagagaggtgcttcccaaaaagggaggggaaaacgagatgattgctttgcccagtaaactatgcttgctctgatgacctggcctttctcccgttaaaaggtgggtacctttccctaaatccttctcccgtgcatgctattctcctgttcccccgaagggcggtatcaatacggcaacccgaaagctcgttatcaaagtggtctcttctcaaaagcttatctgccagatgaaaacaagttcgtagtaacaaggggcaaaacaagcaggttggataagggtgccagtgaagaaatcaagagaatatgctttggagtattcatagaaagaagtcttcctataagataatcatctttcctttgttttgacattcttgatgtattttccactgtatggacatccttctatctttgtatcggtagcctcttcaaagtattgctttaaagttcctcatgaagacagagaaccagctgactactataactccccatctcatccctgctgctgatccgtggtaccatttctctatggggaagtgttgattgattaatgatcagaaataaaaagaatgcagagaataggatccacggctatgagagaaagcaaactatactagcttcctgctgccgattagttgaagggaaagttaaaaatagtcttaagaattatagagcacgacagcattcaaatgaatgttcttaaaaaacaatatttttatttatcatattttgactagaacttcagttctttcacttcgacacgtcttccaactgatgataagtcaactcaacaacatttccagcttagctgccctttcacttgcttctgccttttcactagaattaagatagtgtcctcccagaattgagaaagaagagagaatacctatgtgctgctatgcctatggtccagaattgctatccgtacgaccttggtctttgattgtaaaaaaaatacatactaagcaagtaagcctgcctaaaagcatttctttttgacacctctctcgatttgaagagattacacatcactgcgaacttattcactcttcgaagcccccaccaccttctttctttgagctgagcactttacttcggctgtggtcattgcctaccggtaaactcccatacttccttcttttgttcgagggaggccatacatcttccttctttggttggatccaggtcagaaagttatagggtgtgcgcaaacaagtctgaattaataagaaggggcagtacactacccatttgggaattggcaaatcacagtcatacttcttagagtggggtggagcaccagcaccttaagctgcaccagtatcttagtaagatagacaccgattaagaaaccgagaagtctagattatggggactctataagtttttctcagatttcctgtgtctgtactactgaactttctaccctgcatattgtatgtatccttcgcccttattttctgttctgagaatccgccttcacccttcggagaaaacatggtggccggagacaaggtatgtagattaatagagttgctcttacttttataatatatcattgatcaaaacttggttcccatggatgaagtgtttgagtagacaaaagaagaagaagctgtagaacaacactagaatgattccaaccgacatacccacacacaaacagactaagactttgtagccccattctgttgagaaggtgcaatctatataccaagttgtctttgaggtacctcaagcacaacctcctaaaagaccatgtgaccatcagatttacctcacgatagtcaacctgtgaatcaaaggctttataggtattcacaccaccggttgaaatttatgccataatcaaggagtgcccagaatggtactctacaacctagttcatgcctcaccggctcttcatgtaaagtctctagtgggtgcgagcggctcccgcaccgggtcgggtctgtagtctgtcgttttgaccaaaagatgaagtttggttaagtcctccaaatgagtccattcgcctcgttcacataggtcctttccacgagggccaaagtgaacccaaagtcttgtgtaggcttttttgtttatatccaatccatgtggccaaaacaagatatttagcagggatacagacgacgcgattcctgctttcatagtttgatcaggtagctgaagtcgtggtgctgatcgcgtggtttgcctcttctctcgcggccgtgtgttggtcagcgtggtatggagtagcggttcctcggtagtctgactgtttcgatgcagcatctctatctttcggtacatcccgggcaggccttttctaaaaagtcttgtgctcaggtgcccaccaagatttctgacatcttagcctcctagttttaaattctcgaatcgaatcaattaagaatcaattcaaattaataaaagaataaggaaacgctatctcatccctattggtagcggtttgggccactactgccaaaacaaaccctagtttgaggaaagaactgtgggttctcaaaatcaagtatcgccgggcctagttattctcttgccccaacttatgcggggtacgaatttttcgagttggatcagtactataagcctaagtattttattgatcaggcggcacccagatttgaactggggataaaggatttgcagtcccctgccttaccgcttggccatgccgccaaatccgatctaaaatcgagaaaaatcttattcatccacattattttactaattattgttcgtaggaggggattactaaaccctttttttttcgtcgaatccctttgtacttatccctttccaatccctttgaagaaattcattccggtttttttattggacccagttttattctcttcgattgattgtatctcaaaacacacactgcttaaataccttctctttctattgaaaagagaaagggtttccagtcacagactgaaaaatttaggacaaattggaaccattaactatattaattaactatattatttgttattttgatattttctatttgttagtagtgaacggttctaaaatgggtattgtatccctttttcctcgatcgtcaacgagcaagaaaacggatgcgcgtgctaacgctttcgcgctagtgcgctcaatccggtgcttgtttggatgtaagagatctcgtttgctggccgggcccttccatgagtttagatctctatgtatgaatctcttattcaatcccatactttttctcatttcagaacgatcagcatactgtgtgacttctgcgtgacagttcttgcatttcgtttgttgctttgcatgaacatttagatattggaaagcccttaattaggaatttcatagatagagaaggacgggaaaaaagagagagactgactaactacccggatcaatgctgattgacgactgaataaatagccggaagcaacaactgcacgagagagaaagagcggatccaactaaggaaatgcagtacctgttctgccggagctaatcatgcaaagctagcgtagcgccagccgtcgaagtgaatgaattcgaaagaacgaagaagtaaggaaatgagacgactctttcttgaacaatttcataagcagatcttcccctccacaccaatcacgagtttttttttattcctctcgtatatcgtcgtcacgcccttaatgataggttttgaaaaagatttttcatgtcattcccatttaggttcgattcggatccctctgttgtttccctttcctcccgaacctttttctcgaaatgataaagaatctggtacactcgaattgtattatttaagtgcttattgcttgccaaaaatcctacttctacaattggtaggtcaccgggttattcaaataagtcgtgttttctgtgcttttcccatgttacaacttccgtaccaattcgatcgatccggaatggatcggttaaacattctattagggagcccggtcttgactcttctgtgtggtattcattctggttcggctcttggaatcacatccagcagtggttggaacagctcgcaaaatccaaccacttcacctactttattgcccccaaccgtttcccgtacctctatagaaacagaagggtttcatgttctttcatcgattgggtattcctctccttttgtatctctttatccaatttcggtctcgattagttcacaagattgaatggccaagtcatggaaaagccgttattcgattgttttaaaagaatgttgagccgggcccgggtatgtaagttcagcgatgtacaaacaaggattgatttgacttcccgcacctaggttgggggttctattttggaagaggaatagaatctcattcatgtgttcatgctaacagaagagcggatccaatacacataagactcttttctcttgaaattccgaatgtaaatgattcaaagaaagggtggactgcagcaatagcaagagatcagcgaacgaagcggagaatgatcacaattaggtcgatcctaccatagccgagtctacatccaagacctgacacgatgaaaaataagattctttctaaaagagctaagaaaaggagtacgaggactagctcaacgtatacccgcacgaaagacttgaaagagctcacgcgtattatgcctaccttggctactggtgaagatggagtcgtaaattgacttaaccaaagccatacctgattgcctacgaaggtcttaagtctccgcacgcccaacacctacccctacctgtatccttaacaaggtcgggatatccacgcataatactatctaaaaaaagattaatgatttggatggcaaggcggatgtactagtaaagatatatctttccttcttttccatcttaaaaataagacttctggcgaaaagagtggagttgagtacccttgcttaataactagttgcaggcatggcttattaggtttctgaaaaaaattgagagctctttatatataaccaaagaaaatagaaaaaagcataaaacatttatagaaaaaagtaaaaaaatcaaacattgacgacccagacgaaacaattagtgaaatcgttctatttcctccatatccccaaacatatgcctattcccgcacatgttcttactcgcatattggacttacgaagggtaagccttattcccagctatttaactaataaaaaactcttcacaatgcttaacgcccatatgttcattctttctttgcttctcatgtttccatgctcctttctggtggcaggaggcaaagaagagacataatggagataatgatggttcaaatccaaccattccttgggcgtggttcgagcgagaattcaatgatcagtatttagatgtgatgtctcgggaagcgcttcgacagcaattcgttagcctaaaacaagggagtggtactgttcaggactacaatatgaaatgcgacaacttgatgaggtatgctcccgacattgtggcagatgacttccgcttgcgacggcaatatctggaagggcttcatcccagattgacacaaataatcgaccttcctggtacagtgagactagtggatctgatggcacatgcgctacgagtggagtcatatgagcctagcaagggtcagcaaagctttgttctcaatgtaaagccacgagttgatggatcatcaatcaaggccaagtcagtcaatgaattccccgccatccgcaaatccagctaagccaaattctggcgttgtgaattacgagaaggtttggtgtcgatattgtcaagggagacatcatgagtcaacttgctacaggaagaatggcacttgttacaattgtggtgggctcggtcatttcgctagggggtgtcccaagccaaattcaaaactcatgcttgggaccgagcatcaaaccgatgacacagggagtagtggcgagaggtggcggtacacaacagccgagaggccgtggaggtcccatctcccagcgggacgtgagatttggaggcagaggaggtagttttaatgctgcaatggtgtgattcctttgaaataggtagtcaagacctagtaagtcctcaaattgaaacacttcttcaatcttacacggatttattccaagaaccaactcaactacctcccaagagaagtttggatcattcgatcccccgaaggtactgaacccattaacttgcgcccctacagatattcacacccccaaaaatcagaaatagagaatatatgtgaagaactgttgagaaattcgataattcaacccagctatagtccttttgcagctcctgcactttaggtaaaaaagaaggacaattcatggcgcatgtgcattaattatagggaactaaatgccgcaaccataaagaacaagtatcccatacctataaatgaagatttattagatgaggggcgaaaatattctcgagaatttatttgaaggtccccggatgaaagaaagtgatgtgcataaaaccgctttcaggactcaccgtggtcattttgagttcaaggtgatgcggaatgacaaatgcacccgcaacttttctgaatttgatgaatgaaatattcaaggagaagttgagaaaaggggtattagtcttctttgacgatatcctagtatacagtgacgggatggagactcatttgaaataacttgaagaagtgtttaagctgctcaagaaaaacaaacctaaactgagcaagtgctctttcgggatgggacaaatagaataccttggttacatcatttctgaaaagggagtagcaactgatccaagcaaaattgaagctatggttcagtggccagtgcctaaaaatgtcaaggagctaagaggatttttgggtttgactggttactataggcggtttgtgcaaggatatggtggcatttgcagacctctcaccgaattgctcaagaaaggaggttttgaatggaatgcagaagctcaaaaggcctttgagcaactcaagagagcaatggtatcagctccagttttggaattacccgatttctctaaaccattcactatagaggctgatgcatctgatttgggaattggagctgtgttatctcaagataaaaagacaattgcatatttaagctaagcattaggagttataagtttggggttatcggcctatgagaaggaactgaactaatggcaattttgatggcagtgtctgtctaaatggaggcattaccttcagctgaaaccatttcttataaagacagaccaccaaagtttaaaatacttgcttgagcaaagattaactcaaccactccaattcaaaaccctaaccaaattcattggactcgatttttagattgaatacaaaaagggaacttctaataaggtaacagatgccttatctagaagggtaagagccagagaagtagagttgaatgctgagattttttgcattatcatcacaaagaactggatttttattatttcatatcttcaaggcaaatcgacccaatccagtggctgatgaagttaagttttgaaccttttttttctaatatccgttgaaaatttgtgtgtttctgcttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgacttttgactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtggatttaaaaaaccccgcgaattaacttgggtcactggtgtggttttagctgtattgactgcatcgtttggtgtaactggttattctttaccttgggatcaaattggttattgggcagtaaaaattgtgacaggtgtacctgacgcgattccggtaataggattacctttagtggagttattacgtggaagtgctagtgtgggtcaatccactttgactcgtttttttagtttacatacctttgtacttcctctgcttactgccgtatttatgttaatgccctttctatgaagcaatggtaccaatatgcaaatccacttttttaaggatctagagctggagggtcgacctcttttggataagatagcatagggcatgccccgcccactcttaagactaggtacccgtagactagtttttactactcaaagaacttccctatgcaatggtgctttctagttcttatctgcacctacatttaggattaaccctattcttgataatgggaatcacgaacatatcataccaagcccgccaagcgggagaaggggcgaagcgagaactcaggaatgaatgaaccaagaagggttcaagacaaaagaattctactcagaatgttgatcttctgaccacgaaactgagcaagaagtccatccgatagtgggggagatcaaaaagtacttttttatgggcagaggtatagctatcaagtagaagtctttcgctgtgactagggatagacaggagatgatccctcggttcgtctgagccggaccggagtcgaatacttcggatcctgcatctgcttcagttgattaggtgcaaatgtgccttttggaccgatcctacgaataagaggcattaacaaagcatttatgagacaccatactttcaataggcaagggccagcccgaagatcagcgggatctttctccaagctaagtttcgacccccgagggaaccggccacgatgcgtgggggtatcggtgctgataaacttgtctccgctcgctcccctgctcgttcaaagtattccactcgctaggatcttagtaaataagcttgctctgaccttcctagctttgagagcaatactacctgtaataacacaatgaacttatcctacttagggaacagactggcatcaaggagtccaaagcatcggtatggctcgagtgaaaaaagagaaagactattgtcgtccgtcatttcacgccctattgacattatgactaagaatagggttgcccattcctgccatggtccatgggatcttcgagttgcgagttagcttagagttagtttaagaatcacaggggaaggcaaaggtagataatctggttccacctctttactagagagccataagcaagatttctataactgaccgttaagataacaggcataaccagaagtatagaaccttccttttacaagaaggagggacttgtgattggttttctacagggaagagagataaaggcaggcgacaagaaggcggtcacttgctgtgagtaaataggggccaatggctcttccttaaggacgaggttgaatctccaatcctaagaagacctattacttgcagcagctcctagtactaccgggaggggccgggataccgaacttaggtgggaacttttgctattgttcagtgaagattttctatttatttgatgagtctaggaacctatagtatagatagtttctttttttagtgataagtccgtgtcattctttctttttcttaagaagaacatcgaatcagagtctttctctttgtaagctactggttcaaccaaagctagtctttccgaagccttcgttcttataattttgagatagccaaccttattttttttcgtggataagctgctctttcgaaaagagctctaacatcagcagctgggtcccaaactcataacacataacatagcagatttctttgatttctagtgccccaatgcgccgccataagggaggaaagaaagctcaagcatcataagccgcccaacccccttcccctttacagcactcctttcgcgccttgtagctctccttggagaaggataagaagcaggagacggataaaatctatataaatagaatgaggcgagtgatttctttaagaagaaaaaaccaagtgttcagctaataaaaagtaacataggtcagcgctgatgccgatcaggtaccaaaacccagatgtaaagcaagatgtctatctacgatattactgaacctgaagaagaaaagaaaggccgtatgcacctgtagttaaagcataatcagttgcgttatacatctatctactgaacaagataaatcttcctctccaggtcgactgcatcacttcactaggtatggttgtttttggttcataatggtggtctaggagaacccgaaactagagcacacacgggatatgcatttttttttatggtttgtgattgttgcaaccacctctcggtttttttctctgttgctgatccagatatccatcttcttgcttgcaggtcggtccattgtatctccaaattgttgccttgcatgctgagctgctgggctttcagtctcaggtccgccgtgtttcctttcaatttcatgtttttactatattttttttcataaactcaacaatagtctagatgagtggtcggcgggttgagatagtgatattcgggagttaggcgatgtaggagatcaataactcgcatctctaaggttgagctacttgcatttgcccgctttcaagagtactttacttacagttctattgaaagggaaggtgataaaaaaaatagagctgattggtcaaaactctttccctttgaatcccttaattgttgatttgagtgcagtgcctgtaagggtagcttggaaaaaaagaatgaaagtgaaatcatcatacctcataggcgcacattgcttacagtaggtctcgatgtgttttataaggaaacttttttcatcataccgatttgccggtgtgatttcattgtttattctccttagttcgttggtcccaattcttgtaatgtcggattgcaactctcgaaacattggattctcgggccgtgtaggaacataaaatccccggttcggtccaagtcgctcatgggatgcgaggtataataatagcatgtagaaggcccctagttagaaaataagcaattcttccactttctctctgttgcctatcggattgtcgcctgttgatggtaggtttgttctagaggtagacgaggcattactttggctaggtggagtgtttgcgagtaccctatctatcacattgatcccctcaagatcattttgaaatagaccatttattcgtaattacattcccggaaggccttgaacaaatgtctcatttatggatacattgggagcaaaattggaaaccctagctagtatttattttggaagattaataacccagtccctttgtttttggttaagaccactagctctaaccggccttggtttgtttttcctaaaccttgttccttgtgcaaattttcaagcagattttcttgattaggaaattccggtttcaccaagctggtattaatctcaatgagagggacttgttggtcaataccgaaagaacctacttatggtggtaccaccgtttccggttcggccaaaacaacaacgatgtcattattatgaggaaacttaagacattggtgtaggctagaaggtagcacatcaacatctcatgaaacctttcctagaaggaagctctttactgataggctagcctaggctttgattcgtggtttacttcaacactgggctcttcttaaaagcaaaaccggtcgcatatgtcgttttctcgcttcactatatgataataactcctagtatggcacccaatactgaatggataagcaattggggctggtggttcccactgtagaatgtaccagcactgggtcaaagaggcctgctaggtgagagcctttcataggatgtgccgaaaagcctatcatatcaacttacttatacggaatggaatgaatttcactcccatgacttggagatgggaaggccgaccactacactacacggagagatttctataccaagtcatgagcgatagcgaagccgcctataggcgtcgaaggacgaaagtccgttagacctccaagccatagcaacctcttggggaaattacgagcaccgcgttgcaaatgcacgagatcaaagaaatctagcgaagctgtggatgaggctggctaatgggacggtcatctttcgaaccaaagtaaaaggcacttaagtttcatcagattcagacttacggtcagtgctgaaaccaatggccgaacatcccacttaagataagagcccaacccacttccttttttaggactctgttttgcaagggcatcaaaatctttagcagatcttccttctgcttgatcctttttctacaggtcgggatgtcatcaaagccagggctgctcgcctttccttttgacggcttggcttcctatcgctcctatgtagtggtcggccttaaaagtatctttggaccctaccataccatcatgcatgcctatgttatagtgcgttaagcttcgccagaagcaagcaagatgatgaagcgaagcttcgtagacaaggctcgttccgtgcttgacttacgagctcgtgtagtaaggcctccgccctatctatatctatggatactgaagtgtggccggtacttgaatttttcgaaacaactttttgttgttcttcttctgagaagcctctattaacaatcagtggtaaaggcattgtattgagaagcgagcccgatgagcctagctctaacttcgggtggattgaggaatagtgctatagataagcattaggtttaggtcgcccataactgaacatagcactatcactatctgaaggatcggaaaatggaccgcccaattgaaatgataattctcgtttctcgtatagaaagagaaaacaattagggctctaactgagctatttcttgtgacacaatcgatctgaagaacaatatgcgcagagcgcagccttgcttcttcatgaggtattacaaggatgactaccacctggaatcactcaatcagcttacttgacgataggaagtgatggcaggcaggatacatcacaaagtagcgtagcagggaaagaactgaacagaagagatccgctgcctactatacaagacaagtttcccgttccggtttcggcttgagggaagtgcatgaaatcgattcaatggaataaaaacaacaggagctattcaaccatcgttagaggcaaaccttagaagaatgctggaagaagaggaaagctgattgataacacttaaccaaacatcgcaaggacaggaaggagtatcctgaacgtaaggccaatggctagcatacttcgctgaacactcaacttgatctatatcgatagacacatctgagagaatcatagttccccctctggggataactagttcttctcccgagtccttgttttgtatgagataacagcagtctttgcttaaccgagcatcgtagggcttacttcatcacacatagctgtctttactttcgtttcgctaaccgcccaaaagcaggtgcgcacacacaaatgctaggcgagatacgtagttctctcaacccttcctatccatcattacagaccggaactagatcggattaggtagagcaagaccttgagcctcttgagaaaccaatagaaacgacagtagctagcttcaccagaagaggaagaaagacttctataacttcacttccctattgagtagaatgcatggcaagtttccactgctttaggctactctactaagactcgagggccgacttcacgtaactaaatggcttaactaaactaaaaaggaactaaactgggagaaatcagaactaaaggcgtactgtactttgcttaacactcactatattcagcaaaagctggatgcgtattatattatatcttgtcgggcccttcttctttcttctttgaattccgatcgtcatccaacataccagtaacatgtgatgatgcacccgaatctactgctctgtgaagagttggaaaggaaatagggcggtgggtaaggcctatttcagaattttgttgatccccattttctacttctcttatttacgatcagctcatttcttaatttcattatacatctttctttgacggaatgcagcatttgctccaatgactccctctgttcatcattttgtaagtggaacgtgatgggattgtcctcctgtatgggtgggacatgttggtcgtccccggggacaatctctacctccggctccgggtcagggagcggggcgttcaaatctagatccaaaatctctctactcggtggagcttcgtccacgggcggaagattttgatccaaaaataagagttcgccagcagaaagtgcaacaccacttgtataaagaaaaaaatgaaggaaagtgacaaagtcctcacattcacggaagtaatggtaaggaaaattccttacttttccatttctttggaaagctcctactaagattagaaattccccaataaagctgctagtgccgggtaaactcatattggctaaagtgaaaaagaagaagattatttcgacttctacagcagacagcacccatctccatagtggagaggcagatgaggaccctgaaaaagttgttgcggcaactccaacgagaaagaataagcacaaaaaagtagtaagagatcgtttggggacgagcctcctactcctagaatgtattttccgacgagtttagatatactcttggagagacaataacatgatcacttttggacacaattatgtgtacttctgctctccttggattagagagactgatcccaactggccttggccaggaaaaacgaagaactttttatgcgatctacaaacgaatgagatcagaaagataggcggacgacttgaccataaggtcggatgtttccgtgagcagtaagctgcggatctccccttttttgggggaaagctggtggcccttttggcgtgttaattctttcgacggggcggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttgggcactggatcccttcggacctggagaacgtgtgacactgggtcggggtttggtgaaccaacaggtcgctcctttagttgaagtatcgggcccctttttcgttgcctaggttacaccttcggaataccccagacggggattgagctctattccccccaatcttcactttacgccacgccgactctccgtcgtggaattagaccaagggtcgaagacccataccataggaccccgtcccccgtatcttatctttcgcgcgtaggagatcgagacacagccttagggctatggggaaagtagatcgattgccctagaattacaactacatagagggtctctacaagtctataaagaagtttaaaaaaattgatcggtagtagtccggtcgcacccgaacaataatattccagagggaaatgcacctaagatcaaatattttgagccggcttccgtggaaaattcagactttctttttgatgctgcgatcacataaaaacataaactttgaagctcaatagctaaatacatggcaattaaatcatgagccgggatcattaagagcatactgcgagtaggaagtggaattaatacaatgaattcagaagcatcaaacctctctttttcgaaagaatcgaaacacatcgaaatggtaccagccgtacttaataatagaaggatttggcagaaatatgtaaaattgtccctcctaaaaaaattattccagaataaatgggcaatagttaggagaggtgcgccagcggcgagcagaagcaaggttattagataccgaaggaaagcccggccagaaccacacgtgcaagtttccctgcatgtggctcgtccgtgataacttcttcggatttgcgtgaactagcggaccgatcactaagtggttagtacctccagcatgagcgaaccttttcagaactggttaggaatgggcgccactatcccagcccggatccagccaggttctattgatcatgtccccttcccaacagttgtaccttgtcttggggtctttggctttactatcaccggaaaaataaaagtctttctcttcccgtcccgggtcatagtgaggcgaaggtgcgtccacagaagaggaaatcgcaatgcatcttgctcagcaggcgtagcttggagtgggagtgttgcgggagtaaggtaaggaaagtgtggcctaagagaggaaccaaccagggccttttgagcgctgctaagctaatatgcgccagagaaagaaaaggaggtaactattcggtccggagcattgattccccctaacgaataggctaactctatctctcaattgcctatcctgtactcgagaaggtcccccagttcctcggctgcaccttgaagtgcatttagttgtctaactttagactcgggatattccccactccatggcatctttcgcttatccattcagcccgcccgcccagacgcggcgccctttcgcattatcatctaccgccctttctttcctcccgtcccttcacgcatgaagatcgtcgtatgtatgttcgacttcggttgccggtgcaatagaattggcgggagtatattatggcaggatcagtcacctgggcaaaccaaccctcctccaagaagaattgtgctatgcccccccgatatccctatagagcgaaagagctgcctggtgatccctaggttgcagcacgtccggtcgttaactcctcgctagctgccgccgtttttaggaccgaccgacgcctcacctgcatgcacaggtacctacgtagtgtagtgtcggtcgcacattcataatagcgttcggactcatgtgccttcctgaaccaggggagttcccttgctcctgctgcgtacgattagccagccttgcggcggcaaaaggattaggacgtccccccatgctaaggttccctgcggtccggccgcattaggttagggagctgggcgataatagctcctccgcaccccaagcgcgctgccctcctaggcgcgcaacactaagtaatccaagccaacccacattactaactaacggtggataatcatctttcttagaggtactaaatacaactccatgaatgagcaaaatgaaggttgcgttaatgataaagatctctggggaaaccgctaaaaaaagattgaacatgtggttccgagtttcgataacttcttcagctttcattttcaatactgatcgtgaaacaccatgagcagcaggatgttgaggtccggaattcgaagtgaaattcttgatttgcccgttcctagtcgtcatgggaaagaaataagaaagatattattattccttttctcttcagctatgtcgaagatatttacttatttgccgctccttggctgtcaaaccttccaattcgaatttaaaattccaccccctctctcgaactgagctattccgatgataaatcactaggacgacataagacagacacataacctacgtaccacaatttctccttaggcgcatgtctcgggcagatctggagcgactggattgaacagaaagtactctcacactatagaaaaagtcaagtccactaaaagtacatgcactcttttcttacacttatagagtttcgaagaaaagtactctcacactataggtagatggctaacatcccgggctacgctatctacgactactgccacagattgaatgaattgtgactgagctcgaagagagagtttattgctttacccgcgagacagtttgaacctcgataagtcagtgtagtttaggcggtgactcacatctgatatgagagataatatatatgcaattcgttcgaacttgcttagtagtgaattgggaacaagaagaaaaagagggggccatggaatacactattgtagtagctgaaatggcggattcccctgctacattacaatacctcgctccttatacggccctggctgagtattttatgtaccggcatactttaataatttatgatgatctctccaaacaggcacaagcttatcgccaaatgtcccttctattaagaagaccccccggctgcgaagcttacccaggggatgttttttatttgcattcacgccttttagaaagagccgctaaatttaattctcttttaggggaagaaagtatgaccgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatctaaattggaattagctcaattcgcagagttacaagcctttgcacaattcgcctctgctctcgataaaacaagtcagaatcaattggcaaggggtcgacgattacgagaattgcttaaacaatcccaatcaaaccctctcccagtggaagagcagatagctactatttataccggaacgagaggatatcttgattccttagaaattggacaggtaaagaaatttctggatgagttacgtaaacacctaaaagataccaaacctcaattccaagaaattctatcttctagcaagacattcaccgaggaagcggaaatccttttgaaggaagctattcaggaacagctcgaacggttttcccttcaggaacaaacaacaattttgcatgtctactcttgttagtagaggagaaatcgttgagaaagatttttcatttgaatcatgcaaaaaagttttcttagtttttagtatagttatttaaagaatag

SEQ ID NO: 70291 - DNA, 926 bp, Oryza sativa
  unsure (1)..(926): unsure at all n locations
tatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagttgcttaaggaaggaaaatcaaccgagaccccgttagtagcaacgagcgagagcggaacaagggttttcatcaaaagaaatccgaagcggtttcattcgatttgttgtggattggatgatggaaaaaccagcaagcagcaagcgtaggctgtgttgccgtagtgcgccctacggagttgtacaaagtcagcaaccgttttggggcgcaagcataggcaacacaggactgatgacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaagggggaccaccctataagcttaagttannnnnnnnnnnnnnnnnnnnnnnnnnnnnnnnnnnnnnnnnnnnnnnnnnnnnnaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaagatttacgttcttcctattt

SEQ ID NO: 70292 - DNA, 7515 bp, Oryza sativa
  unsure (1)..(7515): unsure at all n locations
aggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagaaatatagtgaaatcgtctttcccattctaaccaaggatatatgtatcaaaatcgctctaatacggtcccgaatatgcaacggatcggcgtttttatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaattgtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagatagtcaggaaccttcttttgacttgaccagcttacttgtatagtatagtagtaggcctttgcttctgaacgaccttacgaatggatcaactagaaatgaatcggtgtcataaacgaatttagctaaccgtagtagtaaattgcgtgacaccaagcaatcgatcaaagccaactcaaaagaaagcccatcccttcatccaacgtgaaaatattctcaagaagaagccaaaagaaagagaggtgaaacagagtagagagaatcgggtgcttccagtgattagttatcagaaagcactgttttccagatcggattcgatcacagtcccataagcagtagggaccacgagtgagcatgagcctatttcgtgatcggctagttgctcaaaaaatcgtataaaaatcaagcaagaaaacgtatgcgctttagcaacaaagcgctcatcccttgttctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcnnnnnnnnnnnnnnnnnnnnnnnnnnnnnnnnnnnnnnnnnnnnnnnnnnnnnnnnnnnnnnnnnnngagcggaacaagggttttcatcaaaagaaatccgaagcggtttcattcgatttgttgtggattggatgatggaaaaaccagcaagcagcaagcgtaggctgtgttgccgtagtgcgccctacggagttgtacaaagtcagcaaccgttttggggcgcaagcataggcaacacaggactgatgacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaannnnnnnnnnnnnnnnnnnnnnnnnnnnnnnnnnnnnnnnnnnnnnnnnnnnnnnnnnnnnnnnnnnnnnnnnnnnnnnnnaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaagatttacgttcttcctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttcattaaagcaggaaaatgaaaatggaaaatgttttaatgtttgatgaccagcgtactacttgccacggtcctttgtttgaaagtcagtgagtgagcccatccgtattgtcttcatgccagaatgggaactaagagctgcggcttttgatcccgggaggagcagaatggctatgtgccttttgtccgtcctcacctgtacacttgtgtgattagactcccctactttcctgccagaatcggttgcctgaatacctttatcctcaccggaaaatagagtctacctttttcagttatcaaatcgactagggatagcctattgatgtgaagattaacttatagcatcagtacttttattaatcctcgaggggcgaatggcggatggtcggcaatgaaaaaaatagcacttcataggtgatccgagaatagctagagtgaaagttttcctaaagacgcaagagcttgatcgctaggcgggtcggtagaatctatggaccgaaggttccacgctacacttacgaaggacaaggctattcgaaatatgtaagtcggcgaagtcaaagagtccttttgaaggggttgtgcagaacacttacttttggtttatgagcaactgttatccgctgaggccccccatggtatgcggatattttccattatttggtcactaatgagctacctgcaggtttgtcaaaggctaaaagggaaaaggcgcgcagcggtgaagcccattactctgtatgggatgatccttacctttggtggcattgtgcggatcaggtgagaagaaagaacttccgataatgaaagaaggccttttagcaggcaactgatcaaaagctattcctcttagccctagtagccctagctatctaatgcatactttccaactggccctggcctataacggcaaatcactggcgcatgacttgaaattgagttagttagagagcattaattacatcacaaattccacctagggattcctctataaaaaagagtaatctttttctttatgtaactagagatgtagcgacgagccagcttggatgtgacgagcaagtatttataattacgcatgaaagctagtgtacagaaatatcccgggggaaaagaataagtatgcttcacctatctttcaaagggcatgccaggtaataagctagaaagcaagtagcccaggaggaaagcttctaaaaaagagttgtcagaaaagttagcccgatattgaatagttgcttggttaaaaacaaccaacactatacagagcatacagccggcatttgaaggaaactaaagaagcaagaagaaggacctttctggcgcttgtagtatggccctttcttcacatctaattggtctgggataggtgcttgacttaattacttccagcctgatagatggcgttcattttcttataagcacctctctattcaagatgcattcaacatgggcagcagattaagtgatttattattgtcccttcttctagaggaggtgatacatcatattgtgacagtccatattccatgctttgctggtgagaaagataaactacttaggatccccgacaaccatgacatcttctcaacgagatccgcttttgatgttatcagaaggccaacgggtgattccactctcctcgctagcgtcgatcggtattctattacgaaagagcctcttcttccccccaggaagatgggcataatcatattcatttcattttcaggcgagctctttgcctatcgactacgcttgccgtattgcttaacggcgtactctattccgcctacagacaagtcctatacttagcttccttatttgattattggtcttgttgttctcggaacttgtgcctaaggctctcactcgcgatactcaccgggcgatagatagtcacctgagccaagaaagtagatgaaattgagaatagaatgagaatgggctttcagctttcatagatctttcctctcaaaagaggtgttacctaatccactatgtcctttgtttaatactgcggtaacctggaatttcaaaccttttttctaccctcgccacttctttcgctgaccctatccacctcctttgcggaataccagatcaagagatgaattagcggatcacagggctaagtcgaagcatgccagaaccttctttagtagtgagccgtaccgactagctcctagcaagggcttcaagatcacagtaatgcttgccaaaactttccttgggtacgaatgtcatgttcaaagcaggtttctctagacaccttggaaaagatcactgacgagctcaatctcaaagtgtgaatgaaattatcagtttcatcctctttatgagcctgagatcatatgggtcaacaattctcatttcttagttatagaaagcccttctcaaggaagtgagccactcaatctgagccagcggattctcattcagctgtgccggtgcgcaaagcaagcacgcttagacaacgatgtccaatctttggtctgcccattaagggctgactccgctaggcaagaggactactactgggattattctattactaattgatgacctgggctcttctttctccactacagatattgactgacctgttgatagtatagcgggggcagtaaagaggaaaggaggaaaaagaagtagagttaggttctgttcttgtgtgtaagccctcggtcgattcgtctgctcattcgcagcgtatgattcttatccaattgcttcttctgaaaacgcggcgtcggttaatctttcttattctcccttcggggctcctcatgttgctactaatagaaacagttcggaccttgctcatacaatcctcgggactactattggttaatctttgtcctccctagggaaagtaaacaagacgagactttttgggaaagacagggttagcgccctttggttggcggaagcgagaatcatcttttgattttttgaagttcaatttctatcagaggacaatatgaatattataccatgttccattaaaacactcaaggggttatacgatatatcgggtgtagaagtaggccaacacttctattgacaaataggaggtttccaaattcatgcccaagtactcatcacttcttgggtcgtaattactatcttgctaggttcagttatcatagctgttcgtaatccacaaaccatcccgaccgacggtcagaatttcttcgaatatgtccttgagttcattccactaaaatacctttgaatagcgctgaagatatcattgctataaattgaaagaatagagtgagatttgtatttgaactagctaaggcatacttcactgaactcctgctttccagtctgcgcttcgcttcctctcggtcgagtaagattcccttagctttgatttgcttccatctttctaaactctgttgtctcggaaaagaaagtatcatgttgctcctcggaaaacgcgtatagtagtctcattggccaaagtaaagtcgatgggacgctccagtgtatgcgttactgtactgggaagctagcattttattttgtcatggcgcaaaagcagatatggtccggtattcccttgttccccgtattggttatgttctttattcctcgtctagcagaaactaatcgagctccgtctgatctccctgttccgcatggcatgaaaaaaccaatcaaatcttcgtttccttggaaaaaccgaggccagttgagatcagtctccctttctaggagcagagcttaaaaagatgggaaattccaatgaatttcgatcacaatcatgtggtaataatgggtttgaatcagagagactcgatctggaaactcctcaatgattataacgtgaactcgttgaagagaaggagacaagcagaaatagacgctttttttgaaccatttgagagggcgcagcgtatccgtttcaataactggcagaacggaatagagttgttagatggggctgaatggaggaacggcgatatagttatccctggaggcggcggaccagtaatttcaagccccttggatcaatttttcattgatccattatttggtcttgatatgggtaacttttatttatcattcacaaatgaatccttgtctatggcggtaactgtcgttttggtgccatctttatttggagttgttacgaaaaagggcgggggaaagtcagtgccaaatgcatggcaatccttggtagagcttatttatgatttcgtgctgaacctggtaaacgaacaaataggtggaaatgttaaacaaaagtttttccctcgcatctcggtcacttttactttttcgttatttcgtaatccccagggtatgataccctttagcttcacagtgacaagtcattttctcattactttggctctttcattttccatttttataggcattacgatcgttggatttcaaagacatgggcttcatttttttagcttcttattaccagcgggagtcccactgccattagcaccttttttagtactccttgagctaatctctcattgttttcgtgcattaagctcaggaatacgtttatttgctaatatgatggccggtcatagttcagtaaagattttaagtgggttcgcttggactatgctatttctgaataatattttctatttcataggagatcttggtcccttatttatagttctagcattaaccggtctggaattaggtgtagctatattacaagctcatgtttctacgatctcaatttgtatttacttgaatgatgctataaatctccatcaaaatgagtaatttcataattgaataaaaacgaggagccgaagattttagggggcgggagaaaaggtcaagtctaagcgacatatggcacgaaaaggaaatccaatttcggtaatccgaagcccaccttaccttaatccattttcttgaggatcttgcatttgttcgttctctgccgacctattgtttccatcactcctgttgcttcttcctttctctatccaacccgagctctatcgcccatggctgaactcttctctg

SEQ ID NO: 70293 - DNA, 5265 bp, Oryza sativa
gaaggaagtaaataacaacacttcagcgtttaggtctaccttcagtaaaccaatagttttgcagcattggaatttgagttggccaggtaaggtcctctaaaaagaaaagaagaaactacttagaatagataaatgccattggttttctcgtactatacgatctttttttgttttgttttttggccatgattgtgctgctcctgtgaaggctagtgggaaagctcaccgttcgttgtgatgagtgggggccttgtatctgtattcggatcagctccttaacagagtttcctgcttgaaccctggctgggagctgggagaggtgtcccactacaggtgcaaataaaccatttgaccttacaggggaaaggaaacaaaccactcaataatcggtagaaattcctcctactgaacagctttccttttctcgccttaactactacttcaaagcaaggcggaatatcacgggataggaatgaaagaacttcttactcaactttctagctatataaaaatagttagcaatatgaaacgagtaacttaagccctagtaaaaggctactctttgaatcccctctttaaggcatataaaattagtactcttcctgagctagcttaagcatatcttgagcgagtgagttgtatttccctccatcaagttctaagcgatcaaataaggtccttgctctcgagccaatgccaataccaatagagagggtctaaacgaaggattcaaaggaggttaccggttaagggcaaatgcaatctctaagccagttggagaagaaaggtaatcaaagaaagtttcagttggacttaccctgccaaccctaccctaatttcataccctgcggttttcgttcctctattgatatttcgttcctctccttacgtcgagcgacctggattattctgagcacttcgcacttctgaaaatcgtataaaaatgtgtggttccgaatgagataacgcgcaacggctttcgcgctagttgctcaaaaaatcgtataaaaataaagcaatcaaaaggtgaaggcagggcagtgggcgtgggactgtaaatcctttttcgttcgctgggcctgggccctttggactctaaatccaaacggagtgagtggttcgattccactttagaacgaaagcaaatgcaagtgaaacgagacgagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgaattgaacattggttaaaaagaagagagagagatggcgatggcagtctctctctctcttctttttaagggatattattgacaggcaaaaaccgtttttgagaatgataatacttcatggtgtatgtagaactcaacatctcagtaatttgcttctcaatttcatctttaagggctggattatgccggtaattacttacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagtccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgttcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagttttttttttttgaatttcgaaataaaggttcttgtcttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaagtgat

SEQ ID NO: 70294 - DNA, 4474 bp, Oryza sativa
cccgcttttctttcgtattttcttctttcattttgtaaacaacctggtagcgaagctgcagcttgataattcataggggccatggtgtcaaaaccgggttacctaactagggaaaaactgttccgaagctcttccaaagcgtggcaggctgggcagcttttaccgaagcggaccccccgcccatagcaaatgtttgttgtcatatttcaatctagggggctgcggcacaacctgggtgtggagacatgaatgagtcgaaccctattcatcatgacgtaatgtcaaagaagtggctcggcgaggggctttatgctgattcaaggccgaaggacaaagctcttcctcttcgtgcttgtcctaaataatgatattcactgaggtgtgctggctctgcttcaatccgttttcttgctccatgccaatcgaagatgaaccattcaccgagccgagtatgtgcaagacaagacacggctagataagtcaaatagaagatattgcttttacacgagcaactcttaccttcatgtaggtacagcccacttttcctttgatgaaatgcgaacacaaacttcaggcatccaagaaagaagtcaagatcgaaatcgaagcattgtcattgggttgaagatcaattcatatcgacaagactttccattcatctttttgttgatatttggattccgttttcaaataaagtcatcttctagttttaaatcacctttagaatcatcagcctctgtccctacactgactcacttatccgggatcgatcctcactacggtcctttatttcgaaacgaggatagggctctcgcggaacgaggtgtagattgagaagaaagatgagcgtatggtccatactcactcgggttcaaacttattcttcttttttttccattcattcaaccttatatatttgatccccttctcccaggtgcgagtctattattgaggaactgcgagctccttttctagagcttccttcccatttaggcggggtgttcaaaggggttccaccgtcaacttaagttaaggaaccccaactcccaatttggcatttacttcttgtgtttacagctcaaatctctatcgtcgtcttgacatccaattccttacggcagagacctaaaaatacccattgccggctttacttttgcctgtggagacggggtgtggcataccttcccaaaagcatacgggatcctatctttgaaaaagcaaagcgtcggctagttctattctaacctgactgacttcctcaccaccaccgcttacggctatttcacgcttatttcattcgtagggccaaaagaaagagctccaacggcggctaaaagctttgaagctccttctacccttcctgtgaatgaattggataaaagcctttatgcccgagagtgaaaggtgctccagcttgcttggtgaacactgacttactgaagaccggaatggaccaatgtgacattgactcaagaaggtagacaaaaaggccaactatagaaaagccaagctgactgaatgaaataccgcagttcactctgactccggttcggtacctactctatatctgaagattgaccacagcgtaatgccttaccgctttacaccttgctttccttattttagctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaatataaaatatcttacccgtgagggggaggcaaaagggaaaaagctagtattttgaaaagggtatagtagctggtattcggattgagcagtgccataaaaggaaagcgttgttgtttttcctgttcaaccaccccaacttgtgacgtataacgatgcaggtatctggccagcattgaccgttcgagttgatgagcggaacccagacccatgccaactggacacccgcaacgtatgtccacccgccctttcctttgataaatcctattcctatcgatttagctgcataggcaatacgacgttactacgaataaatgacgagcgaaccctcgaaaaccgaatcgggattatccacttgaacagatgggaaacacaaagcaaggtatcattgtttataaatgtatcgattagctctgttgataaggatcatgatgaaattgcaagtacggatggattgagacccgatctgttccgatcctttggcatgggaaatccttccttttactctctcttttgaatgagtcgtggtgcgctcatcaagaaggggaaagatggatgggaaatgcttgtcaagctcggttctttaaagaatagcatcctcgtcttcctagtgaaaagcgcattgggattctctacttgtggtggtatagtgctgcttttagtgatttggagggtgcctcccgtgggcatgcctgctacgctgattaagcgggtaggcagatggattgatctactcgttcaacttgcttgtgttggtgagttgttctattattgattggtcgagcccggaggaagagtggccttgagtttctcgatacataacattgtctaaatcaacccaagtcgcttcttcatttctctaaacagactggtagttgggtgagggatgtttactattgattggttataggccttccttccaagcatcaaagaaagaaaagagcaaagcaattccaacataaactgacactttaggatcctctaagcctttctatagaacccctaagtagggaaggtactaaaaagaaactcaaaactagcactactaacacaggctgaagaggatgacctcgaaaaagaatacaattaaagatgtggccttccctccaagcacatatatggatatggagcactcttttccaccctatccttatatatttcattcccgccattgacagcaactcactcttttcgaactgcactttgaaagccaaagccaagaaagaccatatcaactactctccaaattgcaggataagtcacagaattcaaatggaagacagaaagagaaggcaattcaaacctaatggccaaacattacgaatccaagacagaaagacttatagccataaaagaataacaagagaacaaaaacaactccatattctactggcctgcctctctgatctactatccaactgccatggaagcaccactgaagactggcttctccgaccttccacccgatcctgggcgatcccggatcgacaagccgacggtatggattccctatatatggatggtaggaacgcttcaactgcagagccctgaatgcgtcagtgaggttccctctatgagagaaagagaggttgctaatcttggatcagacggcgtgttggtattattgataaggcttggattagcaaattagcaccgcttgagtttaggtattcgaaatagcgaaatacataaattatctatctcaagtcgactctagatccccaacttatcttgagccatcagtcagattaaaagcagcgccctgccggcagctcctgacctctgttcctatgggagaaagaaggtgtggctttggaccccaaactcttccatgacggccttcttccactcattttattagcaatcaaacctcttccctgctcttgcactgaggtaagcattcaaatagcaaagcaagggaaaaaatatggtatgtatttttttaatctacatacagagaaagcggatgtgcccttattagcgcagttgaaaataaaatatataacgcgtagttgcaagctttctttcgtgagctagctatgtttgcttcctcttttcctctctgtttcggatgtcaacccaatctctgattcaagtccataagttccttttttatagctcctgttgctcttctctggctaggatctcacttatatggccttttttttcttttatatattatatagtaagcttcaatagatagcgtagtaggtgctgtctctatttactttctttcttacgcctaggtgctaccttctttccagttccgtaagtcccatagagttattttttatctttgattcccaaacgctgcgcgcaagtcaagcttacagaattcctgccggggcgccttttttcttatgccagccaagtagcaatcagaaaaccaatcaatcttccttacactacgacaattcacttgaactaccaacatcatgagtgacccaggccggccgtatatgcgtcatttctcctcatccttgtctctatttgttaattgctcgctacccgtagtgggccttgagtaggatttaagcacgggtttcgaaccgtctacttttccttatccttatgggaatttaagagagagatcactcca

SEQ ID NO: 70295 - DNA, 1724 bp, Oryza sativa
gcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaacaaaatatctcaaaaaatgtctataatgatggactgaaaatacaagaaattcgcatgttctctttattatgttttcgtatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaattttttgtggtacttttagtagattttactctgtttatcctttactttaattcagttttaatttcgatgtattctgtaatgtaaatacaatgaaattaattgtgtaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagcttaacatggtggttaaccgtattatgaaagacggaaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggactttttggagattggatgcagttactaattcatgatctggcatgtacagaatgaaaac

SEQ ID NO: 70296 - DNA, 10801 bp, Oryza sativa
  unsure (1)..(10801): unsure at all n locations
gctcctacggaaccaaggtcgaaaggattgaaaaagtcagtcattctcaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatagcattaatagttgagtctgaaatgaattttctcaatgtatttcatttacacaaaattacttaacattaaagacactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttagtttttttcagaatcctatttttgttcttatacccatgcaatagagagcgagtgggaaaagagaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtttggcctaatgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccggaggagaagttctagatacttttccgaactttgtatctggagtacttcatctaatttcctccgcagtcttaggcttcgggggcatttatcacgcgcttctgggaccggagactcttgaagaatcttttccattctttggttatgtgtggaaagataganataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttagccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggggccttgagagttcctcttgtggtagcaagttacttcgcaacctgctcaatttggccttatagggtcgggaactaatgaataaaaagggttggataccgcccaaccacccagccctctaccatatctagacaaatagaatagtccttttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgagaaaagaattgggtttccaccgagctgaaacaatatgctgatggttctagtaaaccaaaactaccgttttttagctatttggcttccatttccttttttaacaaaagaagatttagttacgattggaaataaatttttttgtatctttatccatagatcctttactcatattttaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccatataccattacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggacagctatagaatctggacccatcgtagagacgttcaaaaggctcctgatgataagaatcatactttcacggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcagaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggtgcattcgactaggtcgtactttgaatccaatttcaagttcgattagaaggatagaaaggccgcgaggatcggaaaagaaaaatcaaatctttttaattgcttctccttttttgctattttcttattatttatataatccattcgattcttttttttttagaatactaaagtattctaaaaaaaagtattctatactataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatatggatcttttgtagtgtaagtaatataatatggtatgttatgtggctctttctacacacaaatgcaaacccgctatggatggggattatggatgcggatataggctacaagcataaatgcatgcatatgcggaaccgggtatagcgagtttttttaagtggatcaacaaatactttttgaatagaaagtcaatgtattctaaccaattattttacaggagtatctagttggcgaaggcgatttcagaatcaaaaaaagtaaagtcaaaattgtcgcgaccgggaaaattgccttttcccgaacgctagtgtattaatccccgtcccaggaaaagccggggtacaccatacaaacatgatataaaagacacatctttattacatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggataataatataggggttaagttttgcagtaaacagcatttaaaagtcacttagttgcccaaagccattttataaagacgatcctagagctatacagtattattaatcacggccatgaaccctcacgaacctgccttaacccaaggcctatgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatcctcctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattctaccataaaccaacaattccatagtgtccaaaagatatgagaattcccaaagtctaaagttataaaaccacctaatgttgtcctattaatcagcgaagcatctacctaaattcatactagtggaaccataaatagagtgtccactagttggggttttgtttattctagggtgaacaaggtaataataacaataacaataatagtatggtcataacaaaggtaaataggcatagctaaataaaacagtgataacgcgggaatttaaataaagcgataatgcattaatttaaattaaaaaaaataattttgtaaactgggattcaatatgctcaaggatgatgtgacttgccttgctcgctttcccaaacgacggcttcgacttccacgaagagcggatcttccgaagctgcagcgtctacacgaccaacggaaaagaaaagggcttttactctactaaactccacataacagcagaaacaaagcacaaaaatgggttcttgacttcttaaggaaaaaattagagacttgaacggtccaattccgagttcaaatggccaagatatggccatttgaagtttatatgctctttaaatggatatttgcgaatttcttcatttaaattttaattacaaa

SEQ ID NO: 70297 - DNA, 859 bp, Oryza sativa
ccaataaggataccactcttactagcaaggtgaaggacacatcaacccgcatacccttttaccacacctaccccttgttgggcacgtttacgcatctcttgacccatccacatgacccgcttggctaactaaaagaagcttctcggagcatctatgcatatgagaacggatgccgagtaaagggtggccagcttcgacctttgctttgaacaggggttagcattatcaaaaaccattgctcataaaagggatctctttcctaaaaggcatatctcgtacgctagggaatgtgcttctctcgtacgctagtacgctagggaatgtgcttcggcttcagcctagctacttttttgattggtgactaaactactaaaagcaaactttagctatcaattcttttctctatgttcagaaatcattaacggatgcagaactggatactctgcttaaagcaataagcctcccttggatagatcgaagaaagaagcactgtgcgttaccaggtgtagtggagaaagcaagggcaaaggtttcatcagaaagagatgctcgagcgataccaggatcacgatacgattaatctgatggcgcagcacgaacaggaaatagataacctagccctgggaaggaaagggaacagtttagtccctccgatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacac

SEQ ID NO: 70298 - DNA, 684 bp, Oryza sativa
ttcttcatcaagtttataaaaaatatagcaattcttatgatacaaaattagatccattaaatctaatactggacatattttaatagtatatttgcatggtgccaaaaatattgttatatgtttttctataaacttgataaaacttaaataattgtgatttagaaaacaaaaggcatattataatatggaactgcgggagtattaggtaagaaaaacttgaaaaatagattaatatgaattattatagaactatttttctaaagaaaatcaccatttagccatctagaaagcgtgcgcgcggaaaacaaatgggtaaaagttgggaaatataatatagaacacaacctaaatgcattgattagccacaagctagtaaatcattcagccaccttggtacgacatgatacatgggaaattgaatatggagtatggacgtacgttctcaactaaatactagtgcgagttttgcttttatgatatttgagaatgtaaactaaaccaaaactaagccttgcaaaaaaaggcatgaatggtaggaacttcaaaaaccgaaaacttttaacgaaattaaaagttaacctcaaacctgatgatgaagatgaaaagaaatataattgtcaagtctcaaacaaacttactttaactgctcatgcgtttggtaagtgaaacgtcatgtttcattat

SEQ ID NO: 70299 - DNA, 4572 bp, Oryza sativa
tgtatcccctattcactcccatttccaccccaaagcttgagttgtagtaatacaattgtagctcaaaaccacctcaccctccattgcttgtattgaatattggttcattgagatttgggtattgggttgctaacacaaggatggtgtcagcgcgaagaatcggactatagctcaccggacaggaaagaatcgaagatcgacgccgatggccggagttggggaagaaattggtgatctcgcgatacacggcggcttggctcgattcctttggtgtatgggctcctggggtcgaggggacgacgatggcgcggtgtcttgctctgggatggacaaggatggtcgggcgacgatgatgctgaagcggtggtgctccggagctcccgtggacacggtcgcgttccggtgtcaccactgcatgacaagaggagagattaggtggaatggatatggtattgataggaggttttggatcgggaaggaaatagagacgaccgcggcatgatggcgatggcgatggtcgtcgtctccacggccggcggtgagaatgagggtgacggagaggcagatggccttctccctcggcttgttcggctctgggttgaagagtgaggttgggcgactcagctggaaggagttgaaggcggggtttgacgttgccacgtcccgaccatgcgtcctgcggcatcgagagccagtcggcgctcgatctctccctctctgtgtttctcggtcggctggaggtgagggacagaggaaggcaagcctaggacactgctaagtgcgtccatgatgaagtaaactaggtgtaaaagagaggtgtgggtagaaacatgggtgaatatgatttttagatgaattttcggaattaatttctcctctaaatttttagcttcataacttaatgtgtggaccagattaactaatgttgattttaatggaggtagatgattatacctagattccattttctttggttgcactcaaaaattatggatagattgatcatagaaattaaccaaatatgggctaattaaaatctagattgaatttttaggaggcttaaactaagaataaaaattctagaaaaattatatttagatatgataaataatatagtatttaaataaattatttaccatgtacacttttatgcatttcaattcacttttgcgtgaggtatgttttagccaataaagaattataattagtctactattcaactagcttgacctatttatttaaggtaccaacctgagtgttaatatttgaccaaaattacagtggatagtttgtgctaatcatagtctgcataaatttttccatgattttatcttgcacaaaatattttggagaattagaatggcctctctttgtacatgtgttcccacttcataattgcatataatattattatagggattacattaaacttcttttgagctgagaagatgattgtttgagtttaatattatgtccacatgttatcacccaataggtttgtttagtaatttaaccctaacccttttaggttatgctcatgggacctattatgaaatgcgagaccaaaatctaaatgcacaagggactcgagtcaaggcatgcattatgcacatgtatgctcatttacttggtatttcaggtctaatgttgggaatgaaaaggttttattttgtttgcaatttttatttatgcaatggtttagatgggtctcacctaagttaaagtggaaatttttggctctcaaaattgtaaaagttagcctatatctattttgtctagaaatttttaagtcctagaattttgggtatgttacaaaaccccccctcccactccggtcaaagcatcctcccgccggtcagacctcggtcaaacccgcctattgactccctcccctgcctaccactttgttgttcacgtctcgtaggaattccgcagtaatataacggtcatcatgcagtaacaagacaactttctcgcagtaacaacatcgaaaaatagtcatgatagatctaattttggtaagtacttttttgcgaacatcatggtgcaaacagattagaaaaatactatataacgtgagagatattgctctctaaagatagatatttagtttttttagttctcgtctcactagaacgacatagtaacgcgacaatcaatgttctagtaacacgactactttccgcagtaacaatgttataaaagcatttttgtctcagccatcatgtagtaactagactattgtctcgctgtaacgttgttttaaagcgttatggtgaaaacggttctaaaaaataatatgtgatgtgagagatattattgtttaaatattagaattctaaaagtttacttgtactaagcttgctactatgtatctttgtatagacaaatagaagtacttttagcacttgtgttaacttgtgaccatgcacatgcactttttttaggactttgtattttgcacaagagtaagatttaaaaatttagctacgcacaagcagttgtagagtagtagtaccgttactaccatatgttctctgttaccgcaattttaccatgatgttactgcaaaaagtacagtaacgacctataaatttggaacaatcaaaaccattttcaaaattttatagaaaatgtaaaattttatagaatttgtaaaatttggaatagcagttttatttatgttctagaatttaacattcatccgcttctcggtctgttgtttctcaacatcggtttcccctcatcactctaaagtattctttgctatattaactgtcgggatcaggaatgagattcccaacctgtcactctaaagatttaattacaattaatacaacgatataatcggatcgtagattggacaattagttttggagaaaaatcgtttcgaagctcgctaaaatgcatgcatgtatgaggtggagagagagaggagagagtagtgatacgaagtttcacgaattttgtgaaacacgctgaagacacatattggaatagattactatcgtgtatgaaacaaagagtgttaatggattgaaacatatgattatttttttatcagaatataatcatgcggcatcttgtccttaagatataattacaacgaataaaacggtatgatcgcattatatattagataagtaatttatgagaaaaatcgttttgaatatcgctaaaggtgcatgtgtgtcgtatcggagatagagatataggcttggataagtgcatgtatgtcagaggcagcatatttattgcccgcccgatttttctccttgtgtccggatgttcgaagagaagcattttccccaaaaaatatacactattcggtccggtccaatcctcatacgaacatcgtgtacgcctgtccagccagatcatcctccgcgtatagttagaaaaaagagaaaaggcatgcggaacctacaaacccttgcccaatccttaaaaaaactcactagattattattacaactaaatttactatgctaggcaccccaataaactagaaaaaatcgaggaaaaaattccattgatttggccacagaaggcaaaaatgctatggggtgaacgatagcccctagcgatcagccgatcaccgcatccctcccccctctctccacatagtttccttttttgcaccgcattactttcctattttagtaaatttatgcatctaaagtttgtacaactcaagtttacacatctaaaatttagagacccaaagtttataagtcaaaagtttatatatccgattcaaatttgaatttgaattcaaatattatatgtagatatgtatatatgtatatgtttatatgtatatatgtatatatatatatatgtatatatatatgtatgtatgtatatatgtatatatatatgtatgtatgtatatatgtatatatgtctatatatatatatgtatatatatacatatatatacatatgtatacatacatatatacatatatacatatatacatatatacatatatacatatatatacatatatacatatatacatatatacatatatatacatatatacatatatatatacatatatacatatatacatatatatacatatatatatatattatatatatatagtatatgttgatgcgaaaaacacacactggcataggagatctacttaattccagtgcaggtgctaaatcttgctcttgggttcaaaggcgtgccagttggtttgatcctgtaaccaacaagaaacaaagaacgaaataaatgaggttaaatccataaacgatagccgatcggctaatggccgatgacatatcgtttatcctttagccgatgtcatcttgaattcgatcggcaatgaataataaagcaaaataagattaaatctactcgatcggctgtagatattagaaatatataatctatgtcttgacatatgtttaaatcaagtgattgggatagatcgaacatcatgccgagatagtataaatcacttatatccaaaagtacttcaagatagggattatatatactcatagcttagccgatgaagattggtctaatatgtatcagctattgctccg

SEQ ID NO: 70300 - DNA, 1068 bp, Oryza sativa
catggcgattggagggaggcagagagagcagtggtcctggaaggtgataccgtagctggcggtggtcgaccagaaaccatgatgtttttttgtccataggattgttgttttgttttgataggataagatgggctacataattttaggtatcgctaggatttaatttacactgtagacaaaacataaggccttttgtgtctaatagaagaaagaaagatggagagcatttgcccctgttggaacaattaatgtgctgcaggcaataacaatccagttggttggccattacgattcctgactcctgtgctgagtgatgagaattcagtgcctcctccctcactagaagggctgttaatccgtgaagcatgcgtgaatactggtgttgcaattggccgtctgcaactatctgtccacgcaagtaagcatccatcgatggaaaggccggcgaaatactagtaaatgcatatccatgtcagtcagattcagatcacatgaggttaggtccgcaatgcaaatgctactactgggtgaaatatctgagcaattagtaagtgaatgtcgctactgcattggcgttgcatggcctggcctgcctccatgtatctttgtcgcgcacttgcctgcgctttttcccaatattttaatccaaaattatctatcttaattagcttctttatctctgtctcagtagtgcaggtgctcccaacttaataaccttttaacacctgaaaaagaagatctcttttcagtcgagagagagagcagggcccaggcgaggctatatatacacggcattgcatgcaccatatgcatctcaatatctcttgcgacctcactccaattgcacaaacatacatacatacatacatactcgatcagtcggcaattgattaagcagctagctcaagctggtaaaattaaacgaccaatatatatgatgatgatgatgaccatggatgtgaagctcctgctgctgctgctgctgtccgtcctcctcctgtctgctgcctccatggccaaggacgacgatgagcagcagcagaaggtgcaatgccatgaggacgacga

SEQ ID NO: 70301 - DNA, 686 bp, Oryza sativa
tcacaatgacgaaaagcaacggcgagagtggatccccttgcctgagtccccgagctagcttgatcctttgagtgtctctaccattgatggtgacggtggttgacgaagtgaaaagcaaagcagaaacacagtcacgccatcgagcgccgaagcccaaatgtcgaagcagctccaaaaggaattcccaagataccgtatcaaaagcttttgcgatgtcaatcttcaacagcatggcaggcgttttggaccgatgcaactttttaactacaccatgaacgtagaggaagttctcttgtattcttctgcgcctaataaaggctgactgtgcaggcccgatcaattcatccattctcggggcgagacgaagtgctagaattttggtcaggatcttggcgaaactgtgaatcaaactaattgggcaaaagtcagttagttgattcgggtcctctttcttgggcaggaggatgatggaagctgtgttgacgagatgtaggtgctgggaattcgctctccacgcgtccccaaaatattgaggaaatagttgtatgcagcctgtagcttatcttcttcagtggtagcatagacaccatcatgacagagggtaggaattgctttctttcttcgacgtgcattgatcttaaggcgaaaaaattgtgccgttgtgccgctatgcttgaggaataaca

SEQ ID NO: 70302 - DNA, 774 bp, Oryza sativa
cttaagataaaaagaaaggcaggatcagcctatgtactggggaagccactaagttgggggggatttgacagtggtgtttcatgtagcagtgggatacccaggtaataagttcccctctggtttgaagcgaaagcttagttgaactaaacaaaccccggccccggccctaaaaggctagatcaatctatgtattggaatctggtaaagcaaaatactccgtacaagatgagcaaataagttgggatttggtagtggtattccctagaagtgggagggattggtttggtaatctatctatgactgcgccatggttgcaagtggcatctactcctatctatctatcaatctccaagtcgaaagtcaaccggctgggctgggcgacgagaagctagctagggctgcgggtggacctcaggagggagcagacggcggaaagtgactcaccggagccgacgaggatggcgacgttgccaagcaccatggcggcgcgcgaggagaagcccctcctgcctgtagctctgcttcaatctaacggcggcggcggcggcggggacgagggcggcgaccggcgagagggaggacagattaaacctctcgatcgatcgatcgactactttttttttttccctagactagtagaataaagaaagaggaaaattactcctacttgtttgctagagagagaatagaatactgtaattattaacggggcagggaggccaaggggagatctcaatctgagacggtcacctgttgaagttagacagtatatta

SEQ ID NO: 70303 - DNA, 2356 bp, Oryza sativa
gatctgtttatcataaagagattcgttgttcctgaccctgcttcaccttaattgttatcgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctagggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctggatttatttctattcctatttagctgggcaattctagtttttgttatgatgatctcatggatagtagtatttagttcttcttttacattcagattggtagtaggttttcagatagcttagcccttgatatgatgaaatttctattggagaagacgggcgccaacccgaaggggaatgtagctatgctggacttctttctactagctacggtgctacacctgctcctagctacgatgctgctcctgtccgccccttgatttatcacccctttggtcttttattggtcattgatttatagacgggaggataagtaccctggctcgagcccagatatcgatttaccattcctttatcggatctccgaaacgggaaacaagaaaagtaatagaaatcgtgtgccagcgggagatacgaaattcactggtttttactctcaatccacaggtggagatacctggggtgggttttcatggcctatagtcccctgccgccgaagcacgaactacttgaaatcgcggatcggcagcttcctgcgacattccttcaatgcaaacgtggtatttttctaccctttgatagatagcaagcagctcctataacttgatcgacaggacccaaccaactaaactattgattttggcaaagctagaccttttgaggaaagcagatgcagataacgaaaggaagctattagtttttcttgtactcgactcggcttttctttactgaccgcttgcgtaaggaaagttgacaataggaaaaccaggtgagaagttttagagcaaccgatgcctaccgtccggcgatgtccctaggtggagctggcttaccacattccgatacctcggaaccttcccttcgtaaatttggaataacgaaagtctcaaccgcttgctggcatgccaaaacacttattatgtttatgtgaagtggattcatcggaagagagaggtaaagcattttaatttcttcgcttttgagcagtaagtatttcgcaaggcggcccaggggtcttcttcgtttaaggggcagttgagc

SEQ ID NO: 70304 - DNA, 580 bp, Oryza sativa
ttccattagccgtatgatcctaaaaggattttaagaagatagcattaggagcatgtcgatgagtttgttggtaatatgtagtggtaacatgagcttctacttttcctaaaaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaactacaaggttaactgattgtaaatcctcttggaaagcactcagatccccatggatgactgtgacctacaagtcagtcatgaaatgccattaggtcgccgaaaatgcatcaaaaactataaaagtaaacacaaaaaataaaaggaaaaacagttccaacctcatcccttgtcccttcaataatttcttgtgtttcatctaaactgatatccacacgatcaatccttccagcgagatgtttccttgcagactgaatagtgaaaatcaaaggccagtaagatgttttggttgg

SEQ ID NO: 70305 - DNA, 5180 bp, Oryza sativa
caagtgcgaagaggataactgctaaaagcatataagtagtcagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcctgaatttggtggttaaactctactgcggtgacgatactgtaggggaggtcctacggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtaggatctgaccgtaccaccagtcagttagcagccgcccgttctacctctgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaattactactctaaaaccaatatagaatcttattaagattactattaatcttaaacttaaaccaatatagaataagtagtactgaagcctcttgggcgatgtagggcaaatcttactctccaagacgtccaccttcgtgctcagttcctgaaatgcagctcccaattcatccaccttcttctccacaactggaatgcgcgcttccacagtccgcttgagatccagatactccgcccgagtgcgctcatccgcctccacgcgcttcttctcattcccctctacgagttgcagcaggagatccagcttcttatcagtatccatggtttactacttgggaatcggaaccaattcgttctcactccgaattccgcaaacctggggtggcaagtttccttttcgcggtgtcgatccaaagatcaactccaatccgccccaaggaattttaccgcagaatcaagaggattgagagaacaagagaggctctgataccagattgttaggatccaaagagcaagaacaagaacacacacgcaatgatagggatttgacaactaattggtagtctattgctctaatccgacaggattaagccttccgccgccttcgccgcctagttgccagttcataccatttcatcttgggttcccctgttttatacaagtatcaggtacattacccactctctctctctctcgaattcgcatcacacacgcaacagccagctgtacagtgccaactggattacacagcccattcaggcccatggtaacgggggttgggcttcatcgttcttgatggcctaactggcacttgagtattggtctgaatgtcctcctcctcatcttggcgccttatgccctcagagtcttgatcatcagtaggttcttcatcagcttcaggttctccttccttctcctcctcttcagctggaacagccatgtcaggtaggcacctgacaatttcgtagagacgcgctgcatcgatgcacgcattgcacacacatatacctggcggtacatgacacgtaggttgtgatcaacctgttggttgtcggtgaaccgtggctccctcccattgtagtccagatcgatcagcttcggcggcacgtgccgcccgttccgccggggatcgaacaacggtgaggactggtcggtgtacatcgccggcattctcatcccgtccggtgcatcccagttccagaacggtatggcgaaggtgggatcaccgatcaagctccccaggatccgctcgaagaagtagagatagcacctatggaacggcatgaacagccaggagttgtgcacctggagatccagccccgggaacccgtcggggctgtacgacccgtcgcagtaggcgcagtggacgctcgcctgcgccgcgaagctccgggggtcgtccgccggcagcgccttcatggccgcgatcgcgcggttgaacttggcgacgtagtccgcgccggcggagtgcgcggcggggcgcgtgcggagcggcgaggacgacgcgtcggcgggcggggcgaagtccaccggcgaggcgctggagggcggcgggcagcacgtcagcacgttggcggacggagggagctggtcgggcgggccgcaggaggagatgtcgggcgtcgcgacagggtcggcgccggcgcggcgcgggaacgacaggaggatgcccgccgccgtggcgcttgcaccggccgcgccgagaccgaggaggacgtcccggcggtcgagcctagaggcgtcgggctccgcgggagacgatgtgcacgagacccgtccgacggcgccgcggcgaggcttaaggcaaaagctcgctcctggagaggaggggctcggtgatgatagagagcaggtgattagctgggagagtgatgccatggccgcgcgcttgggtcaaccgagcgcgatggtgatcggtatagctctcttgcaaatcacgatttgccatggtacggtatatataaggcgagcgcacgtctgtgccaccgtgccacgcgagcgcacgtgagcgaatgcatgcgcgacagcgcgttgtagggagatgcgacgcgcacgtgagagcgaacgagaaattgaagacggggatcacagcgtagcccgtagcagggagcgcacgcatatatccctcggaaaatgctccgcatgggggagtagctgggattcgtcggtgtgcacgttgaagatttgttatcagctgtcactaattttatgcatatcatataataatagattaagagcttatatgtaagagtgaggataatagtaagtcaactataaatttatatggaagagagataaataaaaatgaaaaatattggttctcatgcaaatattacaagacattttcactaaatttatagagagaaagatgaaggagaaatatagtcaaccttatagttaatttattatacatattagttagctatactattaaacttgttctaattgtctctaatttataatctctaataactctaacactctataacactctcatatttttattgaagtttgtgtagggattatccctttcatgaggaatgtcaatttctctctctttcactcttcttttctccatctcaccattcatgaaattaaaataaaccccaatgataatcatatttgatttttaaaatcgcaatgataataaaaatgagaggcagcgggcgggtcgtacatgagtacaatggcagagccgccgatgattggtgtgacttctagaaagtaaaaaaaaaattccaacgatagttatgttcgatttttagaaccctaatgtccccacgttctcatttgttctcttgttctcataggtttactggtgattccattcgcaatggtaggagtcccttgttttttttgtttttttttaaaagtaggagcacaaaggtacttgtagggtgccacgatagagggattttggactatttgttattctcttcaatagtaccttcttaaataccgtctttcctaataattttgattatttatcatcgtgattaccaaattgtttatattttaccactttacactaaaagaaaaaaaaacctcactcccctcccatctttcttctctctctttctctccgctcttcttcctctctgacgtgggaatcacaggtactgttgcaattggatgtatggcgtgagccttcgggatttggtagtgaggtcatcgatgagcgaagatacgccgagtccaccctgaccatgagcgagatacctgtgttggtgagggagcatacaacttgacccatgccggctccaacgcctcccccgccacacctccgtttgcgtcgcttctctcaagttcacaggatctatacgagatagagagcctgcaaccaagatgtattgctttcaccccaacgacccatccgacgaaccatcaagcattgttgcgtcgtatatctcgcccgtttagctgcccagttcatcctgacactagccattcctactacttggcccatgctagagactggtttcatgtcatatcgcagagaaagaaggtataaagaagatgaatgacaggggtaataaaggttatttccttgttgtttcgctgaattgtcagtcaaaagtaatactacctccgttttttaatagatgacgtcgttgacttt

SEQ ID NO: 70306 - DNA, 2059 bp, Oryza sativa
gagtccgtacttctggagtcgagagaaatcccggctgtcggtgacatgggaccgggggtatcttgactagaggtttggggcagctgcagtcacccacgtggcctgaccccctcgggggggtcgggcccgagggtgatgtggccgcccctccctttgtctccccgaggggtcaggccgctcccgtttcggccccgagggctggggcgccccgaccccctgtgggtttggcgccacgtgtgtgggttaggtgagcacagcggggctcacctaaccgcatttattgtgggttggacgagcgccccacgccctatttaatgcagcgcaacacactcgttcggtccgtgacaggtcacagtgtgtgaccggtcatagaccggtcagatagagggttaggtggtaacaggcggccttttccacgcctagccccgttcccgttgaatgatgagagcctatatgcactcgtccctagccggagcccgcgtgctgactcctggagttagcacgtcagtcccggctagattcataccaggcttcatcgcaaccattacaaggaagtcattttatgaagaagggttgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccggtgtcaggcgagtgatgacgctgggcctcactcaaagacaagctgtgatttagcttccaggcgaaggcgcaagctagttttttcttttttgggaagatagggtgagtccccacccaaaagaagagtaggtagaagtggtgcaggtgggatccccttgagatataaaaggaggaccttgcccacttaagaacgggggagctggggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcacgaaacattccatagatcgagtgcttagaacctcacctagcgcccccggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacttcgccgcccacgagcgatgaagaaggacggcgagacggggagcgtcgcctcctcgtctacggcgatggcagcacgccccagggcacgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgccgccaaggcctctggcgctgctaccgccggctccgtgtcgtcgaggggcgccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagccccccgtgcccccgcttggtggtgtcggctgtcgagcctttgtggcgagcattcggaacgtccgttggcccccaaggttccggcc

SEQ ID NO: 70307 - DNA, 16368 bp, Oryza sativa
cttccccgatgcgtactccgtcaagcccaacactgacaccttcaacgccattatcaagtccttcgccgagtccggcaccacaaggtccttctactcggtgctcgatgaaatgtgccagaagggtgtgaagcccaacgccactacgtttactacggcgattgctggtttttacaaggaggagcggtttgatgatgtagggaaggtgattgagctcatgaagaagcacggttgtggtgagtcgctgccagtgttcaatgttagggtccaggggctgtgcaaacttggtcggagtggcgacgcaaaggcattgctgaatgagatggtgaagaaagggacaaagccgagctggctcacttataatcatttgattcatggattctgcaaggagggggatttggaggaagctaagcggctatacaaggagatggcaaagaaagggcttgttggggatagtagcttctattatatgcttatttattacctttgtaagggtggtgattttgatactgccgttggggtgtacaatgagatagcagccaggaattgggtgccgtgtttttcgaccatgaagatgcttgtgaatgggcttgctggaagctcaagggtcgatgaggcaaaaggtatcattgagaagatgaaggaaaaattcccagataaggctgaagggtggaaggaagtagaggatgctttgcctcaatagaatagcagatggacgaacttgcaggtatttttcagccatctatacatacaaaaaagatagttaggtgaaacatttgctttgctttaatttggctgcatattctgttaggtttcacaagatttcctgtttcacttgtcctttgtttcattgtattgtcgttccatgtgtcacacaagctactgtacatctgaaatgattcacaatgtcaattccagttcaacttgtggtaaagtgatgtccttctgaattgagatcctctaacttacttcccttcgacgccagtcactgaaatgtgtaccctctaaccaacgggcccacatgtctgtgactcaaagtcaaagggaagtaagtcagaggatcctcttccatttgagagaagtacctgtcgctacggttttctcttttaatccatttagatgaaagataacgcttgaataaaagtatacgtcattgtgccctttttgtttaattcaaaacgatctactcttgataactttgttcctttcatgctccggtgtcgtggattgagcttgttacatgtgactagaatcttctttgcttccatcatgtaaatatattcctggtcataagaatataatgctaacagaatcgttttataatctatacaccagcaagaaccctttatttttctttaatttggtatattcatctatattagagtattgagaccaaagggcattggtgagagcattgcttatgctgacagttattacagtaacaaaatggttttatttaatgatatcattggactgtttaaggactaagcaaatccaagtgcataaatttagcttatgaggtcgattttgttttttttttttttttgttcctagatccaccaaacaaatacatcaactattcaaatacagtataagtctaaatgttgggactttgtagataaactcccaataatgttcaataaataccttgagcattttggctgaactctagtaaaactagtggtttatttgagaagaaaatattgtttcaagtggaagttcaaagagatatattgtatctttaatttgacaatgatgagttgatgccaacacttgtatttgattctatctattatgatttatgaaaagaactattgatacaatttgctaccttcagctaatctatattaaataccctaatgttgtaatccgagatatatatttgaactgatgatgatgaacatgatcatacttatacaataaaatgtggtgcccatacccatcttagctattatttctttggtgctactgttccattctgccaacctttcaatttgtgcatatctttaagttcgtattaactgtagcataggtgtaatttagttttgttttttcttcatgttacatgtttgactacatttggtttgtgatgccaaatggcctgaattagtcaaaccgaaatagtctgtattttccagaaaaaaagcaagcaactttatttttaatctatctatattacttgagaaattactatattggaggatagataataactagtcgcatagttgaaatatggatatgaaatagtgtcaaatctgctggagacgatgaagtcttctgcacttcatccttgacttggtcatacaggatgtgcttttctggttccttgatctcacgaattctttatgcagtaatctggaaacaatgcaccgcaattttttcttgctagggttattttgtttttgtgagtattatatcatttcaacccttgtcaagctatttttcccttgttcctttttcagatgaacagtactggccattgattcaattcaatcgttgaacatgtctttttcagaaatcaggaacttcaccaacatttgatcgattgacttgagcagagatttgttacatatgctagttccagctatggcgacaatattttccgtctgggatagttgaggcgtttgaaagtactgtcttaagtcatctgccgaatatgttctggacattattatctggtatgctgttacaaattagtgtggttcaggagatcgatataataaccatacattcatacttttgtcatttttatatacctttttttagaggaatatcgaattccattataccactggtgcgacagaatcgccagacctggagggataccatccctaacgagactggtaaggtgaggacaattacatccataagcagccagatcataggctactttgttacagctaccaggacagtgattaacatttgaaagcactagaaaagtcctcagtgaacaatttatttcgtggagaagacctcctgttgcagccaaactgtattttgccccctcatagcgtacattaacatcatagaatcagttcccaactttacttgcactatacctttcttcgctgccgcatcaattccagccatgactgctatagtttcggcgtgaaaagcgtccatcagatatggggtttgcccggcttccgctacaatcaccgaccctgaatcatccctatgacataaccccatccaccatttccagtttgtggcatatatgttccatccacattactcttaatcttaagtgtctcctcatcaggtttcctccatttctgagttactgttttgctctgcttcattgcttacttttactcgaatcaccgaacccctctactcgtttcagcacagtcaagcctaggttgttggcttttctgctctcaccttctctaattctgggaaaaaattgcgattatacttatttttcaataatttacatttatatacctgtatgagatggatttgcaaaaatatacccgttccgcgggactgcgatggtcccgcagctccaaaacgcaggaaggaagttggcttgccacgaccgcaagccaatttggcagcgccgctgtcgccagactgttcgacgccctcatggttaggggtggacaaaaagctcgggctcgtgagctcggctcgggcttggctcgagctcgcaaagctcggcttggctcgaaaagaaaacgagccgagcccgagccgcctccagagctcgtttgtaaatcgagccgagcccgagctagctcgcaagccgctcggtaggcttgtcaagctggtgaaaaaatgaccttggcccattaacaattccccatcccaggcccaatgaaaaccctaaccttcccttgctacagaaactattccccttcccacttcctagttcgtcgccgccgccagtccgtcacgccgagaccgagtccctccctctgggcggcgcaaggagttgccggccgctggcccgccgcctccctcccagtccccagcagaagcgccggtgcgccgctcgacgcggcagcctcagttccgccagctagccgcctccctcccctgcgccctgcgcggctgcgctggctccggcctccctccccagccgcccagcgacgctcgaccccagtgccgtcgcggcgccgcctctctaccctgcaccgccttcggcctccctctcctgtgctacccgcgtccctgactcgacggtcgacgccgtccatcacctcgccgagacgccaaccgatcgacgacagttcacacagcgacgagcctaggatgaagaggttcgtgatgtattttctgatttttgagattcatttcttagtagctgtgtatatgcgtgatgaattgatgtgtatgtgtgcagtgtgtgctattatcaatgattcaatcacagaaaggttgaggcaaatagatcaaaattgttatacctacactaatatactatacttaattcgagccatatgttttgtgtagtaaatagaatctgtaacgcacacttgctgttaacttgctgaaaattgattgtactattgttgaagtatttacttgctgttgtgcatcacaagctggctcgagctggctcgagctttgaaacgagccaagccgagctgcattttttgctcgttctctttatcaagccgagccgagccgagcctgttcttgaccaagctttcacgagccgagccgagccgagcttggctcggcttgactcgtttccacccctactcatggtgcagcagctgaaaatgccacacctcgctcgccccaacccgttcgatcgacctcttccagcactgcggcaatgacgaggaggcggatgaaccgacgaagatgacgaggagctccagctacgggcgttgtagtcaccagcgttgcggccctctcacggcggcccggccctcgtagtcttccacggcggcgacgaccaggctcatcttgccccaacgttcttcctgacatcctcgccctcgctgctcacgacggcatcaacctggtacgtacatacatgcataaaccttcatggccaaggcgccaagtgtacgcgcatctccatggccatggtgttctgcacacgcacgtaactaatgtgcttcttttctgttgcgtgggagcagctgggaggtgtcgccgggccggcgcaactcgacgacggcgagcagtgacatcgtggcggtgttcggcaagaagggcgtgagcccgcgcgacatgacggggtcggggagatcgattcattcgaacaggaggattgatccaaaacctaaccattccaatgcgggaatgcgggatagtgagggcaattttgtctctggtttcatagttgcggtaaacaaggcggaactgctataaatcagaacattttaatagagttgtgctttcaaatgggggcctcaattttttgtgctattttctggtaccggtataacagccgtgccaccaatcgaattctctcttcatctttgcatttcttgtttcatgccagtttgtcgatgtggcccaaaggactaacaccgatacacatagttacaatttaaagaaacgttcgcatgaacatcggtttcaacttaaaacacaatataatcaatgtcagtcacatgaaatagaaacatttcatcttcaacacaatataggctttgtttagttcacaaacaaaaacttttcaccctatcacattgaatgtttggacatatgcatgaagtattaaatatagaaaaaataataattacataaattgcttgtaaattacgagatgaatcttttaagtctaattgttccatgatttgacaatgtggtgttacataaaacatttgctaatgatggattaattaggcttaataaatttctttcgcggtttactaacggattttgtaattagtttttttattagtgcccgaacaccctgtacgacactatatataatacccgatgtgacacgccaaaactttacacccctaatctaaacacccccataattagcgtgagtcacgtgaaatagaggcatttcatttcaaaaagaaaggaaaggaagaattatcttccaatcatctatgcgttgtgaagagagccacataatttgctgtaactttatttctctatcatgggcatggcgcataatttccatataatttgtggtggattttaagccctttaggttatagagattcatttgtttcctgtagttcaaatgattttgatttttttaaagaaattagataatatggattattatgttttatccctctacaattatcgaaggtcaaatttgatctagatatgaagaaactaagagtaataaatctacgtgaatgtcattgttattttttaatttgattttctgttttgtttttttatatgtagatcgaatttaaatttatatgtttgtgtatgcctatttatatggcatttttttttacagatgcggcttgtaagcaagccaagatacatcaatggagaaaccgaaaataatattaaagggcacacttttgtcttagctagttcgaaaggcaatcttgagtgatgaatgttgtggaaaagaactccaaattaatattagaatatgcagcaattcagcccaatgttatttttttatgggtgcatgattattcgtattaaataaatgcaactgtcctttatcttacggcgttaaatttggttctattttatcaaattttactatagctccgtgcctccttgccttcttggtaattagtgcttgagcatgacaaatattttgaaacaaagagagtaactactcagtatcaatatatccacaataaaatttctacttgtatatactactccatacttataaagaaaatcgtttaggacaatgtttaaagtaaacattgggaatataaatcatgaataactctcaagttgctgagtttgaaaatgtaaaaattatatgtatagatttgtcttgaaaaatattttcataaaaatatacatatatcacttttcaataaatatttttataaaaataaaaagttaaaattgtattttggagatcatgtcgctgtcctaaacgatttctttttacgagtatggaggaagtatatattttcacattccattgtattctattctcacgcctccgatcctaacctttccatgtcttggcaccaaagtcacagtcacactctcatcttgctcggcacctaggtcctttaagatatcattcagtgccaccctcatggtggtttgtacccctctccgtgtcacattgttttgcgtgttgtgatgccttaaacacacaaagctcccgaccatctcccgtccacatggctcgattttcttgtgctccctagcattgacaaacacatcaaacttgcacacgccatctgtctggatgtgctcgaccaccagcacctcctcttgtgttgccccttttggctgtctccacaacattagcggtcgtctcacctctgcggtcaccacattgccaagggatactggaaacatgacgggcttctcgaccctgtttttcactctgtacttcacgttgggagtagtgggtggccgtgcatccaaccatggtaaaccaacgccacgatacgtgtatcggagcttgtccatgtcgagcacgtcacggacggtgatgcgcacaagacgggcctcctcatcgtagaagagaaacgaggagtcgagccaatcagggtccgtaaagtcttcgcctttgccattgctgcgccatacatcccacagccgatcgatgttagcatgatgcgtgtagaagatcgggtcacgaccagcggcgtagtaagctcccatatcctcggcgttgggataagacaataagtcgccaacccaaacatgcatcaagttatgtggttgtagctccacggttcccgcacctggcttgctagcctcacctgcacgaaaaggttggccgtggaataaggaggccaacggcgcactgctaatcatctgaaaaagaattacagaagttaatcattttgacaccaaatggttactcacaaatatatgcaaaatattaagatctaatatatgatactgatatttgtagtcgttaaaaaatacgaccatattatatattttattatttttagtaatttattattagaaaaaataatgatcaaatatgtgctgcctcaaagatcatgcctatatcctagcgacaacttaaaacataattatatctcgatttttcataactttgcatatattggtaagttaagaatttaatactcctatttgtttatatttttataatacatcattctaggagagtagtttttttaaaacttttaaatataactataatataattagagtgtaattacagtatgatttaacttatatatatgatccgcctataactaatcacaaaacacgcttggtgtggctggctaccaattaatgctcccctcactaaacacaacgtggtttgatggtccataaatcaaaagtttgcgccatgatgtttttttctttcctcctatcacgaatctcaacacaattttgatgtccctcctcactgcacgaatctcaaccggtcaacccgatctgacagttcacaaattggcatccctcctccctgcacgaatctcaactcgatctgacggtacacaaatagtaagtttttttttttgaggggggcttgcaagaaaaatatagcaattccgtttatcaatttttctctcctccactcaccaaacacaacgtggtttgatggtcataaatcaaaagtttacaagtaaatttcataaaactacatatactttgaccaaactatcttaaaaaactaccgatttaaagcattatatcataaaactatagattcagtgtaaaatttatcataaaattacagatttaagatgaaagggtcacaaaactatagattaagttccaatttaattacaaaactgcaacgtttatagcttccacatgattgcagtcttaggtattgtagctctgaaatccgttgttctgtgatatctcgatattaaatactgtatgtagttgtgtgatatttgactttaaatatatagttttctgataaatttagcgttaaatatgattttttatacaacacattaaatctatagctttgttttgtgaaatttatttaaagtgtttttagataattgatagaaatccggcttgtatatacataagtggatacacacaactacaatcaaaatatttacactactacaaaagatgtcgtaggttctggtttgtaagggtccatatgtgttggattttcatccagcaccaatagaagctaccgacacctatgaggaaaatagaaccgacaactttaggttcgcatgagcccaaaaaaaaaaaaagtcagccagctcaaatcgagctgaactcaccaaccatgttgccgtcgttgtcatcctgctctatccgctatcttcaactactatcatcatcctgttgtatccgccatcttcatccggcatcgtctccgtcaaagcccagtcccgccgccaccgtctcccacctatcggatccgaagacaaaaacgaagaggccgaggggcagagggagagaggggcgcactgctgtcgttgcgtcgttgctgccatcattgtgtcgtgccccagccatcgttgcgccgtgccgtgccccgccatcgcaatgtcatgctgtgcgtcgtgccaaggaaacggctgccgcgcgcgccatgccggcgatgggagagcgaaaactgataaggttcggccagtggataggcgacatgttttttttttgtgaggtgagtggataagcacaggctcggctcggcttataatggatgcatttttttttaaaaaaaagcatctatagtttattatatgtgctggttttttttaaaaaactcgtaccattattatgggtgtaatttttttaaaaatcaggtaccaatatataggtgctattttttttaaaaaaatacctatattataagtgtcggttttatctagattttttgttctataaaggtgaagagcggtaataggtgtcgttttaaataaatcgacgcctataactgagtcgatatctatgaggtgttctgtagttgtgttagcaaaataacttacgtaacaaatctatcaattgataaagaaacaaaggcatgcaacaagaggaacggactgccgtatatatagtgcacctgcttgtacatgatccagaggttgtgctttatctgctcatcgtcggtgtagttgttctccacgacgtccatggcgtaatccaggtccacgagcttgggcggcgcgtgccacgggttcctcatttggtcgtacagcggcgacgacgcgttggcaaactgcagcggcatccgcatcccctccggcacgtcccagctccagaacggcaccgcgaacccggggtcaccgagcagcttcccggcgatgcgctcgaagaagtagaggtaggcgcggtggaacgggaagaagagccaggagaagtgcacctggacggccagctccgggtggccgacctgccggtacgcgccggtgcagtaggcgcagtggatgtgcgcctgctggtagaagctgcgcgggtcgctccgcggcagcgccttcatcagcgcgatcgcgcgctcgtacttggccatgtactccgcgccggctacgtgcgccggccgccgcgtccggagcggctcgctcgggtcggggagcgtgaaatcgattggttcggacgtgggcatcggcgggcagcattggaggtcctccgggaaatctggaccctccggttttcggcactgcaggaggtcagtgacaataggcccgcccacgcggccggcgttgatcttgtcgtgaccgccgtcggagagcaggggggtcgagacgccgtcgtcggcggcgcaggagacgacgtacgggtctagcccggtgacggcgaggagggcccttgtcagagtttgggcgcatgggttcacggagactgcaggcgaggaggtgtagacagcggcgtaggcgaaggcgcaaacgatgaggacgaagagcgcaacacgacatcgctcgttggccatggttattgcacgagctgactagcacatgagctcgaaaactgtttgctcaagcaacagctgcatgtagtactttattatcgattaggagtgtgtatatatagaaacatgtatccaatgacgtgaaactgtggacgagagggatcgagcgtcctggtcctggaacttggattgctcatatatacatggccacaaacgaaaccaccaacttggcttaggcctgtttagttcctaaaaactttttctaaaaacatcacatcgaatcttctttggacaaatatatggagcattaaatatagataaaaagaaaaactaattgcacaatttacatgtaaatcgcgagacgaatcttttgagcataattagaccatgattagccataagtgctacagtaaccaacatgtgttaatgacggattaattaggcacaaaagattcgtctcgcggtttccatgcaagttaagaaattagttttttcattcatgtccgaaaaccctttccgacatccgatcaaacatccgatgtgacacctaaaattttttatttcaccaactaaacatgcccagttcgctgctcattctagaagtggggaacgtaggcactgtacatgcactgttacagttactcttgatgggaacctaggcactgtacttttgcaccgttgcacttactcttgatgggaacctaggtattgtacatgcactgttgcacttaccgttgatgcagacggcctgggatggcgtcgaccacgccgtttggctgccaacaaaatccgtcggacgcaggccacggcgcgggttgcgcgaggctgccagccggtgcagcacaagtaaatgcacagcagcaaatgctacacgcacatgcggatgaactcacccgggttataatgcaatgaaaaaaaataagtaatgaaattaaacattgatttaatttcatcgattttatatggcttcaatttcataattgtgcgatgtaaattcttaaaccatttcattagtctgaggtatttgttattaagaaattattttttgataagattcgatgagttctaccaatatattgagaagaaaatgattattttcgttgccggaaatattactagggtaacaattatgaagaaatgatttatcacacaattcacacaaaaataagtgaatcaaatttattgtgaaaccgatgacataaatttataccctcttccggtgctactatgaaaatcagcacacaaaattgacgctgtgctgtaattttgcaaataatatgaaaaaactttgcacagactaatacaataaagttgctaccatgacatttgcaactaatatgaaaaaaatatacacagactaatacaataaaggggctgctatataacagaatcccgttttcgaacgggatgatcccgagtaggtatcaggtgtgatacctatcaggtatcagacgattctacgcaacaggatgatcccgagtaggtatcaggtgtgatacctatcaggtatcagacgattctacacacgtttcaggtgatacctgcaaagtatcatgtgatacttatgaggtatcatgcgattttctaccacgtatcgtgtgatactcgcgaggtatcatgtgaaacctgtcaggtattagatgatttcaaccacatatcgcgtgatactcacgaggtatcatgcgatacctgtcatgtatcagacgatttctaccacgtatcacgtcatactcgcgatgtatcagacgatttctaccatgtatcacgtgatacttgcaaggtatcggatgatacttactaggtatcaggtgattcctactagatatagctgggtatctcgttgtgggaggagcaccccgacacgtgcggtcgccccctgcagccgtcccttgtagacgaggacggcgacgacggcggtagaggacgggcgtggcaacggcggcggtagcgggggacgggcgcggcggtggcggcggcgtcgacgggggacagacgccgcggcggcgggggacagcgacagcggcagtgggggatgggcggcggcggcagcgaccggggacgggcgcggcggtggcggcggcgtctacgggggacagtgatggcggcggtgggggatgggcgtggcggcggcagcggcgtcgatgggcgcggcggcggaggcgacgggggacgggcgcggcagcggcgggggacacgaattgtgttgtggagaggagctatcccgttgagggacggtatcccgtcccttagcattcccatacaacaaaatttgcactgttgctactatgaaaatcacggtacaaaatttggcacgagactagcacgggtccacgagtctcgtcgtgtttcacgctgtctgaaagcatcggaccgcgcgtagtacgtcaagaggcgggcatactactaccttccaacaggcccgtcgctggttggggagagggataaatgcaaagatatggacacacggttcacacgatgcctccgctccggccgttcattaggcgagggggagagagagagggggccatgcaacgccctctagcaggagccccgtgctgcacatggtcattccgacgtactcggtactatgctagacagctggccacgaaattatcagcgtgtgacaggcttagggtctgtttagatcctatcaagctgtttcactgtgtcacatcgaatgttggaaacatatatgaaatattaaatatagacaaaaaaaactaattagatagattgcgtataaattacgagacaaacattttagcctaattgcttcatgatttgacaatgtagtgctacagtaaacatttgctaaatacggattaattaggcttaataaattcgtcttgcagtttacaggcggaatttgtaatttgttttgttattagactacgtttaatactccctccgtcccaaaatatagcaacctttgagcggatggaacagacgtctgtctagattcatagtactaggatgtgccccatctattcaaaggttgctatattttaagacggagggagtacttcaaatgtgtgcccgtatatccaatgtgacggcaaaaatttttacccctgcatctaaacagtcttaattagtttttcttttttaagagagagccttaattagttacattaattagttacatgtacatcttgtgtatttttagacaatagaaactttattaaaactaggtcaattacattaaaataatacaattatactgagcccacttccaacctctacatcaagacacccacagccaaaaaatgacacccacaacaaccaaaaagagatgcggaaatataatgtttaacacctatcaattcacacactagattgtcactcatactcatggctaaagtattcctgtgccatatggtccaactgtccaactattaagagaccatcggaatatgacaatagtgtctcaaagtttcagcttatagaggacagcccaacaaacgaagccattgcgtaactaaggaaataacttaaaaaaaaggagaagatccatttctttttgtaaaaaataacttcattcttgcataattaaagtaaccaacaaagagttgttacaccccattaacaaatttcaaaaaagtttccgaaaagccggtgaacatacacaaaaacggagaaaacaaccatggaaaaaagttgaaacacacttaaaaaaactgaaaacatactataatagagtagaatggaacgtttaatccatcttactagatcccgttgcaacgcacgagcatatttgttagtgagaagaaaattccgaaactaccaaattttggtagaataacattggtaagacaatgttttgtttgttaccctatcaaaatttggtgaatttgataacaccaaaatttggtaggtttgaaattgataataaagtgaacatgcccacttctccatataaaaaagtgaatacaggcagtttccggtccaatctcaccgctgcaaacgatggccataaaattctccatataataaagtgaatacaggcagtttccggtccaatctcacccatgcaaacgatggccataaagcgtaactgctgtgttcatgcagccaggggattatggatcgtgcctcaaatcgttgattagctagcatgagtcattcagtcttttgtttacgatcagatttcaaattttcaatacaacaaagtacatacattttctacatgtatttgtcaattactatatgacgaaagttatgtgaaccctacagcagtgtaacacctgtagcatcaagggtagagatttactgtacattcacgcaatcataatcttccttatttgcggaagttgcttcgtagtaacaacaaagaaaacaattgcatacctacagactacagtgatatgtacagctaaagtacagactaaaagccagcatatatcaaaatgcaaggcgtaataatgtgtaacagatcagcaatttcgcggtctgttataattcggaggcagagaaggacacctttcattcatgtgagggtacggctgcatggtgttgtatccaggcaactccattcgatacctgccctttatttggcagaaggggagcttgacactgtcatctttgttgcaccacacgggaagccgtgtcatattgttctcaaaaaagttgaggctgtaagcatcttttatctgcatggaatttaaggagaacatatttttttaccagaagttggatgcgggcaattaataatgatcaggaaatattcataattcaaatcatttggtagtgcagaatggcaatatgccaactggtagactagccttccactatgagtcaattactgagcatatgatatagttccatcggtgatgtctgaattaccctagatctcatggaagccggaatttaagcataaaccacacaagaaatcaagagtacttacggtgaattcagtaacttctatagagctggcaattgggtcaaagagtccagcctccttgtacatcataaggacgtaagccacacaagaagcagactggccatcagtatagacccacttatcttgctcaggaactgttagcaatttgtcaaatgtcatcccacgcttctctgattccactatgatttcaggtagatcaagaccctgaagaagatagctccattataagtctatccagaaaaactcatagcattgagcacaacggagctataaagcaatgattttctgtgtatatagaaactcatagcatggagcaccttccactgttagaaattggatatgcgacaaaagaactaagagaattactaactaatcaactgttgcaggccaatccccgtatcataaaataggatcccttggtgtgtcataacccttatatatacccaggggacgcttgagtaaatgagaaattctcatgcagactacgtcttatcaaaaataattgagggtagtttta

SEQ ID NO: 70308 - DNA, 17138 bp, Oryza sativa
ggccatggctagcgctttttctatactcgaccgctccctgactttttctgtcatttaatttttcaaatttctgttttcaagagcattcttcaatttacagcttcaatatatacgtgatatcatacccctaataatttcacaaaactatttgtgcttctttattttattttttttcttcttcgtttgcctgctcctgggcgtgtgatactgtgattagcagccggcaaggcctaagcatgcatgagtccatgattgggctttaagatgctagcccgtgcatgcacccgtagcactcatagatgtatccagaattcgcgagacggcaagagtacccgtttcccacgctccccgaaaattaccgtccaaaattccaaagatttatctgacaatttgatagctccacgtggaccaatcagtagtggcaaacctgtcggcttgagattaatagatcaataataatatatattattttgtctttaaaatgttttttatattaaaattattaacgaccctaaataaaaattgttagttacaaaataggaaggagagagggaggattgcatacctacaatgtaagtacatcgaaaatgctacgcctcggtcgctccccctcccccacgaagcgcgggtgcgccctggccccacgatgtgttcctatctatctgctacgtgtccccaccatatactccgttgcaacaaatcacctatatattttagaaaccctctattaagggaattcgtttcattttttgttccacaaaaaatgttttacctagtgtactcacaatgtttcactatgtatagatataatgttgcagtgaattaaagtattcttttgcaacaaatcacccacatatattttgaaaaccctctattaagagaattcgtttcattttttgttccaccaaaaatgtttcacctattgtactcataatgtttcactatgtatagatctaatgttgcagtgaacgaaatattcttttgcaacaaaatcacccgtatattttggaaaccctctattaagggaattcgtttcattttttgttccacggaaaaatgtttcaactagtgtacttataatgtttcactatgtatagatctaatattgcactgaactgaaatattctttcactacttgcagaaacattgtttttatataaggtgaaacaacacctgatttaaacaattgaaacattttcgatctacttagtgaaacaattccgatatacttggtggaacatcgtgcaacattttaaaaaactcaataataagctaaaaatttttcccgtcggaatatatccatgtgtggtcttgttttaaagatttaattgtaacaaatttaatggtgcaataggatcatgattttgataaataatttaagagaaaaatcagtttaaattggtttttcacgcatgcgtggcgctgacgtcagcgcctaatttttccccaaaccatcgggcgcccgacgcgtaggcccttcttaaggacatacgtccagcttggcaggtggaaagagagttggactttggaggggggcgtggctaatgggcgtgtgatcgctgtggtcgatcaccccccatcccccctatacactcctctcctcctttctcctacccttcttttcgtcctactgcaccataaaatttttaaaaaataaaaaagcaaggttagcaaattttatatacggaaatactatatataaaaaatatttgaattcaaattcaaatttaaaatgggtatgtaaacttttgacttataaactttgggcctctaaactttagttgtataaactttagatgtatagaaatactatatataaaaatatttgaattcaaattcaaatttgaatcgagtatataaacttttgacttataaactttggttctctaaactttaggtgtataaaatttagatgtatagaaatattatacataaaacatatatgaattcaaattcaaatttgaatcggatatataaacttttgacttataaactttgggtctctaaactttaggtgtataaaatttagatgtgtaaacttgaggtatataaacttgagctgcataaatttataaaaataggaaaataatgcggtgccaaataaggaaaccacgtggagggggtgatcgctaggggcgatcgatcgcccgttagccttttcggctttgggggattttaaaaaaacaaatataatatttcaaaaacagtgggtccactcaatttgttaaagtgtcacatatttcaaaacagtgggtccaccctatttgttaaagtgccacgtgacggtttatgagtatttgtaggaatagcacgtggcggcctaggagcatttgtagaaagattaatggacttttagtatataatagataatagataggttaggttatgattttttcccttcttactacttaatttacttagcaatttttatttatgtgtatcgttaactgaaataattttttttaaattaaaattattaaaaaattatttgagataaactatgtcttgtgatatactgaatggcttggctatgtgcagcattgaaaagaatatattagataccattgatctccaagctattcttaatgattttgcttaaaaaattcgtgaaaaggacattttttacaagagacattgcatatttgtggtctcctatttaaggtattcatattacctttttttgactggaattactgccagggctttgcccagcagtgtaattttataaagattgaaaatatttacaagattacagagttacaaaaggaaaccgcaaggaagactataaggtttgtaaccaattaaaaacaaattgctttgagggatccttcattctgcacatatgcagaagaacttctttcacaaaaaatgatctccagacttggaaagaaggttgaacgttttgaaagattaaacaatttctttgcttccatatgtgccaagctgtcaaaaagaaaatctccaagaatcccctctaagcaaacttgattcttgctagggcaatcatttggaaaaactccaaattatgattccagtcaattcccaggtgctgccaacacctgatactgaacggacaggaaaagaaaagatgcaaccttgtttctctgcaatccgcattgcacaacacacatgtgaggtcatcatcttctttagcacaatgtcgtctatccagcatatctcttgtgttgagtctgtcacagaacaggagccagacacattttgttttccataaccaaatcatgtgtctgggggttgcaacgcagaaaagttgagcttatagaatttcttagctgtgtactctgaaccccagataaaattcgaagcatcccccttcctgactgtatattcagattgcttagaacttcctgtagctgtaaaaattaagaataggccacatctgagaggggtagggtaaaagaatcttctaaaggtcttgaacacatgactttcactgaatcagttttatacatggtcacagcaaaaagattggggtagctagtgcatttaaaatcatcattccatagatcattccagaaaagggcagtagttcctatcctgatttcacatttggctatccccctgaagatgtttgcaagagatgtgatatccctccaccaaaatgaacccttattcatcatcaagtgtgaaactttagaatcataatatgtttgtgagagtattcatattaccttgccttcataattcttttagttgtcgataacactatcaatattatttatcaagaataaattactatgttgcaatttccactacttgatttattatttagcatgttagtaatgttatgaaaatagatgcacaacggagacacgaatttcacgtggaaaacccttgctggaaaaaactatgggcgtcgaccggcaataatcactagaggagttgattacaaacgtaggagaataacattgggaatatcaccccttcctgtatggcatacaagagtatatatatgagataaaaataaaaacacctaatagaaaaagaaagacataaagtactattaggaaactaatcctaatagtacaacttcatcatgttgatttgcatagctatccaggacagatatgtacactaatccttctgcaatcattttataggtggaattccatctagtcggtggattaaaagaaaaacccaactttgaaggaagattcttcaagtttgctatagaattgaaatcttgcattcttgatgctgaagaatctaaatgcttcaacaactcacgtagcttgtgtattgttggtttaattatcttcataccatcctgaacccaaatatttaggatatgggcacaacatctaacatgcaaatgctgaccctcaaacatcaatgcatccttgtgattctttatcaactcttgacatgagaattgttattactggtattatctaaagttatagttatagtaaacaatttgtttctaatgcccaaatatgtcaagcaactcattatagcttcttcaatggcgaatcctgtgtggggatacttcaattccttaaagcttataattttcttcttcatgttaaactctctatcaatatagtgtgctgtgacaaccatgtcgcctatatttgaattgaagtccacatatcggatgtcagacatacacgcgaatcaagactgtaattcagcacgcaagtcttccctcatttgctcatacaagttaaaggcatcatcatgaagtgtttgacgccccacaactttgaaagttggctgcacggactccacccactccaaaaaataaggatcctcaattttattgaatggcacctctgcgtgaatgaagtatttgaccattagctcccagcttctcttgggatcaaacacgaaaccttccccagtctgtttcttaattgttgcaaggaagttgattctagcagcaccatcaatagctggacatgattcggctatgtgattaataaggtgacttctgcctgactttttggtggctgtcaatcttaagctacaatatttgcattgagtcttggggacaccatctatcatcacaacctcttgctgaaagtgttaccatactttagccctcatacgtgttcttgaagttgattattatttgtattattagtacctgaactctctgacatgacatatttattattgagtttgttcaattgtctgcatagaggaagaaatctaaaatgaagatagttgaaagaacatggtctataattatttttttcacacattgtacacgtgctacaagctaaaaattgcacactagaattccattgaccatagaattaatttgcatctcaaaatcatatcaagactcaatctgtaatgatttgttaaataatttgcatttatttcaacctatatttttgtatattatagaatgcactgtcaatcccagctctacctatttcatgggcaccttttagagcacatagtactattaacattctttattaaagaactcaaaactatcaggcagcaaatcaatataattaaaaaatcaatataattcatccagttgaactttctgaattgtgtgtagacatgtttaataagcctgcttgtgacaagattaaaaaattaacattcaactgctacaaacagccaaattaatacgaatctaattcaacccatagttgtaaacttgtagaatccactatcaatctgaagtatttccaaatcagtattaccaggcataagtcataagtcctgaaaggaatattttatatgtacagaatatttttatagcaacatttaattaagcaatatgcttgattaagttcctagctaattaattaatgtagcacacaaatatgatcttgattaattcatagtgtgcaacaatgtgagcgagtatcagcacagtgggtgcacatcaaagtttgtgggtgaataaaaggtcgacatactttcagttagttgcaaaaacattctgtgacttatgaggcaaccatatggactacatgaacaatcggattcactgcaagaaaaccctcatgtgtccgaataaaaaataatatttcttgcaaacacaacttgaaccgagaggtggaggggatcagcatggggtgcacctgcttataatgtactcaggcgcgaagaaggtgaagtcacgggttggcctggtgaggtactccggagacctcagagtggctgaggccgtgaggttgcggttctccgcttcaagcaggcgaggttggtgcagtatgatcagcagcagcaatggtagcaccatgagctaccaatttctttaggactccagtaagtattctaaaatcaaaataaatcagatttttgttcagtacatgctacatagtaatctaatgatgttccacaacagtagttgtctagttgaggccgtgataaatatccaactattgtgcatataatagtttgctgaaaagagatcataattttagactgttgttaggtacccatggttaaattagcacaactgatcttggaaaacatacaggtcattcatagttgtggccatggcaactccatacatgaaatcaatattcttatgcatgcatggtaatgaaaggtagctgcttgtaaatgcaatttagaacaaatcttttaagcatggcattcagcacacaatccacaatacatggaggagagagtactcgccggatcttgaagggagagagcattgccgaatcttgtggggagcagggacacacggcagcggatcttgcatggaggagagcaacagcttcttggcgctgacggagaggaaatggcgatctggcggagcggtgccaggagatgacgccggagcggaggacgagcgagaaccagtggagctgtagccgcttgcaaccaggtcgaagtggcgagcagcagcaacttcttggcgccgatgaagaggagatcgcgatctggcagagcaacgccgggagatgacgccggagcgaaggatgagcgggatccggtggggccgcagccgtagccgcttgcagcgagggcggagtggtgaggagcagcagtagcgacgcccattggcggcgatggtggtggcggcggcggaggtggaggagcggaggacgcgaggagcagatggcgcgaggaggaggatgagttagcgtctgcgtgtggattcagtccgtagatcagtcattttactcagcccgcatccaccccaaaccaaaccacattttttgtaagcccagtgcagtccgatccaaaatgaaatcccaggccgtttcaatccaaccaaaatgatccaaatgaggatccagcccacttaatccaagcaaagtcagtccactggtaggcctagctgtaagtttacagcccgcttctcctctctctcctctcttttctcctccaccttaatatttagccagtttatagcctactattatacttgctctccaccgaaataggaagagatgctgcccgttcgccgcctaaggttcgcgcgaacgtttgctgattagagttttcgactaatacagccttaggagtctgcttcgcgaccctatgggcttgggccgtctcggactctcggtagccccatcgtttgctcggccgagtgtgggcccatacgacccattccccactgatccgcagaaacccgactcctcgatccccagttccccacctcgtctcctcgagcgctcgccggcgggcggttcgccggcggcgcggcggagcacgtgctcctcttccccgatctcctcctccgcgtcgtggccgccaagctctagacgggacaggacgccatccatcctccaggttatccacttccgctcccttctgctggtaagcgctccgccgtcgcctcaatctgtcgtgggatcgagctccgcaccggtgcctccgatccgtacgtcggtctccgggccgaaggcggacggtggtcggggatggatcggccccaacgccggcgtcgtggccgggcttcggatgaatggtgtgcgggtgacgggcctgtagtccgtccgtccgtctgctgatctgcatcacgcggccaacaagtcaatagatagtgaactgtagtactgtaccactaccaatactgacatattctgaagacaaaacaaaccaattctgggaaattgtagacgagattccaagaaatttcgtgactcttgtctgattctgatgtccatcaagaggatgcaaagcaccaagttgggtcgtcatcagcacgtatgccaggtgacgggaggacacagtgacggctcatgatttggttcgtcgttccatcggcctaattttttccttttgccatacttgttagtagttgagctgtcttaatcggcctaattttcttcgtttagtcgtcttaataaaattattgttcgtttagctaggtgggtcgtctggtctagtgcttaatttgggtattgctggctttacataagtgggatatttaatattgttgctatgattatccagttttgtcatttcttgatgatggaacatataatggccaacatgtcaatcaatagcaggccccaaaggtagcaattgagaactgatcgagcttccaagaaattaaggtaggctatatggaccaatatattgcttgactgatagcaccgcttctccattcaggcatccactctgaccagctagcccattgagcaaaggcgagcaaacacattggttttatgatggcagcagtgaactcttccatgggggtcatggcgccactcctcaccaaacttgccatgctgctcagcaacaagtgcaagaaactcaagggaatgcgtaagaacattgagttccttagccatgagttgaccgaaatgaatgctgtgttggagaatcttgcagatatggagaagctagatggacagcagaagctgtggaggaatgacatccgcgagatggtctacgacatcgaggactgcattgatgtcttcatgtaccatcttggtgatggtaataacaaggatggcttgctcaggaagactgcacgcaagctcaggaatttgcgtgctcgctatcagattgccgacaagattcaagaactcaaggctcgtgtcatgcaggtggctgagcgccgtgataggtatgccaatctaggtgtatctacctcaagcattcccaaagtggtggaagttgatccgcgtctacctgcactctatgaagatgcaaaaaatcttgtgggcattgacggtccatgtatggaaattactcagtggctaatggatgaagtagagaatggttcgatacaacaacttaaagttctctctgtagttggctttggaggcattggcaagacaactcttgccaaacaagtatacaaccaattgaaaaaacgattcaatttcacatcattcgtgtcagtgtctcaaaaccctgacatggttaagctgctgagaaatttactttcaggaacaggatttcaaggctacggaattcttgatgaccatcaaaagctcattgacaccctcagaggacatcttgctaataagaggtatgtataaatccatagtttaactttgatgtggcattcatgttgagttcctatggatgtttctcatgttttctaatattttataaccatgtcttcatttctgctgtattgacttgattttgggcctgtttggatcatatcgaaatattgtctaaggttgacagctaattaggcacatttcccagattaggtgacagttcacttcgtagccacacttgtggcaaggttccttgctatggtccataatcagtactgacaacatgtgagcgctgcagtagacaaggttccttgctatggtccataatcagtactgacaacatgtgagcgctgcagtagaaggcaggccgccacgagataattagaggattagatatcccttgttgctataattaggggactagagaccccagttgctttctttatttatgtttccattcgagctggctttttttttattagagattcttgttaggggctatcctatagaaggatcagccatatcccattatgagttaagcatgtattgatatctctcttcatctcctgtgcacaagcacggccttgccctcgtgctggtcattgtcgatgcatgaggttcccttgctctcttgatccctctttgtgctagccacattaataagcccataacgttcttgctcattcagttgaaaaagtttggcacaattttatattggaaaaagtaagaattacccccctaaactatcgtggtcgaccgaattaccaccctaaacccaaaaaccagacattgctaaccctaaacttttaataacggacgaattacccccctcgactcaatctagagcggttttgtcctatgtggaatacgcgtggcaatccagtcagcattttgtttataaaagaagtgggacccacctgccatactctccccctcctcctctatctcctctctctcactcgtcccctctctcgcacgtgcgggtcgagcggcggcacgcgttctgcgcgcacggcgggcggtgggcggcgccacgggatgcggaggcagcggctgcgcgggacacggaggcggcggcggtattaatgagggtatcaatgagcttttgatcaatgagccaaatcttagtcaaatggggcacacttgggcaaattgttgcaaattatgttttcatatattgctacgattggatcctaaatgtgaaatttactaaataacttttctgcttcgatgttgattcttttgaatttatttttaataaattcctctagtattaatttgcggagtctactgttgccatatcctacaaaagaatttctctatttttctactattagttcaaaagaattatatagggaggcctcaacaaccatatgttaatctatgaaaaatatattcgtaggtaccttattgtagttgatgacatatggaacactcaagcatggagcattattcggtgtgcttttgctcaaaataatcatggtagcagagttatagttacaacaagaatcgaagatgtagctacaaagtgttgcgttgatttccatggtatggtgtacaagatggagccacttaatgagtttaactcacaaaagttattttgtaaaaggatatttgattcggatagtattcctgagcagtataaaaatgtatcagaagatatgttaagaaaatgcaaaggtgtcccattggcaatcattagcattgctagccttttatccagtgaaggcatgaatgtgggtaagtggaagaagattcataactttatgggttctgagtcggaaacaaatcccactctagaatggatgagacatgtactgaatctgagctaccttgacctctcacataatctcaagacatgcttcctgtatctaggaatatatcctgaagaccatacaattttcaaagctgatttgataaggctatggatagctgaaggatttatccatgagaaacctggtttggatctggaggaaacagctgagagctatttcaacgaactcattaataggagtatgattaagctagatgattatcgttccagtgaggcatgtcatgtccatgaccttatgcttgaccttataatatcgaagtgccaggaggaaaacttcatcactatagcatctaagcagcctgtaaagaatgtaacaaagcttccagttcgtcgtctgtgccatcagttgtcatacggaaacttggccatggaaagaatgaaactatcacaggttcgatcctataatactttccctgcgtttggctgcagtatgcagcctcctatttctatgtttgagcatttgcgggtattggaacttagggcctattctacatccgttttccttgatttgtctgctgtgagcaacctcttcctgttgagacacttgagtatcagaggtttcaggttaaagctgcctcagaaaattgggagactccagtgtttgaggacactagatctactaggcagccttttggttactggttttccatcagatgttatttctctatcatcattgtgtcatctaacagtttcaggtgatgcagtgctgcctaatgggattcagaaactggtctctctacaaactttgttgacctttaattcagggggtttgcccgacatttttactattgtggagaaaatttctcgatttaattcatctgctatcagactggcaaaaacacgtcgtttcaacaatggaggtcttcgttctaccaatggaggtcttcgttctccccctgcctcccttgagtttccaagtttcgatgatggttggccaactgaatccattctggactacctatctcagcatctggatacaccagcttcctcacattcggacctcttctcgccaaatttggttgcttgttcaccgcatattctgaattttgcatcgttatggcttcagcaactcatcatccgtaagaacattcgcaatgtcccatcctggctgtggttttctctgaagctcacaatgctagagcttcgtgttgaggagctcagttgccgcgacgtccaatttcttgctgggctgccctgccttgttgacctcgacttgactgctcaagctacccctgagaacatcatcactaaacgcgttaccacgcgtttgggaagaatcacccataccgacaatttcccaaagctgcagaaatttgttttaacatgtgatttggcatgcctgacgtttgagccaggggcaatgccacagcttcagattctgaagctagatgacaagaagccttctaacttggaggaagggcatggcaccagtggagcggcgcaacatggcaaaactccacttattggcatcgagcacctaccaaggcttgaagaggtccaagtgacaagccactccagcaaggtgcctgcatacagggacgccgtccaaaggcatccaaggtttcaagacatacgtgccacgtttaatatctataattgaagtacaaggactcagaaaatagcgctgaaaggtactcatgatatccttatactctgcgtttcttcaataattaatgtttgctgctgttttatgggaatatgttagcttgagtattccccataactgggagaagaacgctacgacatgaagcgtaccagagaagcgcagccacagttgctgctgtcttgtttgcacgacctaagcatcacactttagtacgattaaattttggggcttgtatttaagaacttgtattatgttgcgagacctgtctaggttacttgtatttgtgtatgttcaagtccttacatggcatgggcacaagcatggtctgtgagactttgcacttatattaacaaacttctctagccattctctgttgcagacttgcaatatctctcatttaggctattattggtcaaaacatgatttttgtcgatgaatgataattccatagacttgtactttcacaaaacctccaaaaattcaaggtcgaccaatgactggttttgaagtgggggaaattcaggttttttgatattccagattggaaaagcgaactttaccatttgttagatcctttcacgtccaatttatctgcttttacaggagcacactagttaatagagtgatcagctctaaaaacagcactaaagtgaggctctgcacttacaaatatgaaattttaccacacaattttctctccctttttttaggggagagtagcatcttttataagaagagaaacatgttcaatgagagcatggagaatttatttaaagttgttaggtcgcatgtaccaaccgaaactttgaatgccccctaaatgccagctgaaactactctctgcaggctctacttaatctccttgttgtgtttgtgactgacttgacacaaaaacataaatgcacacaatatccacagctgacctaagttatttcttgttatgcagacgctctcggcgatgaatacaagctactcaagggggttcaaaaagagattgcaatcctgaagcatgagctgagctgcctaattcccttctccagaagcttatcgacttaggagtggaaggacaaggtgcgggaactggcctacgatattgaggactgtatcgacatcttcctgcaccaacttcatcctagagaggacaaggatagactggtctggaaggcggtccggaagatcaaagcaactatgtgcctgcccgccatcaaatcgccctccaaattcaagaactcaaggcacatgtcgatatacatgatcgatgtatcaacctctggcgataggttcataaggatttgattcccgattgtcgttgctttatgcagaagctggaggccttgttggcatttgtaggttgtttagggcctgtttagttcgcgaaaagaaaatttttgattgtcacatcggacgtttgaccgaatatcggaaggggttttcggacacgaaggaaaaaactaatttcataactcgcctgaaaaccacgagacgaatcttttaagcctaattaatttgtcattagcacatgtgggttactgtagcacttatggctaattattaactaattaggctcaaaagatttgtctcgtgatttcccccctaactttgtaattagttttttaatttatctatatttaatattttatacatgtgtccaaagattcgatgcgatgtttttaggaactaaacagggccttattactactagagactaagatttaggatagaagactttagtgcacctcattaaacaaggaattattgggccagagggtggttggcagggattgcaacttcagaatgaaattttggtaattttgcctccaccggcaagcacatgcatatattgtctgaaattttctcctttttttccaaatttttgtaaatttgttcaaagtttattcaaattcatttataatctgttaaattttcaaataattttgtcaaaaagtaccaaaatttcagaaatttcgatttccactgaaattctgaaattttggctaaaaatagaagtgtaaaccatggtggatgggtgtatgagacgaaatttgaatagaaggtaaataatatgaactgtgctagaaggccttatgtttttatataaattttaaatactatgcaaatataaagctacgtgaactcgaactcagatcagtttgactacactgacttttaaaatcgtttttaattggggtaagctataaaagtgaaacaggagagcctagaaggactagggctgcaatcggcaaaaatacccaaaagagaggataggaaaaaattttgaaaatatactgttcatcaatttattttgcaaaaatataccggattgtgaaggtttttgcacaaatataccttcggtatcgctgtttggaagagcgataccgaggttcactactagaaagtgcgataacgtggcgaaatcgcggtatgacatagcgaaagcggagttgagctggcgatatcgcgcaaagggaaagcgagaccgcagcggtatcgctctttggtagggcgagagcgccacgtggagaaatcgccgatttgggaggcagtgtggcgggcggagccatcgctctcgctttgtcgttacgcgaaaccgaggtcggtctcgtaatccgaaagcgcgagaccgagcgtgacgtgatagagaacggcacgcggtatcgcgctttgcgcgcacgagaccggtgacgccgcatgcgcgagagcgacgaggcgtgggggagcgtagtgggcccgtggtatcgcgctttcagcgcgtgagaccggtgacggtatcactctccgcttgagcgagagcgatggagcctcgtagagcacagtgggcccatggtgtcgtgccttgtgcgcgcgagaccgctgtcggtctccctctccgcatgtgcaagagcgatgcagtgcggcaaaggtgcgctgtcacgctttgcgcgcgcgagaccaatgtacagagcgcaggaaaagagcgcagaccgacgccaccgacacctttattttccatctctctttttctttttgctttttgcatgggttctgatagccatctccctttcctttctggaaatgggcggaatacctctgtgcactctcttatcattttactattttgtagtcacatcatgtcggccacatgtgtttagctcgtaaccgctctattcgttcgaatccaatgtgctcaatgcataaaatgagaggagaggagatggtcctcacagaggaagacagaaaagaagacagaaaagggagtgaactgaggaggagaggaagagcaagaaaagagaggagacagtggagagaagaaataaatgatacgttttttctattagcaaaaatttgtacggggaggatttagaaaatatcagttcacttagtttatattagtgttagttaatattcatttttaattatgtcagagaaaatttgagctatatattagtttgtacattatgattttttttgttaactaataattttccgtacgacagttaacacaaataatactctcactaattaaattaatagtgcagttttgatgttactcgtgcggtttaaattggataatacttttattgtgtactactgtgacttaaattacacactaatttcatttcacaaagatgcaatcatacgcgcctaaaatggtctcctctctttccaatcacgggacatttcacgtagaggcaatcatctacatttaacggtgaagattccgacgcaccgaaagtggcgtcatctctttctaattattaaagaaaatagtgaagcaaccagtgccgccaaaagtgacggtatccttttgtaattattaactttaacagtgaagcaggctaacgcttcgaaagtgccgtcatctctgtgtaattattaattgaatagtgaagcagtccgacgcgccttcttctctttctaatcattcacaattcctgtgtacaacccattaataattcagactatgcgcagcttcttcctatcccctataaatagcaaccaaacctagcacacaactacatctcttcttcataaacgttctgctggttccaactgcgtgttgtatattcttaggcccgatcttgtggcaggagctgagtagctggtgaactcgctttatgttgttcattcactcgctacacggttcctgtcccaagatcgagtctgtgaatatgcaaatgtgattttttttaatagattcttacacccactctttttttaagttccaacatccgtttgtgaatatgacctactactgcaaattcataaactcggtgttgcatattcataggcccggtcttgtggtaagaac

SEQ ID NO: 70309 - DNA, 10025 bp, Oryza sativa
atatatacatatttctcaagtttattaatgtatatatgttgcacacatagtaaaaaatatgaaaaaaaaagtttatactttctacatagcaacggcttaatatatcacacatgaaatattaacgatttgcatcgggtattcgcatcaaatgtaaacgcatttagaggatcgctctcgcgctccgggtgcgcatttagggtctctctctttcaaagaagccgtcgctgtcgcctcctacgcgattagtagccgattagcaggtgggccacgacgcaacggtatcgtcctaggagagagcgataccgcgcgcgctctcgctcgcgcatagcttgagaccgctccgggcctgcttcgggccccacgtgcgtcagacgagccacgccgctacggtcttgcgtaagtagaccgtaataccacacgcgctcccgctcactcaaagcacgagactgcttcgtgccccacgtgcgtcagacaacgtcggacaacccgcgctatcgctttacgaaagtgcgggaccgcctcgctcttgcgattttcaaatgcaacaccgatgcattagcactcccgcgatttcaattagcgatagcgctgcggctttcgcatgtagattaagtgatatcgctctcttgcgacatcaaagtgcgatacggcccctaatcaacctattcttgcaattttgatcaaaaacacgtatattttcaaaaaaatttcgaaaggatagctgctgatgaattaggccctgtttagtttccaaaacaaaattttttacactgtcacatcgaatatttggacacatgcatggagcatttaatgtatggaaaagaaacaattacacagattgcgtgtaaattgctagacgaatcttttaagcctaattgcaccatgatttgacaatggtgttacagtaaatatttgctaatgacggattaattaggcttaataaattcatctctgcgaaatctgtaatttgttttgttattagactacgtttaatacttaaatgtgtgtcggtatatctgatgtgacaaccaaacccaaaattttttcccaactaaacaaggccttagcagcgatataatagacgctgacaacgaatcagaagatgttggaagaagcaaagaaaggctctgaaatttttacatggaaaaaagagcaaccgcccaagaaggatggatcacgtagcttgtaaacctgccgatcctgcttcttcaccatgacgacccaatcgtcctcaccatcatccaccagagagtaagtgcgatgaacaatacgtgctctgcccacctttcccatggaagcagcagcaatggaccggaactcgaaagaagcgaagctccccttccccatggcgcacagaaggttgcccggaacaatgcggcacttggagttggatgccaccaccacccgcaacgcaacgatggtcagctccttcttccccgtgacggccgagatcccgaccaccatgcggtacaccgtaacgtcggcggcggcggaggcgacggcgacgaagcggtggtcgtcgtcgctgccgagaggcaaggcctggccgtcgaaaggcaggttgctgtcgtgcaccatctcccactgctcggtgtccatgtcgaaggcgcaggtgcccttgtcttcttgctgctgctgcggctgcagctgctgcaccgagaccgacaggaggatgtgggagccgacgagggcgtacgccgcgacgcgcaacttgggcgggtcgaggaactccagcgggttgaggcggcacgggaagagcggcggcgatgggagttcgcgccacacggtgtggctgaggtcgtcgaggacgaagaaccatggctcgaaatccagcggcctcacgacggccggggtgcgggagagagcgtagagcgtgccgccgccgactacaccgccgccgtcgtcagagatcgagatgaggacggggttcaccttggggaagatgagtcgcgggccgccgcgctccgtggatgtctcggggtcgtagacggtggtcaactccacgccgacgcccacggtgcgtgtccccaccgcggcgaacgacatgccgcggccgcggccgcggccgctgccggtgttaagcagacggcgggcggcggcgcaggcggcgacctcgattacggagtgggtggtgggctcttcctcgactccgtgcgccaacaccatgtacaccggcggctgcttctcaggtgaggcccccttgttcttcttcttgttccctggacgaacgcggaggagacgaggtaccggctccggcgccggcgtcggcgtcggctccggctccgcgagtttcttcctcctcttcttgtccggcgtcaccatcttcttccctcgactggattcggatttacgtatcaaagacgtgatgaaaggaaaccctatcccagtggggttgctttcgtcggccggaggacagcatgggcctagccgagactgggccaaatgttacaactccactacttgagactgggccgccaaggcagtgcaacatgcgtctcacctactactaaactccccgtcgcaatcaggattttttttttctttttggaacgttcgattgcgagtgcaacaggcgaatgatagcattgctgcgttcttttttctggtttttaagcatgctcacttctacaactactacagaaacgaggacgacatccctccaaattacaggtatagaccataactgttcacgcatgaaaaaaaaaagttaacccgagagatggatcaaaggcttcttaaggactgcatgtaaaaaaactaattttgcatgcgggcaagtaggaaatagattttttttctgcaccttttttctcttcctccttctctccaccgcaccgtctactcttctccagaaccagggctatcctattaaatttgaggccccagtgcaaagtcgtgcagtagtaaagaagaataaaaacttaattgatgatataatacaacaataatttatactctataatacatttcatagcaatgtaaaatggtctaaaataatatacatgtgcatagtatatttcctattccaatttgttgaagacatgtcttcaaaattaaaatacaggatgtatctatgtaaggataaaaattgatttagtgtatatagtagatgagcctaaaaacctaataatccatacatgatacactaaaattagagaatagggattagtggattacattacctgattgctgattagagtagacgatcaggccgtcaggcgttgcagccgacaaggactccggcaggcaggccggccaatgatgggtcacagccagcaccagtttctcagttctaggtagcgacggcgacacggcatcaggacttagcgatgacatcgcggcagtgcgccagatgcgaacggagaaagagtcagggaggcgaggcgttgtttcgttttctaagcgatgccgcgatcaagaggcggaggcccatcgtgccatgccacaatcaaaggcgaaacgtgggatgctaattggcgtgggcgcgccactaacggaactgatgagcacgccagcctacccttctgcctttccaccacgctatttcttgttttttcgttatctttttcgctttatctttttttcttccttacccctcgcgtgtttatcctttttttcgtgttttttttccgatttttttattggtagcacacatgttttcaaaaatatttgagttaaaagtttttaaatattaacttaaaagtttttcaatataaaagacgtttcaaatctagagttgaaagtttttaaattttgagttgaaagtttttaagtctggattgaaggttttcgaatctgggttgaaagtttcaaattttgggttgaaagttttcaaatctgggttgaaagtcttaaatttgagttaaacgtttttcaaatttgagattaaaagttgaaagttttcaaattttgtctaaaaaaactcaaatttcgagttgaaagttttcaagtatgggttaaaaagttttcaaaatttaacttcacgtatagttttcttttcaatctattagtaaaagaagaacattaaataaaaaatattatctttattatcatcattatctaaaactaatcaaattaaattagttacgttgttaatgcataaacatctccgggaagaaaagaaagtgcgggaaaaaagaaaatactaaccgcgtgcgtgccaatttgattcaccggcgcgtatttaatgcttatcattattggaagctaattacgtgaagctagcgcctattacaccatcctaatggattagcccattagttaccgataaatcaccacttgcatcagtgcgtgcatgccctggtgaccatctctgcatcttgcgcgtctgcgccatttagcaaaaccgaggcgaaacgacgtaaataaaacatgaaaaaaatcacagatttttagggctaattgggctatatctatatatatatatatatagtgttggagttttgggcctaggggcccctgaaaattggggccttgtgcgggcgcgcgggccgcacagccccagggacaagcctgtccagaaccatcgttcgccgtttccccttcctcctctcctcatctcttccttttccctctctcaccccctcgctcatttcctcccttcctctctcacggtggtggtcggctcatagggtggcagaggtggcggtcaacgggcactgcaaatctggcaacgactctccccgggaagggcggatccgccaccggcgggctcagaagggcggatccaccctcacatgcagcgggtgcaagcggtgatctcaggagtggccaacgacctctttcctccatgacggtgaacccggcagctgtggacctggcaatggggagctcgtcggcagcagatctggcgctggggagctcgacgacggcgaacccggcgggctctccccctcgtgcgcacgtggatctggcggtggggagggtgttggcgacagcgagggcgtccgctcttacctcctcaaggccatcaagtacaaaaactaaaccggtgtgctcctctcttcggcgtctttggcttcgagccgccaaccgggacttcgcctaccgcatgatgctagctgtgttgttcctctgcagcgacagcgacacccctgtgaaacatggatgtgggaactagaggccagcgcgaggggtgccaaggctggggagacggattaaggatggcagcaatggccgctgagcactggagctgctcgctattgtagcctacccatattgtcatgaaaataagactatcacaaaccgcagccacgcctcccgttgtacctggcctccccgcggtgcatgccgtcattgcctacacactgccgccgatgtttgtcgttctaccaatgccaagggtcgtctctccgctttagattgattagacatctatgattaatttgacgattggattgaagatgaatcacgaattactaaaatacccttttaaatttggtggcaaattccaaacgtgccctcgttcataagtatagtatattgtaccgtaaaagttccctttctttattgctcatttttgtttgttcactatgtaactctctaccataagcatctttcaacgttaattgaagctaagaacataaagtgtcagaggcttagagctggtaggtgcgtgctcgacttaatcaatagtattgcctattttctgctagctcagcatttgctgtcctagatttgggactcctaattagcaatacgttgtaccggttgatcaaccagctattctatgttgaagagcgtgaaagcatctaccacttgtgttaggtcagaagattcttcctcccttgaggatacccctcaagatgatcttatgcttaattcggcaaaggaatggaatttgtcttccattcgtaactatttctttattgcataggcacaagagcgtgccagtttctattattaaaaggaagaagaatcactctcctttcgatgttaaagacaagagttgattaaattaaatttctaaagttaaatacgtttatgatattacttcctctgtttcacgatgtaagactttctagtattgctcatatccatatagatattaatgaatctaaacacatatatatgtctagatttattagcatctaatataaatgtgggcaacgctaggtattaaatctacctgtaccatctctttatctaaaacatttgtgaaattatttatgatcaacgtttcaaaagtctaatcgaataatacaattaaacatcaaatatttatgatggatacatgtacgtacaattcgttccaaccaacagagggttgtcatgtgcccggcggttagaacagtggtgggattatgttgtgatggttagccggtcaactaaagaaggcagcaacatcatcagtcattattcgtggcatggaaaattactccatctagctcgcagataagtgaagtgttttttaatgtctgcagtcaatatgtttaaatcttgcccattcatattttttgtcatatctcaaatcattttttttaaaactgtcgtggccagatttatcttcaaaattagtttcaaataatattataactttgctatattttcatatgctttatactcctacttcttaacaatgaaactagtgttttggtgatcagttgctccgtccatactccatagtatcacttattcacgacaggaggtagtgtatcctatcttactaaaaggttacaacccattaaattctaaaactcaacatacaaaagatgttacatcattatgtactaacaattattacacttaaacattatgcatgctatattatctatattttgtaatttattaaattttggagttttaaaatagaagcatgttaaattatcatcgcacataattcacataatatttcaatatatctctccattattttttaaatatactatatacctatatagttcatcctcggttaatattatttttctctcctcttatcaagccatatcatcttaatttttttaacccgtagatgattaatctatactccatattatctatttctttttttctttcataaaaccacaccgacttacataaatttatgttgtttagctattttatacattatttttacttatcggatttgctataaaacttccaaaagtttttgcccccaaaacttttagataaatgaccatccgatcgcctcgacatttgtgcatgaagggaaaaaaattgctagaaataaattttcacacatgtcacgcgtaagattttagtgctagctaaccagggcatggttgaatgcaagtttattatatcgtagttacattgtagttacagtgcagtagttacgcttcaaatatagtatagttacacttacatcgaaagttttttactaaaaaaacttgtggcagttttttgatactacctttaattatttttatcattctaaattcccgcagtaacgcgcggggttttacctagtatgctaagtaatgctagatgtagaaccattaagatttgtcaaattgatcctcgtgggttgtggccaaaatgttttatgatgacatggtcaacgagagaaagtttgccagcagtttctttcatggattgttttaagagagagacagagagaacatgcatgggcatcaccagcaataattttaagattttcaacggttcttttttttttggatacggatcgacgtacaatactcttcacgtaggaaagtacgtgaacgtaccaaattagctgtcattcaaagaaaaaaaattaagacaattaattagctagtatcttatcttatataactggagggttgatctgctagctactgacagtcaaacgcagtgccaagatcattgacaagcatagatcaagaaagagcagagacagagagggattgatcgaggcatggccgtgaacatttcgactggggtgatgaactcactcctggtgaagctggaagaggtgtgtcgatacgacttgaaagagatccaattttctaccgaatttgatttcaagaacaatatatggcacttgaaagaggaattgagctgcatgaatgctctactacagaagctgcctaacatggaggctctgaatattcagaagagggagctgaggaacaaggtacgtgagctagcctactttgttgaggacagaattgacaggttcatgcacagttttggcactgtagctgacaaggccaccttgctcactgacacgatggatctgatgctccctatcttgtttgaaaaaattcacgaaatcaaggattatgttgtcgaggaagtcagaagagtagagagtatatacaatctcgacgagtctattagctctaacccgaggcagatagaaatcgatgatatttcacctgtcctgtgtggaaaggcaaataggctcgtcggtatcaatgtcccatgtgaggtgattacacagttgttaatggaggatatggaaggagagtcagtacagcatcctaaggtggtctctattgtgggatttgggggtcttggtaaaacaacgttggccagccaggtctacaagaaaattcatagcagatttgagtgcgcggtgtttgtgtttgcatcacgaaaccgtagcacgtcaatgattttaaatgacattctttcgcaactcagatatgacggatcggccgatggcataaaaagtctcatcaatgcaaccagagaaaaactctcttgcaagaggtatgagagcatatgcttctatggttctatttcgttgtgtcaataaaactatatatcccaataggcaatggatggatcacagtaacttggtgtaccatcaaaaagtctgtgtagtaaacagtttggtataatatttcatagtactttggaatatatttcctagttagttgtttaaagagaattatattccttgacactcagttcagtaccattcaattatttgcatttagttactctctattccttatatacaatccataaatcaatttcctagacatgttaatggaccatatcagcagatatgcttctgaaaaaaaaagggccataatggccttatggacaaagatgcctcttgtagttcccaacattatatgacaaaagcttgtgcaaaatgttccaatgtttttcttcaagtttcagttgttttggtaaatatatattcttctgcaaactatgaaagaggaaccacatatacaaaaaaaaaacacacaaatattttgttacagcaaaagacatatgcgagatcttaatatatttcctaggtaactacataaatagtttcatagttcttttaaaaaaattatagtggaaccagttcgttgccagccccatcttatttggaattattgtaagaattgccaagtccaatggcctgggatttaaatagttgagaaactcaccagaatatcaattcaactttacttttttttttaaaaaaaaaagccaatacaacagtcctatataaaaacaggtaaaagagagcgaccatggggtaatctatctcaaattgccatacacaaaactcttccatataaaaccatatgtattatatattatgtatacggatcttgtagagaatatctcccatttgtgccgtgaggcaaagataattcatccctgtcaaagtttaattttacattctccagtattgaacatataactcaacatgcatgatcctgctcattctcagtgaagtttctttggaaggcctcctgtaaaacaatatctttaactgatcgcttttgttgattgctaataatatatagcttaggatattctactcacaaaaaggaactttcataacccaaacttcctcgcaaaacttgtccattccccatttgtttaatactttcttttcacaatactcctacaccaccttttacttttatgaaagctcttcaagaattgttatcctttttattcagaactttgaaaaaagtccaccccttaatttgcatctatttgtttatcaacaaatctacacacaagtcagaagaattattttttagttccacaatccacaaaatcagccgatggccaattcttgaatgagaggatagttggtcctagggaatatatcttctttt

SEQ ID NO: 70310 - DNA, 13865 bp, Oryza sativa
aaatccgccgatggccaattcttgaatgagaggatagttggtcctagggaatatatcttcttttctttttaacatgctgtgatgggagatgataattttattcccggtaaaagaacaaattctatgcaaagattacatgaagaaccatcaaataactgaataactaattttgcctttttatcaaacaccacaacagattttaaccaatgttttctagcaactgctatgaaaaaaaaagaattatatgaagaatatcataatagtcacactagcacaaacttactacttgatgagtgatttcatcttcaatgtaaattatgttgagtataacattgaactaggtttaaaattgcaaaaataacgacagtaatagcatgcagcagcagcaacaacaattgaatagttctttaaggttcttatagaggtacattatacttgtgagatatttatggtacgtacttgataaagctactgggtggtaccatatttttctatgtgaaatttgatacttcataagtaccaaattataccacaaataaactacaaatttaattttgtacctcctaatactgttgaacataagtactataaaaagactatagtttgcaagatctgtactgttgcagacaagaacaatattagtattgctaaaacaatgagtaagtaggtttggactttgaactaggtactatatcaacaaggactacagaaggtcctttagataatactgttggatttgagtgtgagccactttgtttcttgatgaataatgaatttcttgtcacaaaatatttctaaaataaaaataaatggataaatttattcttgcaacaaactgataatcatcatgtgtaattcttgctgataataatcaaaatgcctcactaaataaatgttctgaaaacttaatgtctaaggtttaatactaaattatcttgatttattacactatcagcatgttactggtagtttctaattttgttttagggcattcttttgaaacctataaatcttgttgttttcagtaatactagccacctagtcgcacttcgcgcgactctgagcttcgcataacctgtctgtattagtgggaaatataagcatttctagtttgtttagtaaagtttaagattaatggaaagtgttctctttcaatcatcttattgtcaaagttaaaattttgaattgcttagtttccctggttaactaaaagtgcttggattttcacgcattagaatcaatgtctagaaatgtttatatttgtatataaaatttgaatactaaaaatatttattttctaggaatggagggagtagttacctttagaccctttttagtgattattatgaagaggggtaaaatttaatggaggaaggttgtaaggttgaaattagaaagtatgcgaagaaattaaataggatatgcttgtggttggttgagatgagagagtgggcatagaagtagctgcattttacgataaattttgattgtaaaagataagtatatttaatataatacgaaggagcaataacattaagttgttataacgatttcgtgtacacgtgtttattcatagtgactagtgtgctcatgtgtatatgagctcgtgtgtttgtattatgttttttaaaaaatggtacttcatggtgtatgccaattaggtgccatgtcaaatttggtgtagtgtgttccaatataaaccaaaattatattagagtattttttttaaaagagaaattatattagagtatttgtatatgcatataaactgtgaattgagaatatttgaaaattacatataggcatatatacatatttaggacattccatccacatgtgaccacagaatgtctgggaaattaaagaatgtgatctcatgctaaatttatcacaattcccttattaaggataatcatggcggccaataaattcagaacgaatgtacggctgagctagcttcatttaccttttttttctttatttgataagaagtttaatgtttgtactatgtaaaaaaaaaatctaggtacatgagttatctacttgttgagacctttcatctggaagcctcttgattggcctgatggttttccactcacatataagcctcttaattggtccaacataaattacctatatagatgatcgaacggtgtgttcttttacaagatccatccaacggtccatgttatttagattacgtgtctcatcctccttgcagaaagcttgttgctttcacctagtaagatgttaaataacaatatcaccttgaccagttgaccatactgctgaatatgctcaactctcataaccgagaaccatttgcaatgggcgttacgaatctgtactaatattttctgtcgcagcgcatgttctatacccttgctgcattcagtcgccgtttctatctgcatgtagacttgatagaaattttaacagtgtattatctggacaatataatgcccaggattggtgtagatatagatatactaatgagtctgaaggccagaagttaactatatggtttataaccaaaaatagctcgatatggttttctatagatatctatggttttccgctattgattattgctatgttttttctcaggttcctagttgtaattgatgacatagcaagcatagaaacatggaacagtattagtggtgcatttgtcgaaacgtggaacagcggaagcagaattattacaactacacgaagaaaggatgtagctaatgcctgctgctctagcttccatggcattgtctataagatgaaaccactaggttggacggactccagaagcttatttttcagaagaatatatgggtcagataactacagccctgaacttgaagaactcataattgctattgatattttaaagaaatgtggaggagttccattggctgtagttgtcatagctagtcttttggctagtcaagaagaagttaacaaactggataattggttgaagataaaatactctatggggtttgaactggaaagaaatcctaactctaaatggatgaagcatatccttaaacttagctacaataatttatcttcggatctgaagacgtgctttctatatcttcatatgtatcctgaaaactatgacatcatgaagaaagactcgatgagacaatggatagcagaaggatttattacccaaaaagataaccgagacttagaagatattgctgagagctacttcagtgacctcataaatagaagcctgataaagccagctcagtttaagcatggtgaggttgtctcctgtcgtgttgtgcacaatttgtttcttgatcttattgttgagaagtccacggaggaaaactttgtgactgtaattaggactgatcaagattgcttaagacgacataattttttgattcgccgactcagctaccaatcaaaccgtggtaacttgatccaagcaagtgagtctttacatcaagtccgatccgtcatttattttggggatcggctgcatcagcgtggtgaaagcttgcctcgtcttcagatgtttgaagccttgagggttctacatctgagaatggaaggttattttccattccgtgcaacgtatgatttgtctcctgtatgtaaccttttccaactaaggtatctgaaattggaaggtaatcgtttccagtttcctgatacaagtggggaactgcgatatttgcaagtggttgacataaaatgcagcggtgatctcgtactcatcggtgggtttctgagtgatgcttgtttaccatcattgcggcatctgagaactccatggaatgcagagctcggcagggggattaacaggctgacctctatacgtacacttgaagaaattaacttctgcaattgttctgttgaaaacatccgacatcttgggatgctgaccaatctaaggacgcttggtgtcatctacaatcgccgtcgaggcaacgatgaagatgaccagacagatatggtaaagtttgctgctcttgccacttcccttagggaactgggcagctgcaacgtccgctgtctagatttcaatgttgctctaatggagcacagacaaccacccattggcttcttgtatagctggtttcctcctccgcaattccttcagaagtttcaccctcacatgatattcttcttcagggttccatactggatacaataggttgagactttaactagtttacgtctcattgttgacaaactcgagggcgatgatatgcgtgttctcacaaggttaccctgcctcgcttaccttgacttgcaagcgatcgaggttcctggcatggagattattatagacagtgtatcattttcagctctcaaagaactaaagttgatctataaatcttccagtttgtcgatcgagccaggagcaatgccaaagcttagaattatgcatctcattgtttttggccatgcagagcaagataccaggtctctagttggcattcagcaccttcacaacctcgaagacgtcataatcacatatgattacaataatgtgatggttgcatttagggaagccctcgataggcatccgagggttggttccatccaagtatatataggcgcatctccaaaggcttcccaatcccattcctgagtgaatttcgactatctgttggatatgcttaaggttagggaaactacctcctgcaacaacggtggtagtgtggcacatataggtaattaagaacaaagggctgcttctactgttgtactggaaatgctagagagccaaggagaatggtagtagaaagaaggcacacatatgaaagtgcatatgactattgtgttaacagatatttttgtcttttccttttttattccctcaagtgttttaattgttaaacttgttatctctctatattcataactggccgcactccatcttatctttcccgattctatttacttaagtcaattgagtggagaagggaggtcttgtgactatatgtgccttaaccttgctaattaattaatcctcgtgtttgcgtcaatagttccctcgataatatatatctttacttattataaaagtttaaggtgtttttatctacaaatttcatacgttactgctgatagctcacgatcttttctcgactccgttcctagcaaacaaaagcaatagcacgatttttttttctgtccgactcagttttcagtcgtcattttttttatccgtccgatcatttttttacgcgttttttgtgggcctggtttttttctttctccgcatgtcatttttttcatctgatttttttagtgggtcgcggttttttttggttccgtttttttttcaatctcctccatccgatccgcacgattagagatgtttccgtcgtgcaagggcgaaaaaaaaaggaaagtccgacgtggagaaaaaagtccgtaaaaaaagcccgtaaaaagggcgataaagaaacaaaaagtacccgtaaagaacggcaaaaaaaaaagaaatctgattcttgcgtcattttttttccgttgtttccttttcttcgttagtctatttcttttgctgttttttttccgtgaaaacgcttgtccccgggcgaccggcgcgggtgagcccaatcgggtgctccccccacgcgctctcctccccacatgctactgttggttccactcacttctctcttctttttccacaaaagatgtttcacctagtgtacttataatgttttactatttattgatctagtgttgcagtgaattaaaatactcttttacaacaaaaaaaatccacatattttggaaactctctattaaggaaatttggtttattttttgttccaccaaaaatgtttcacctagtgtactcacaatgtttcactatggatagatctaatgttgcagtgaacgaaacattccattgcaaaaaaaaaaacccacatattttagaaaccccctattaagggaatttggtttattttttgttccaccgaaaaatgtttcacctagtgtacacataatgtttcactatgtatagatctaatgttacagtgaactgaaacattctttcgctatttgctgaaacattgtttttatataaggtgaaacaacacccgatttaaacgagtgaaacattttcgctctacttagtgaaacaattccgatatacctggtggaacatcatgcaacatttaaaaataattcaataataagctaattttttttcaccggaatatatccatgtgtggtcttgttttgaaaatttaattgcaacgaatttaatggtgcaatgggatcatgatttggatatgtaatttaggagaaaaatcattttaaattagtgttgcacgtaaatcggacgcagacgtccgtcatgctgacgtcagcgcccgatttccccggcgccggatcggccgcccgataggtaggcgcgtccttttttccgtcctttttttcccgcctttttttcatccgccttttttttccatctgctggttttttaatttattttccggttttttcaccttttttttcactattattgtattatttcgcatgcggtaaaggatttgttttttatctgccatattttttcgttgctcggccgaaccctagcatcgccgcctcatccatctgtctccccatgcgttccctcttcctgtcttccaagcatagtcgatctatcccccatgcgttccatcttccaattgattgcaaaaatcgatcccccactactcccttgtattcacagaatttaatctccatttaaaagtcaccattcttatcccgagtgaggagataaagtgtatcaaaaaccattaactaattttaaaagatcgagaaaaattcgactggatttgatggggaggatcggttttggcattgcacagacacgagacccttaaccaatattgaaagatcgagaaagattcgacctgatttgatgaccaggaagattcgaccggatttgatagggaggactggttttggcattgtacggacacaagaccctcctccggggatggaagacggcagtccgctatgcgagtgggaccgatgctccactcatgggttgggtcaaagagagacagaccaagcaaagggaggtagcggtccaaaacaaaagagtaaaacgtatagcgatccaaaaatatttttacccattgcaacgcacgggcatttttgctagtatacatatatatatacatatatatatatatacatatatatatatatatacatatatatatacactagcaaaaatgcccgtgcgttgcaacgggcaaaaaaattctaataataatatacatttttcatgcataatcatgttaatgacaatgtttctattttaatgagcggcttgtttgtttacaaacagtatttttttcttgcgtgattttctcaaaccatttttcagaaatggcacatttcttttaaacagttttttcctaccatgtttttttttgctttttttacttatgaagaaaaccatatttttctccttttttttttgcttttcttttctcgtgtgttttttttcttgttttctggcacgtttttttgcttgtttttttcgatggttcttttttgcttttttgcaatacaggagaatatatgacaaaataaagccatgtagtagatggcaaaaaatcgatggatcctatccgactgaagcgtccatcaatttagcttttttctgacagttttttcagggcgatttttttaatagacggtgtttttttcttgcacggtttttaaaaaccatttttttataaatggcgtgttttttcgatagttttttccttgcgcgtctttttatttttatcgacaatggaaataatttttctcgcgcttctttttatttttttattgatgatagagaacatttttagcgtgcttttgcgctttttttttgacttttgcctcacacgttattttaaccgtttttattttctcatgcattttctctttttaaatagttagattagagatagagaagagatatatactggttagaaatcagattttgtttcgccgtttctatttttttctctcttgcattttttattttatatgaaccagctttttattttttgcgaaccaatttttcaccattttcttagggaatcgaacgaattttttagatgtttttttgcctttataggaatcaaactttttttctgtttttaaaggattcggatctagcgttttttttgtcaccacttttttttttttgccttttatatgaatcaaatcttttttccgtcggatctacagtttttttcgccagtaaggaaaaaaaaacttttgttgttatttttttctttattttcttttttgtgcggcttttctttttcttttatgcacctttctgtctttgttctctttctcttttattatttttttaacaaaaacgacatcaagtagcttgttgcaagattatagggacttagatgtaaatataaaaattacagggactcaaaaataaaagtacaaatccaaaaattaaaatcatataaaaatggaatgctctcgacatatagattccgtttttgcaaacagatcttcaatccggcacatcaatttttttcaccaatctaagtcagactttttttttggcttttatttttctttttatgcacctttctgcctttgttctctcacttttattattttttaacaaaaaagacctcaagtagcttattgcaagattatagggactcagatgtaaatataaaaattggactcaaatataaaagtaaaaatccaaaaattaaaatcatataaacatagaatgctctcgacatgtagattccgtttttgcaaacagatcttcaatccggcacatcaattttttttcaccaatctgagtaagacttttttttttggtttgtaagagtgaatctgatataggagtcggacttttttttcactttttttttcactgttacggatataggagtcggactttttttttttgttttttatcggacaaacctggttttttcggtccggtttttttggtttttttcgcctttttttttctggatcggacttcttttttccgttccggtttttttaattggacaaacctggttttttctgcccggtttttttacccggttttttttggacgatggaagcacctcgtattttttaagtagtagagaagagaagagatagagatatatatatatgaccattgggctccccaaattcatctcctaatgtgacatggtcccgtagcacggttaaccctagccatcaaccgagacatcctcaccacgcgccggcaaggtatgaactgcaaccccatcacatccgttggcctaattgatttgtgaagcatcaagcagcagaagcaaatttcatagctcgtcgttgcccacccgtgctcgcccgtcgtgtggacatttttttttcggggtttttttttttcggggggacattgagagctatgaatttatctaattgcaaatttcacattttctataaaatttagaaaatggttttgattattctaaatttttgttttcatattttctatacttctttaaaaagaatccacttccattgcaaattatccattgaacttcttaatattaagaaacaaacaaatctaaatggatagtcacgtataaggttcctatagaaaaagagtgtaacaaatagtcaaaaaaaaaagagaagcagagcagacaggtgggaaaaaaggacaaaagaacactgaaataggagcagacagggagtataacaaaagaaagcagaagcagaatctctagtttcttcctttcttctcactctatctccccacaatgcatggatgggatatggccatccatattttgttagattcgacgattcaatttttttgtttgatttgtatggatatgacgatctaatttcttatttggttggagggatatagcatggatgggaaaagcaataagttagtaggatccatttgtcatatatatatatattttattaaaatataatcatccgaaatcttattttaaaaatttaattgcaacaaacataatgttagaacaagcagaagaaaggctctaaaatttttacatggtaaaaacggcaaccgcccaagaaggatgggccaaatatgcgtgtcgatcacgtcgcttgtaaacctgccgatccagcttcttcaccatgacgacccaatcgccctcaccatcatccgtagtattctccaccaaagagtaagtgcgatgaacgatacgtgctttgcccacctttcccacggaagcagcagcaatggatcagaactcgaaagaagcgaagctccccttccccatggcgcacagaaggttgcccggaacaatgcggcaattggatgccaccaccacccgcagctcaacgatggtcagctccttcttccccgtgacggccgagatccccaccaccatgcggtacaccgcaacgtcggcggcggcggcgacgaagcggtggtcgtcgctgccgagaggcaaggcctggccgtcgaaaggcaggttggtgtcgtgcaccatctcccactgctcggtgtccatgtcgaaggcgcatgtgcccttgtgatcttgctgctgctgctgcggcggctgcaccgacaccgagaggaggatgtgtgagccgacgagggcgtacgccgttacgcgcaccttgggcgggtcgaggaactccagcgggttgaggcggcacgggaagagcggcggcgacggcagctggcgccacacggtgtggctgaggtcgtcgaggacgaaaaaccatggctcgaaatccagctgcctcacgacggccggggtgcgggagagagcgtagagcttgccgccgccaccgccgccgccgccgtcgtccgagatcgagatgaggacggggttcaacttggggaagacgagtcgcgggccgccgcgctccgtggaggcctcggggtcgtagacggtggtcaactccacaccgacgcccacgatgcgtgtccccaccgcggcgaacgacatgccgcggccgcggccgctgccggtgtctgttggttgattttatcggctaatgccggttagttaggatatggttaaaatcctacgggtttttctatcctaataagatacaaactaagagataaatctgttttgtgtgatcggtacaaaatagattcgaattttagattgagataaacccccgagccctaccagtgtcgctatataaagaaagaggagggaggctgtgtaatgactcaactctctctaaccctaaaccctaaataaatcgtccgatcgattaaacactgaaagaggttcgtgaggtatctcacaacagaagaaacaaaaagaagaaagaagaagagcaatggcttcattggcttcatctcacgtcagttagataaattaatttccgcataagcagaaggtgatcatgtttaggctaagactcaattaattaattggattaaatttcaacattgtggtatcagagccttatcttagccttcatgttccctcataatcacatcatccctgtgattagaagccacccttacaaagttcaagattgattcggcatgatgcaattttgaataagattagattaatttccttaagtcttggttgcgtattaagccatgttatgctggttgtctcggccaacagtagaaacacaattaatgaagagtttaatttcgttgcttagtagtagaatttgagagaaagaagaggttcgggataaacaagattgaaattcccaattctcacactaagaattcctagaccgaagctaatctttcggctagcactcagcaaaccaagaaataggggataaactagattgaaattccccactattaagcaaaaggggataaacaagactgaaattttccgaaatccccaataagccagatacaatcggccctaaatccccaaatgaagaaccctaattttttttgggaagaaccctaagtcacaaatacccgaattaaatccaaattcaagtcaaaattaggtttgagttcgggttaattactggatttagaccccctaagcttgccggagctctccggactcctcgaggtcgcgccggttgaccgccgtgtgcgcgccgccttggacctcgtctctccaccgtccctcaccggggtcgggaagcgtcggcttggcggctgccttcgggcctacccccccccccccccccccgccgacgaggtccggccgcatcgacgcttgccgtcgctagcgcgccgccttgtcggaccgccgacgccatagcacacggcttggggccgccctcgggcgcgccccccagccagccgaggtggagccgctgcagcgctcgccgccgcacgcgcgcgccgcctcgccggaacaccgtcgccgccatgatcgccgccgattccactcgcttgctcgccgggagattggatcgggggagagaaggggagaaatggggactagggttagggtttgacccgttcagcgatttcagtggcaaaggcgaaatcttggccatccgtttgatcagacggctgtcctcgctcccgcatcgggccatcgtcttcatgggccgcgccaatctgggccgcgtccacctaagcgccgcgcgcgcacataaatgggccggtccgttttgggccggctttttgataagattgggcctttattttaatttattaagcccgcgaatttaatttctcagaatttatttagccccctttttatgggccggcttaggaagtgatgggccgtattattattttaagcccgccatttatgatttatttatttccagaaattcatttgtgagctttcttagccatttaaattgctggaaagaaattcatggaagtgatgggccgtattattattttaagcccgccatttattattttaagcccgcaatttatggtcaattatttgatcactcaaaaaaaattatttctagttaaatagaaccaacgggaagtttagccagaccaacgttaatatgatttcatgtcaagattattatttccttaagccacttaatttatttctagttgaatggaaatttaactagaaagtatttatgatttcatgtcaacatcattatgatggtcattgccttagtaacttaattatttatagtcgaattgaaccaacgagaaattcgactagaaaacgttaagatctgaatatatatttaacccacattattataaatgcatgtcaattatacttttttttccttaggtattttctaccaaatggtgatataattaaggaattaattttaagattactcataattatttatgaccaatggtgttttgactatgaaattctaagtttattttgcacatgattgattaagccatagtaaactaattatatgcaattatcaatgcttattatttaagatcagttgcaatactgagtaaattatttctagataaatggaaccaacgggaagtttatctagaaagaaatgatttcattaagattgttatttccttaattattgtctacctaacgatgatgtaattaagggaagaaatcaaagtattatcaattattattttctctgtcattttttatttatgccattagtgcattaactccttttatcacttctaccttgcggtgatgtgatcgaggatctaatctatccgtaagcttaattcctttaccatttctgcccaacgctgatatggctaaggattttaattttaattctatggcatcactaatggcatcatttcctaatcatttctaccgtatggtgatttgatttgggattttaaattatttactttatcacttctaccttttggtgatgtgacttaagacattaatgtttattccctaatcatttctgcccaacggtgacttgattttcgattataagtaatctcatctattaattccttcgttttttctctg

SEQ ID NO: 70311 - DNA, 9627 bp, Oryza sativa
gtaagacgtcattgaaattgtgccattgtcgcttatgtcacatacctaggggagtttgaaacgtctcatgagatagagatattctttcccttaaattttaatggcgttgtttagctttaagtgtaaatttcacaaagttaagatattagccaacaaatgattttttatggctatgtttacccattagcgacctccgatttcctttaagaaatttaagacactaaagctaaaatcaaatgaagttatgagatcggattatggtggtaaacactaaataaagcttgttcaccttataagacattaaaaataagcattcatccaaatggttttcgaaccatgtaagaacaaattgagatggatgaacaaaataagacattaaagtgttcatctaaatggttttcgaaccatgtaaggataattgagattgatgaataaaataaagaatttagtagaagtttctaaatgagtcaaaatagtgggccatttaagtgggttaatgaaattaagcccgactctgatggaaatttcgaacaatccaagtgaggtggacagctgcatgaaaattaaaggtgggaaatttcacaccggtactccatactaatgacattttattgtcaagcaatacatattgctgttagaaattaaaggaaatttttccatgaattattttggtctgaaggagtactaggtttatatcattaagtcatatattgacataaagaaataattccagagaattcagttaaagattagtcaagctgaaattaagttataaagataatcatttatgattcagctgacagaagcttgagattagctcaaatctggatgcatacagatttggcatacattttactgggaatcgtggcagtattaattaaatccagactagaccactggtattaagaatgttttgtattatttgcaaggcaatcttaagtaatatgctcatatttctaaagtccaatgatctcagaagtttagagacatttggacacttattttgtaagatgtgtggatatttataaagattatttagattaagctatatccacacgtaggggagcaataaccatggaaaagctccaaaataatctcttactgcatagtcgacgatgcagttagattttaaagcatgttatgattaatcatatatataagaatatttctcagaactaagagtggtaaatagcgcttataaaccactcaaaaaggtgtaaaccactcaattatactgtgttataagttgtgcactaattgaacacggttttctattctactagcaacatgttatgtgttttttgcctaacacattgatatagttgtgaaagatatgtcccaggatcgaattattattaagccaagcttttgctcatggatctatactctaaaggctcataaagttaagattaattaagatatgttctggctagtacatgcataaataagagcctcactaagatcctggatgagggggacttaatttttcaatcaacacccactaagttaagcttgagtttatttgggtactatagtgaagtataggtcttgttgtctcggtgacgcataatgttgttgaagacacattgccttggggagctattttatttgataaactcgtcagttagtctcaaaatcaaggggagaatgttggttgattttatcggctaatgccggttagttaggataaggttaaaatcccaccggttttcctatcctaacaagaaacaaactaagagataaatctgttttgtgtgatcgatacaaaatagattcgaattttagattgagataaacccccgagccccaccaatgtcgctatataaagaaagagaaggagggaggctgtgtgacgactcaactctctccaaccctaaaccctaaatcaatcgcccgatcgattagacactggaaggggttcatgaggtatctcacaacagaagaaacaaagaagaagaaagaagaagagcaatgacatcattggcttcatctcaggtcaattagataaattaattttcgcataagcagaaggtgatcatgtttaggctaagactcaattaattaattggattaaattccaacagtgtcaagcaggcagcgggcggcagcgctggcggcgacctcgattacggagtgggtgggctcatcctcgactcggccgtgcgccaacaccatgtacaccggtggctgcggctgcttgtcgggtgaggaggccaccttcctcttcttcctgttccctgtacgaacgcgcacgagacgaggtaccggcgccggcgttggctccggtgccgcgagtttgttcctcctcttcttgtccggcgtcaccatcttcttccctcgattggattcggattcacttctctctattactacgtatcaaagacttctctctattactacgtatcaaacacgtgatgaaaggaagccctatccctagtgggggttgctttcgtcggccggaggacagcatgggcctagccgagactgggccaaatgttactactacttgagactggaccaccaagacagtccaacatgcgtctcgcctgctaaactccccgttttttttcctttttggaacattcgcttgcaagtgcaacaggcgattgatagttggcttcctagctggcgcgtgcgcgcggcctgagggtgggttttctttttttctttctgttgtttttttcactttcggattttcattttttctgtggttttttttaatcgcgtatgccggtggatttttttccgtggtattttttccgacgagtatatctaacataactaacatgttagttttagataacgacggcaattaaaataagacatttttctagaagatcttttaagtaacagaatgaaaaaaaatctatacgtgaagttaaattttgaaaacttttaatctagatttaaaaacttttcaacttgaaatttgaatttttgaagccaaaatttgaaaactttcaacttttcatctcaaatttgaaaaaactttcaactagggtttaaaaactttcaactcgagatttgaaaactttcaactcgagattttgaaaactttcaactcgggtttgaaaactttcaactcgggattaaaaactttcaattcgagatttaaaaatttttaagttaagatttgaaaattttcaagtcaatatttaaaaactttcaacacaaaacattttgaaaaacatgtgttgttggaagattaaaaaagtaatcagaaaaaagcggaaaaaaaaggaaagcgaaaaaatcacagaaaaaagaaagcgaaataaatatttaaaaagtaatcgaaaaaagtgaaaaaaggaaaggaaaaaaatcatggcaaaaaagaaagcaaaaaaaaagaacgtggtccgcacgcatgctcgccggcgctgggccttctaggcccgaaacgcgcaccggtggcgcgcgcacgaattagctatcgcgttgatagcatgttgcgttcttttttcaggttttttggcatgttcactactacataatcgaggacaatttcccctccaaattacacgttggccatagctgttcgcgcatgcaaaaaagttaacccgagataaatcaaaggcttcttaaggggctgcaagcgaaaaactaattttgcatgcgggcaatgtggagagcaagtgggaaatagattttttttctacaccttttttctcttacgcctcctttccactacacctatttctcttctccagaaccatcgttcgctgcttcccctttctcctctcctcatgtcttcctcttccctctctcactccctcgctcatctcctcccttcctctcccatggtggcggccggctcttagggtggcagaggtggcggtcaacaagcgcagcgaatctggcaacgactctcgccgggaagggtggatccgccatcggcgggctcagaaggacggatccgccctcacttgcagcgggtgcaagccgtgacctcaggagtggccaacgacctctttcctctagtgctggtgaactcagcagcaacggatctagcggtggggagctcggcagcagcagatctggcgctagggagctcggcgacggtgaatctgacgggttctccccctttgtgcgcacatggatctggcggcaaggagggtgttggcaatagcgagggcgtccacgcttacctcctcaaggccgtgaagtacaacaactgaaccggtgtgctccttttcgacgtctttgtcttcgagccgccaaccgagacttcgtctaatgcgtgatgccgtgcagttcctctagcgacagcgacccccgtgagacatggatgtgggaactagaggcccgctcgacggttgccaaggcaggggagacggatttgtgcaccaaccgcagtcgattgaggatggcagcgatggccgctgagcacgggagctgcttgctattgtagcctacccatatcccttcacatttgtcatgaaaacacgactatcacaaaccgcagccgcgcctcccgctgtacctctcctccccgcggtgctgtcgttgcctacacaacgccaccgatgtttgtcattctgccaatgccaagggtcgtctctccgctctagatcgattagatatgattagtttgccgattggattgaagatgaatcatgaattactgaaatatccttttacatttggtggcaaattccaaacgtgccctcattcataagtatatactactagtatattgcactgtaaaagttcccctttctttattgctcatttttgtttgttcactatgtaaccatctaccataagcatcttacaacgtttattgaaactaagaacataaggtcagaggcttagagctggaaggtgcgtggtcgactaatcaatagtattgcctattttctgctagctcagcatttgctgtcctagatttgggactcctaattagcaatacgttgtaccggttgatcaaccagctattctatgttgaagaggcgtacgtgaaagcatctcccacttgtgttataggccagaagattctcctcccttgaggatgatcttatgcttaattcagcaagggatggaatttgacttccatccgtaactatttctttattgcagatttgcagaggcacaagagcgtgccagtttctattattaataggaagaagaatcactctcctttcgatgttaaagacgtgagttgattaaattaaatttctaaagttaaataagtttatgatattacttttcaaggtattaaatctacctgtaccatctctttatctaaaacatttgtgaaattatttatgatcaacgtttcaaaagtctaatcgaataatataattaaaacatcaaatattttatgacggataatattgcatggcacatacactactagaaaaataatttttttaagtaacgttggccttttatttttccaggcgggtatgaccattggagccaaatgaccgcctacaaaaatgtaaacccggttgaaactcgcagtccgcctgtgaaaatctattttcacaggcggaacatttaagcggtgtgcctgcaaaaataccctttatttttgcaggcggaccgatgccctttatttttgcaggcagaccgcttaagtggtctgcccatgaaaatcgacatggatataaatagacaccacatcacatcgattttttctaagtgtcacaggctcacagctctcctctccctcaggcctcaccactcctctcccttagctccctcagcatggcgatgggaggcggcggggttggcaatggcgaggcgtggaggcggcggggtcaacggcggcaacggcgaggcgacagggtcggcgcggctcccctcccctctctcccagatctagcccaagggggggaggagggaggagagattgtggtggcggcggtcccccctccctcccagatcaggccagagggagggcggcagcggcagcgacagtccccctccctcccagatccggctggaggaggccaggagagggcggcggcggcggcgacatgccccgtccctcccagatctaggcggagggaggctgggggaggacggcagcggcggcggcagttcccctctctcacagatctggtcggagggagggcgagggtggtggcagcagcggaggtgggtgtagcgcccgttccgtcgtggcgcctagcgggaaaactatctcttaaaaaccctatttgcgaatccgtttctttgcttgttgtctagtgtccgtgccatctcagatctcaaatccccgatctatcgtcaagttcaatcccgaatccaaatccttcccaaatcaaatccctccgcaaaagtctatttagcctccctcgagttcgatgggccgaatccctctcggcccatctccccctccctccccgtctctctctctctctctatccctctctctctctctccccgctctgcccgtgagccacgttgagctctccctctccactctcgcggccgttcccgccgatgccgcccaaatcgccgcgccgcccgcgcgtgcgcgcgccgtggtggccgaccggccagtcgccgccgccgtcagcgcctgccgcgcctgccccgcgtctgccgcccgtgtcgccgctccactccaaaccgccccgccgtcatcgccgtcgtcatcgactcggctccgcctctccccgtgcgtgcctccaagggacggaggcagagctcccccccctctgccgcgtcgccctctctccctcctccttttcctcaaagcggcaaggaggcaagccctctttctctccccctttttcccttttgcctcccgccggcgtcatcctccccccctcctgtcgccgttttggctgcgagcgccgagcgccagctcgctcccttgactgcccaaggtcggtttccaaaccgacatcgccgccctataaacccaagcgcctcccttcctctttcccctcccaatcttccccgtttctcgcccgcgccattgctgtctctctcgccggccaccgccgtcgcgtgtgccggaggagttggtgcgcgttaggacgcggaaggggactccaggcactcgtcttcttcctctcccccagcccgaggccggagagatcgctcccgtgccgtcggcccatcgtcactgcgccccatcacccccgcacggtagtgcctccctccgttctctctcctcgttccatctcctccccttagactcgggtagtagcacgagtagccccccgtagctagccggcgccgccccgactgctgccgtcgctcgccgtgtgctcgccgcagtcgccgcccgagctcggaagcgcctcttgtcgccggcctccctcgatgcgattcctcctaatccggcgcaaggggtgggttcccgtagccgcgttgatgctctcgccgccgggaatcggcccctcgtgacctcatcgccgtttcccccttctcccgctgtcggttgccgccgccgcaatccgccgccgtcgagcatcccccggcgaatccgagccattggctcgtctcccctcgtcctgtgcaacatcccggtgtgctcgccttcgcctgtatcgccatggttcgctccgccgcttgccgctgtcgtccgctatccgttccggccggcgtcgtcgtctacctcccgccggcccgcgtggcagccacgtaggcgccacgtcggcaccacctcggccgcgaccgggtcaagcagaccccggtccgccgcttccctccgccccctcgcgcgtgcggtccaccgcgagccgagaggctgcgcgtgggcccgccgcaccacgtcctccgcgaaccgcgcgcatgcgccgcgcctctctccccaaaccctagcacgccccgcgtgcacctcgctcacggtgagccgagtcgccgacaagcgggtcccacacgggaccacgcgggatggacccggcctaccggctctctctctcccctcccagcccgcatgtgcgccttgggccgccttcttgggccagccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccaatattcttagaaattcaatatcttcccaaccgtaaatccgtttgactccattcaacttccaaaattcctcaaatctcgagatctatctaatggcacgcttagaggtcaataatagggatttaatttcgccgtttgctgagttgtcccatttcgcgtgtagtttcggagcccgaagacccgcagtgcgaggatttcgaggatcaagctcaagatctcgagcgaggcaagccacctttgaacatcttgagcctatattcgaacttaattatgttgcttgaaaaatattatgcattgataggatcgcacttagtctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcaccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccagggtggtgtcggggaggacccctgggcttcctggcacagtatggtctgggacctaatctggtgttggtctgggacccctctcgttggcatatggtgaacctatgtcggctttcgaaatgccttgtcatgaaagccttaaggtctctagtcgtggccgttctgcacgggctggatgatctgggttagtaatatcgtgtgggtaaagtgtaccccctctgtagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggccccgggtggccgtttgaaagctgttggccgggtgccaatcttgatcaatttaaaagactgaaacattgcacatactccgaccggacgagacgcactgtctcatccgtgtcgtttgagaagcactcccttagttgtttcagaaaagagtttaaataaaatcaatcgcaaaaaaaaaatagcggcctttccttgaagcctgcattaaacacttatttcccatggcttgctgagtactcctgtactcacccttactctatataaataatcccccctcagttgctgaagaagacgaagcggatcccgctgacgaggagttcttccaggagcaagccggctacgatgagttttagggtttcggcctagttcccaagtcgcgcctgtgatgtttggtccaagtcttggcttccgcttccctttt

SEQ ID NO: 70312 - DNA, 56453 bp, Oryza sativa
  unsure (1)..(56453): unsure at all n locations
atttgtaatgcattcggatatggccgatttaggatttgaggatttgaggataatttatttgggattttgggatggggatggagtgataacaatatattaaaaacacaatgaagaaaagaaaataataatagagcaactggatctagctagtctagctctatctttagtcccggttggtaacaccaaccgggactaaaaaggctctatctttagtctttttactcccggttttttcatccgggactaaagatcgctatgtttagtcccagattcgtagtcccggttaaaaaaccgggactataggggggttacgaaccgggagtaaaaaccccttcttcaccagtggttactttcggctaatttgtctatatacagtatatgtgtttttaacaggatatgtgcgtataaattgtactaagatagtgtttgaatcttctgaagatgaagatgaagataaaaattaagtatttcacgcaaaaacgatgtggtaataatgtgtgattaattgagttttaattattacaaacttaaaaaataaattaattgatcaaatattttagagcaacttttatatagaaagttttcgtacgaaatgcatcatttagccgtttaaaaaatatgccatgagtatccaaaatttcatccaactcttgttggagaaacgtacacaacctaagtcatattgattctcttccgcttaatttaacagttggctttactggattgattttgtactacgaacgattataatctctcgatcctttgaatatcttagctaaccatgtcgtcggctacggctagcccccattttctgatttatatgattccgtgtccattttacttagcgtattggtgcgacgtacgtacggtccattttacactagatttcacctaatttagattcatgcttgatagtacgttcttacttagggcattcccaacccaagataatagacgtagttttcataaactccacatcattaaaaaactagtactagacaatactcttctaatgcaaacactactattccatacttaaatttaatgctacttatctcatcttggatgttgtgtagaaaccttgtctcatacaagacatggtttccttctatttcctcatttattcgcttgccacatcatttttcatcctaggtggcagtttatttaatgctatggacaccatcctagtcattggatcgagaatgccccttagcatatgctccgtactccaatacaattattttctacttttacgaactctgattcaatgattatataaaatgaacttattttcgataaatgagcggaacaaaaataaatttattatgggatagaggaagtactacctccgtcccaaaatatagctatttttagcacagtactttgtcccaaaatgaagctatttttctacctaccttctcctctcaaccaatcacaaccattctttttcaactactttctcttttcaaccaatcacacgccttcttaaatcattctcatatactttcttaatacccgtgccaacttaaaaaatgcttatattttgggacggatgaagtagctagcagtaaaatgcacgtgcatacgcacgctcgtcctagcaattaatttgggtgtagctttactactgtagtttaggtttagactgttcaattcaacaatggctgcggtaggccgtaacgtccggatcgatcgatcgatgtcgtcgtcgtcgtcgtcgtcgtctagtacataaacacacagtgtcgttgtgtctctgctcgatcaatccgtgtaccgttagatccaaatcgatcacatctgcaaacgaaaacaaacacacatctactgcacatatactatgctaatacatggaggaggagaatcacaaactagccactacattaatttttccccgatttgtagtatagccatattatacttaggtgaacatcaattcaatattcatgcacatgtacgtcgtggtatgcgtgcaggcatacgattagttaaactaagtgtttccccgctctttgctgcggaaatttctatgtaacttttaatatgttttagtaatcgggctaaaagtaaaaattatattagttattaacaacaaataatgtcaaactatatttagatagaaatacatttaatagactctgtatgagattataggtgaaatatgatatcccgtactttgattatatggatgaatatatgttaaggattataaaaatgatggatatatatacatgttatttattgtgaaaaataatgtgaaggaagatgattggatgttgatttgtagaattcaatgaattatagatgatgttgcatgcttgcataagttttgcatgtaattattgctagtggatgatgatgatgaggacatcctccactattacccgctggcagagacgtaaaagtcgggcggcgaccatgtgagcctctggtaatcccaccttgcttagcttgggaggaggaagccatcttaaaagggagagccacccttctcctgttgtcttttagggagattgggcctttcctcaagtgggtgtgcctaagaactgttggggtccggacaaccttaagttattgggcctcggccgaccccacctaggctggattgttatcatttggtatcagagcttgggcccttgttaagaggttgggaatgatgaggacatcctccactattacctgctggcagagacgcaaaagtcgggctgcgaccgtgtgagcctctgataatcccaccttgcttagcttgggaggaggaagccaccttaaaagggagagccacccttcccctattggactagtcttttagggatattgggcctttccccgagtgggtgtgcctaagaactgttgggtccgggcaaccttaagttattgggcctcggccgaccccacctgggccggattgttatcatttgaggtggcatgtttgcatgttgagctttagaattagtgggttataactttatactagtaagagcaagtataatagtgagctataagcctactataagcttatgtgcctactataagcttatgtggaggagagatgtgacaaaaagttaagagtgttggctctcgtgcaagagccagcttagcacaagcttctagacaaatacaattaatgtataagtgacaaatagagagaggagaagaaaattgtagtcaaccttatagctaatctattatatgtgttggctttaagattggctaatagtagaaagtgagctttgttattatccttgctctaagataggattagtagtaggtgatgatgcattaaactcctgctcttttatgattaagatgcatattcagatattctacctcgatcagctaaatggtgcataacatacggaagctattaatataaagttgctctaaaaatcaaataaactcctttcaaatttatagtaatgattatattttaattaatcattatcttacttaatccttttttttcaggtttgaaccagggccctgtttggttccatgggctaattattagcctgaccttttagccataaattagtccccaaggatccaaacttgtgggctaatttgaggctaaagtgaattaacctctctcaaaacattagcccctccaagaggttctaatgtgactaattttgtatggggaccataaaaaagcagctctctctccccctctctcctctttttctactctcttttcaccttttagccttgaattagtcaatgaatccaaacatgccacctaggtctatgggtgcgctcgttcccgcgggcaactactcccgccacctcgtttttcgcgcgcatgcttcctaagctgttaaacgttgtgttttttaaaaaagtttatatataaaagttacttaaaaaattcatattgatccattttttttaaaaaaaattagttaatacttaattaatcacgtgctaatggcctgcttcgttttatgtgtcggagggattattccccgcccctcactctcgatcgggcctatatatacatgcccggacacatacgtggttgatccaccccagttccctctcgtgttagcccaactcgtatgccatcgaggctcctccttgtattgttgtatgtagtggtggtaatgtgtcataaactctttcacatacctgtttagatccctgacaaaaattttcatcctgtcacatcaaatatttaaatatatgcacagggtattaaatataaacgagaagaataactaattacacaaattgcatgtaatttgcgagacgaatcttttcagcccaattgctccatgatctgacaatgtggtgcgctgctaaaaaacatttgctaatgacggattaattaggcttaataaattcacctcgtagttaacaggcggattatataatttgttttgttattagtttacgtttaatacttcaaacacagcctaaatatttttagctgaaaaatgcactaatttttaatccaactccttttttgacaaaaagttagatctatttttgtactccctccatcccaaaataagtgcagccatagttttccgcgcccaactttgaccattcgtcttatttgaattttttttgaaaaaaattaaaaacataagtcgcgagtaaagtattattcatgttttatcatcttataacaacaaaaaagctaattataaaaaaatttcaaataaaacggacgatcaaagttggacgcggaaactcatggctgcacttactacctccgtcccaaaataagtgcagccgtggatatccgtacccaacgtttgaccgtttatcttatttgaaaaatttatgaaaaatttaaaaatatttagtcacacataaagtactattcatattttatcatctcatagcaataaaaatactaatcataaaaaaatttcaaataagacgaacggtcaaacgttgaacgtgaatagtgcaaaactgtactccctccgtactcgtaaagaaagtcgtttaagacagcgacacggtctctaaaatacaactttgtcttcttgtttctataaaaatatttattaaaaagtgatatatttatacttttatgaaaatatttttcaagacaaatctattcatataacttttacattttcaaactcaacaacttaagagttattgataatttatattcccaaggtttgacttaaacattgtcctaaacgactttctttacgagtatagagggagtacttattttgggacggagggagtacaacgtaggaggatgaggagcaggattgcaacaagtggaccggcaggacaagcaaccccgttgaaaaagaggagcaaagaaaaccactcagtcagtgccaggtggggcccacagcccaacaggtgacccgacccgacccgatcgaatcctgcaaacccgatctttattcctctcctccccgagagagacgagacgggcccgcatcacggccgtccacgtcccgtcggccccgtccagtctgggccgtccacgtggccccaccaccccacccccccacacgtgtggcctcgtaacccccgcacagcacacaccgacgcgacgggtccgcgcctttcctttcccgccatgctacgcgacaacaagataacggcgccgtttagagtggagtactggttcactgtacagtaaagcataggagaggcggagatttacgttgacggcgttaggtgggggtggtgtgtgcgtggcagctcggtcggaaaaagctggcgcctgagcgtgtgtgcgtgcgcggggtcttgtcagtctgtgggacccacacaccttttgtcgcctttcgccgggtcgtctcggtcggtgcccgtaacggtcgccccctctccgttcctggagactgtagactgtactgtacactggagttgtatttgagtcacagtaatgattattttaatcttcacaagatcttttactactccaaggagaaaagaagaaaacacaagagaaaaacggctggattttttaaaattttttggtattttcaaaaatttattttataaataggcattcaaaaaatttattccataaataaaccctttttcatggtgtcaaacgtgacagcgccaaccacgtcaaccacgttaacattgttcccctattctctcagtggaaactaaatcactagtatgaaagtggtcagtatcaataacttcaacatgaatgaccttttttttttcagaaacatgaagaacgtatttataatattttctagaaagagtctatttacaataatcaaaagccactacactaataacgctggtgtcgtcaaaataatccacaatttaaataagtttttttttgagatctactccctttgccaaaaaaaaaaacttaattctggatttaaacctggacacacgattagatttttttttaacgaagagagtactatttataaaataagttttttttagaaaatatataatgtaaaaaagtgcagagaggcaataaatgagggcaagaagaggggagagaagaaaaggatcccatcggatggcctaattagccaaggaaaaagctaaattttaaattttcaaacttaattttgagatattttcaacgtattttcttttataattttggcttttaagtcaccaaaaaatatttataaaagtttcatttacaaattcatttttattttctaataagccgttttggcttattaggaaataagccaaacaataggaccaaagagagggcaaagagaggggaggggggaaaacagttgaggggaaaggagggagcaagttgctttgctgtctccctgacacccgcaataatagagatactcctactgctactaggggccagtggcgtgttgcagcgcaggaacctaacctctgcccatttagccctgtcaaatctttaaccaaaagtactgtacactggcctagctagccaccaccacccacgcccctgctgtaggtgtacacacatccatcttctcatctcatctatccatgccacatagtactactggtaggggtaacaaccacccatcacaccagcatgactgtatacgtgacataaattgttccttgtgttgtgccatttttctctcctctccctttctttttctttctacttttttctttctaaagtatataaacctaatattccatacaaaacatcggtatcatgaatctatacgagaggcatctactcctatgagaaacatattatccctccgtttcaaaatgtttgcaccgttgactttttagcacatgtttgaccgttcatcttattcaaaaaaaaattatgaaatatgtaaaactatatgtgtaaatgaaagtatatttaacaatgaatcaaatgacatgaaaagaataaataattacttaaattttttgaataagacgaatagtcaaacacgtactaaaaagtcaatagtgtcaaacattttaaagggagggagtattatcgtgaatatgaacatgagtattatgatatgttacgctctatactagtagagtatatctagggacggagggaatactcctacttcctctgtctaaaaaaaaccttaatctaggaagagagatgactcactcagtcactcgtattaagggatatgactctcgtattattttgattagttgtactatgagagatcatattctcgtatgggttaagattttttttgatagagggcgtaggccgagtttagttctaaattttttcttcaaacttctaactttttcatcacatcaaaactttcctacactcatcaactttcaacttttccgttatatcattctaattttaaccaaacttttaattttcacgtaaactaaacacacctgtactctcttctctttacctgccaaaagactgctcctccttgctttcttcatcacacatggagtgataccagtacacttttgctcctctttaattacttctgtcttttgcgatcgccggccatgaataccggggatttggtcctgaaattgaatactcccacttcttcatctcttgtattctgtgattgggtgtgccatgcatgcatgcgaatgcatggtatgggtacggtgaaataatgtagaccaatcacaactgtggtacaagaggagattgtgttgtgtgttagcctgcaccttttccctgaccccaaagctactggttgctgtatatggaaacgctctctcatggtatcttgcttgtttttgcgcgtcccttcccctcacttgcactggtgttagcacaaccaccgcaacttgttgctctctctctctctctctactcatttgacatgtactactaattccaaatgttttctaattaaagccgagtttagttctaaattttttcttcaaactttcaacttttccatcacatcaaaactttcctacacacacaaacttccaatttttccgtcatatcgttccaatttcaaccatgaagttgcatttatccttctagtgggttttggtgattaatgatgaataaggttaagggactaatgtgtttattgagatactcaggtaattagtcccgaggtgatcttaggtgatcaagaaatgcttggagaccccccctacaaacttcatttatgcggatttgaagctcgaaggtcaataagatagtttattttttgaaatcgagttttaggaaaatccgtactattaagaggggttccaagtggggttctgagatataaaaagtgatcttagtgggttcctaatgatagaatatttttgggagccatttttgcaaatgggtccagaccggacagagaaggctggctggaagttccgttctctggacctggaacttccggaccctgcactggatgaattttgcctaagtgttggccggaagttccgagggtcaggaacttccggacttcctccagttcaaaaatgtgagtaacggcgaggtgacgtcacctagccgttatatatatccagatcgcacccagctcaccttttggctattccactttagttttttcatcccctacggttgttctagcctctcccaagatcccttggctttctccactcaaaatttagagcatttcttgtgagattgtgagaatagatgagagtgtaggagtgatttggagaagctttgaagactaggtgtggttgagcactttggatatcttgtgggctatcacttggggcttattactcttggagatcttctcctagatggataggtgtcgcccgcgagcttctaaaatcttgtggatgtcccgggaaagtttgtgaaggttttcctcacctccacaaggaaacgaggtaagtgattaaggattcttgtgctgagtttttagaggttctcctagttagagcaacttgcacttgtggtcttttctagaaggatttgtgagttggatcttggtgatcactcaaattctagaaaatgacctaggagtgttgaattgaaagccttggacttcttctgggttctttgcacaagtaaggcaaggggttaattgagatccggctctttggagcacctcaatggagagtaggatttcaagatctgaacttcggtaaaaaatagcccttgtcttttctgtgataattctgtgcacgatgctgtgattgtgtatctgctctgttttcctatagtttatttcgtgcaatttagtttaagtgtctgctagggttacaggtttttttgttgctcggaagttccgatgtttagaacttcggaagttccggacagtctgagcagatcggaagttccggtgttccacacccggaagttctggtcctgctgaattttatcgctgcgatttgtttgtgaatttcaggaaagcctattcacccccctctaggctacatctttgcgcgttcaaaccaaacttccaattttggtgtgaactaaacacagcctaaacacaagcccctgttggatttagattatttaagtaaattattatcatgattatctacttgactttagggataaattgaatattctttttttttaaaaaataaatagattaaaataactaataagtggttcaagtaatacaataaaaacaacattgtgagaaaatgtattttctgaagcgcagagaatccatttcaataatccaatgaataatttaagagaacattttataaaactatggatactttaactaaactattaaaaaaatagatttaagatgttgtatcaaaagactatagatttaacatcagtttatcattaaattatagatttatagctaagtatcataaaactacagatttaatgttgaagttatcacaaaactatagttttttttagtttaaatctcttgtagtaccgttatattgaagtataaacgttatagttttgtgattaaattaacattaaatatatagttttatgataaatttggtattcaatttgtagttttgtggcacttaatcataaataagtaattttgtgataaaaatggcgttaattctgtagtttcatgatggaacatattaaatctataattttgttatagtttgattgaaatatatgtactcttaatgaaaagaacgagacttaaggctgtgttcggcctgttcccaactcatctccctcgtgttcgcactctttttaaattactgaacggtgtgttttttttaaaaagtttatacacgaaagttgcttaaaaatcatattgatctatttttttaaaaaatagctaatatttaattaatcacgtataaaagactgttccgttttctgtacgtagagatgtgtttccaacctacaacaacgaacacagatatagtaactagtacacttttaccgtttagaagttaattttaaactttttcttaaaacttcacgctgatttagcacaagaaaacaaattctacactgcatctacacatctagtacactcagtgacagagggttggtttagtttgtggtctaaataggccttactaaattttgtcagtgccaaattttggcaagttttggcatgactaattttggtaaggtaaagttgtgtttggattgaagtcaaaatagcctaagttcactattgaaatgacctattttcttaggtatgccaaaatttgccttcaaaccaaataaacactaaacagtattaaaattaccaaatattggtaagtctaatttaggcatcaaaccaaaccagcccacagttttggtgatgcttcattgaagggggccaggccgccaggtactccagtacacagtcgcacaaagggcggccatgggcgtttcggggattccagatggagatgacaggagaaaggaaaaaatcactccacttcagccagccaggatatcatcaactgtttagataaaattacgtggaggagaggtaaaaaaaaatcaaaggtgttagctctcacgcaaaagctaacttaacacaagctccaagacaaaaataataaatgtataagtgagagatagagataggagaagaaaaattgtagccaaacttataactaatctattatatgtgttagctttaagatgggctaatactccctccgtttcaaaatgtttgacaccattaactttttagcacatgtttgaccgttcgtcttattcaaaaacttttgtgagatatgtaaaattatatgcctacataaaaatatatttaacaatgaatcaaatgataggaaaagaattaataattaattaaattttttgaataagacgaaaagttaaacatgtgataaaaagtcaatagcgtcaaacgttttaaaacggagggagcagttgatagtgacctctactattatccttgctcttactggagttccttgaaatcttttactactactccagctatgctagtactctcagggtgagtttgaggagagggggattgagaagattgggaaatacgcaaaacgagatgagccattagcacataattaattgagtattaactattttaaattttaaaaatagattaatataattttttaaagcaactttcctatagaaaatttttgcaaaaaatacaccgtttagtagtttgggaagcgtgcgcgtggaatacgatgtccttttctcacccaatcccccagaaactcatcacaacgaacgcagccctagtctcctactagggacgccagccagagggctattgctagctccatgcaagatgatgattgctacctacaatggctacaaccccaaattcacccaaaaggatatcgttgccgatgaagcacttgtggtaaacaaacaccaatggatcgatgcgtgtggaaatatatatatattttaaaaaaaatcagattatgctgcggcatcataacggtcagtagtagtaggaggaggaggaggaggaggagtagggcctattcactttgatgccattttcaaccatatcatttttagtaagttgctaaaaaaatatctatgtttagtttgttgtcaaatttggtcaatacataagaaatcttgctaaaattttaacaatattgctatcttgctaaaaatttagcattgccaaaacttggtaaagtttattttgactacaatctgaacaggcccgtagtatcatgtggacttgaataaaatgaaagaggcaaacatggcaataatactcccttcaattagaaatatttggtattcaagaagaaaattcgggtaaactattgcaactttgatcataccttatataccataagtaaatttaaaaaattatacgtagtatgaggcaataatactatctcttgacactgttgtagtgcacctagcgacacgaaacgttaattattgaatgtaagtgttgttgtaaatgctttcaagggaaatctatgtatactctttttctagtatggccttgagatctgcctctctgtcgattgggcagtgagtggcgggaaaataagcaattctttttctccaatacctttcctctgctcccctccatctttggtagccaccacctacacgacgtgggggtgggggggtgtgtttttgcggaattattatgttatcattgggtttgtcttattgtatgctgactttatcccgtacgagtagttattttctttatagatcaaatgaaatgctaacgtccgtcttctttgtcctgatgctacctttcatgtccatattaagctttgaatcagcgggaccttgcttcaccttatcttgtctggatgattgctgtgggttcttcggctcttcgctattgttaatgtgcaagatctaccctatgatgtgaggttttctcccttcacaatgacaaggtggtgatgaccatccatatccacttcggcgagtttgctgtttctaacttggtgcctttttttcctttgacggagcatcttcaaggttaaactgacatttctcttttcatcaggtcagcttcaacctccacttttgagaatcccctgttgggggtttgtggttaggtactaccttctctagtgaacctcactttcaccatcgtcaccgtcggctttatcatcttggtcaacggatcataagaagagaatcatattaggggttggattgcctcttcattttattttggaaccctttctaacttatcttaaggatctcaatgtaatttgccattctctgaggccggtcctattgtagattatgctgaatgtctacattctttcctactctggccaacattaggctctctcgttttttttgggtgaaagcggcaaggctctcttttttttttctcaccagaattgtgttcattaacttcctgtattggataaatacatgggtcttaatttttttcaaaagtttaactgagttttttaactttaaatatttataacgggaggaaatactactagctagtgtagaacgattatcaattgcaggattagaaaggtatactaaaagtacagacagaatgtgaaatccatcatcaaacctaacagaatcccacatccatttctaggaaagagagtatcagaacctgtaaaaatcaccaccgataaaaaaagaaaaaaaaatatgccgattggatttgtaaaatagcaacggaatggaatcatttagatcgcaggaaagagaaagagacacaccaatgaacggagtgccagggagcaagtggggacatttgggcacgatttaggcagacatttttgacccccgaaaaggcaaaagatgcccccaaaaaggttaatgcgaattttaatgacgttttaagcaccgattattacatcgcccagagaaagagagatggtgtacgtggcgccgcacatgtccaaaatctccaacattaaggaccggtttggtttgaaacctaaattggacttaccaatatttggcaatttcaacagtgtttagtgtctatttggtttgaaaccaaattttgacatgcctaagaaaatagaccatttcaatagttaacttgggctattttggtttcaatccaaacacaactttgccttgccaaaattagctatgccaaaacttgccaaaatttggcatcgacaaaaaatggtaaggccaatttaggtcacaaactaaaccagccctaaattttcaaaaaggctccaattaattttcagtattccaatgttgaggtataaaaaagatgacaccaacaacattgcgtatagttaaatctcaaaatcttttatcattaataaagtaaagaattattatgatttaatatatgaaaatgacattagtagatttataaactttataactgtataattaaaaaataataatgcattggagattatgtcaatattcaaaacaacaactaaatattccctccgtttcaaaatgtttgacaccgttgactttttagtacgtgtttgaccattcgtcttattcaaaaaatttaagtaattatttattctttttatatcatttgattcattgttaaatatacttttatgtatacatatagttttacatatttcacaaattttttttgaataagacgaatggtcaaacatgtgttaaaaagtcaacggtgtcaaatattttgaaacggatggagtaagaattaaaatacttcctcagtttcataatataatttcagaatttcttcacctcgttcatctcaacaaattacaacacctcgtttcttacacacatacggtctcatttcaaccattctctaattatttccatctagttacttaaatcacagcgtaaatccccatttcgagacagaggtggttagtatacataaaaaaatattgtaaaaggacgaacctttgctaggaacaaatacaaaagggacgaactgtactgctatacaaaagggagtaggcggtgtatttgaagtttgcgccatttgaatctccaatagcagaaacaaccataatttgaaaacaccaaaaatctgttgctcagtgcaagacagctcttctctttcaagtttcaaggcagtaccctgaccacggatggttaatcacttaattagtctctgtctgttcccctgtattgaatactacaagtatcctcaattagtagcactactactgtgttgtttgcttattggcttatgagctgtatccaaaatatggatactcatctcgacttttttttttaaccatcttcaatttttcagtcttagattttaaactgctaaaggtaggaatataaaaatcctactctaacattacctcgtttatttttctagaccaattaatatgaaaaacaatccccagctgtttcccatcagagtcatcagcttttaattttgcacctgccgtttaagcagcagcattcaggattgagctaagctaaaccgtcgtcgtggtggagacgtttttgtgaggaatcaaagcggcatgcatgcagcatcatccctggcagcatgacacaggagaaataaagagactttgatgtcattagttgactgtcgttatcaacaaaacaaaacaaaacacaaacacaaccttgaatgcttttctttgctcctttttccctttctctctctgatttgtactacatgtacatgtactactactactacaagtactacttcaagacgttgaactgaacaaacaagccaaaacaaacagcaggagacagcaccggccagccagattcactctcttaagtctctcatgtacttgtgccagtgtgccactgctcattgccccatcgtttagcatatcggacgaaaaaaaattaaacgacatatttacacacaaaaaataatttatgaataaaactttaatatacatgttcttaatgatataaaagcaaaggttaaaaaataaactatgatgaatttttttttaaaaataaactctaaatttaaggtttaaaatttaaattttagctaataaacattagcatatataaaccaaaagatgaggctgtgacattgtagcagcagtaataaagggaagaggagtagttgtattgtatgcagagaacataaagctggccagtggaactgagcaagtgtggaagatgcaggcagagatatctccagatctcttcattatttatttttctcttgttttgatatcttcttctactcggaccaaaattatgaggaggcaggcgaagaaatagtgtattagcctggatgagatgatgatgctgaactaagtcactgtttagattttaacttttttcttcaaactttcaactttttcgtcgcatcgttccaattttttcaaacttctaattttgatgtggaactaaatgctgttgagattatagacatataatgatttaatctattccataaataaatcatgacattacagatgaaaactagcatgaacgcatcattagatctacacatgtaaactacacagtataacatgaacagatcaaatatgcgcaatatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttctggagacctgctctcccgatcgctggtgcacgccggcgagcgggatggagtagtctacgagcgacggcgcagtacagagtaggaggcaaaccctagattgatttttcgtgtgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgtaaaaggaggctgcatctgcgcaagggtgaggagccaatttttcggaccattcgacgcgtacgtcgtgcacgcgcgccgcctgccctgccctgccaggcgaggcgaggcgaggcgagcgagcgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtattgtttatataccagcggttcgatggagaccaattaaggttgaacatccacctagaattccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctatgcaggacaacatctttgctaattaaagtcaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcatatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgttttagaccatacaaagacttcaacaatttgcacactttgcgttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctatcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcaaatggttggttcgaaccactatgtgtatccttcattgggaaaaagctctcaaagaagatagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatatatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacagtcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtttgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctaccatcagtagcaccgaatttagtattcagtgcatcccacaactccttagcgtcggtcatatgcatatacacctcgaccagacgattgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaactagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgatttttcgtgtgctgcgtgaagacggcaggtcgggactccacgccgtttgcacgcaccggatttttcggaacgttgggatggagtagtctacgagcgacggcgcaatacagagtaggaggcaaaccctagattgatttttcgtgtgctgggtgaagacggcaggtcgggactccacgccgtttgcacgccacgggatttttcggaacgtttccaaaacaaaaacgaatccgaatttgcagcaaaacaaaactgcaaaaggaggttgcatctgtgctagggtgaggagccattttttcggaccattcgacgcgtacgttgtgcacgcgcgccgcctgccctgccaggcgaggcgagcgagcgcgcacgtgtgtttcccttcttctctccaccacacatgcttcaagtgactagaaaggcatcctcccttttaataaggtccccatctcctagaataagcaaggtggtactaaactccacatgcatgccatcccatgaggtgggcttttgtgattttccaaagaattaatcttcgagtgggctaaggcccattcattaattccaacaaatgcagcctaactttaaatgtgaagggtagtacagcgtagtcaaaactctgcaatttttctcccaacctttttgtcagtgattagttgatccatgtggactgctcgtacacacgcgttgcttgactgtttcgatcaaaagcaagaaaaactaaaaaaaaaaaaatctaccgcataggagtagtgcttgagtcttgatgaccttcagagttcagaactgtggaaagtgattaatttgtcattcgtggcagtagtaagtttcagggttcctgaatcctgaatcctgaatcctgaatggccatggcacgaggcgataaaaggaaggagacgagcagatgagatgcgagcaatgcaagcattgcaaatgcagtgatacaaatgccatttatactactattgttcttgttccagtttcatccagctaagtactagctatatcatctgctcgacctatctgctcacgcatcatgtagcagcagcagcagaagaagatgcagaagcagcaagcaaccaaacagttgttgtttgtgatggcactgtactcctcctgctgctgcaaaccggcctaatttctgaatcatcctgtagtaggagtagtatggtttcaggggggccaaagattgggttttccggcagggcacgaactcagggagaatttcccaaatctgtttccgctagctgcgcatatacagatacagtagtacatgacaagccaccggtttggctacatcggttgtattcatttttggtttgcacatgaaatgtttttggttgagttgcattgcatcatgggcaagtaagccggcttcatccatttggtgtggagatgctttgtaacagtactccactatgcaaaatttgcgactccatgggggtaaaaatagtcatccttactatacgtttaacggcggtgtatgagaattataagatggaaagagaaaactggacagacggttaaaacaattatttcggttgcgctaaccaatacccttcgctctaacaataattaacctatgaggatgaatccagacaagtacttatctagtttcgtcgtaaaaacttgagacggagggaattgagtttaggactcgtttagaacggagaaattttgtacgactcaaaaaggttaaacaggttatttgtaaaagtcatgtgaaattcccatgtttgaaagaaactaaatttgaattttcttggcaataaagtgtgtcgataaacggggggcaatgtgatcaatgtgatcatggtttgtgcctagaggaggggaatcaacgaaaaggacagcagtcacagcagtgagagccagggaagagggagcggccaccggctgatataagacaaaagtattttttggcgaataaagatggggagttattactccactaaaaagttactagtcgtagtaaccgcaattttgaccggagaaaaagatgaaaaaaaaaagaaagaaaaggctatgtactccgtaccaaatgtgtgccgcttttagaaacagcaccctactattttcctttattatttttatgtttttgaccatcttttcttcaagcagtaagtacatgtccacttcatgatctcacttttcctttttttttctccctttaattcaacagagatggccgttacactaaattacaatttacagtaccagtaccagattggtttgttacagtaagaatcttttactttacactgaggtagtagcagcagatattttcagaactattttcatgcatgcccttcaattatatacttttattacttatactgatataatgtagtacttgtttttacatggaaaagtgaaactagattgggtagcccacagcaaaaggcactgtaaacatttgcataaatctgtctggtcggattggaccctccatccatgcatccgggttttaccatccgggggtaaaagggttaaaactagaacaaaaagtttggggggcaggggtgctatggtaaaaaaaaaacacagaaaagctgtgcggtttcctttgcaaattcttgctccgaccttcgtcacgtcactgcaaaaaatacctcttttgacaatttcatccatcacccctttctcttcttttttcacttgtctattctgttccctcgctcgcattttaaatggaaaaaaaataagaaagacaacattttcttatcttgataagggctcctttagatcgaaggattttcggagcacacagatattattttttatattgttggtttttagatcgcgggtaagcatgatctgatgaatatgtgcatttttttttcacaagtgagatgtgagatgaaaagatggtagaaaaattgttgttctgatagtttttttggggagaatatagcttagatgaaaagatggtacacgtaaggtttgaagtagaagttaggagatgtttacattttcttcttggggatagaacataatatttcttaaagaattaaatggagcatgaccctaaggtcttgccaatatatgtagtctttggaattccctattgtgtgtttcttaaggtgcacgtgttatttgaatgttggtgtactgtttggtttaaaacataatctatgttcgttaaggaagtagtatttctggctatgcacctagacgagtgttgtccacgtgcatagctagaaatacactatttagaacaaaggcagtatgaagaaaataaacaattaaaatatattttccaatcgtgttgtgtcaattatttgtacatgtcgttggccttttgtgagtgattactaaatcgataagaaaacaagtgaataataaataggccacgactattaccgtgttattgttttgattacatatctgccacatgaccatcctttgctagccctggtacaaaattggtattccatcgatgaattatccaactactcataacaattaaggaaaacatttagttacagttccaacctttacgagtagaacatgtccgatcaatacgctgactactctagttatttaaaatatattatccgctaggagacattaatatcttctttgtacgtacttgatgctgaccttcgggtatatgttaccgaatccactaaaagcctagtgaacgacaaatcacatccgttaccatattattgtttggatcatataattgtcgcacgattatcctttttggctctagtgcaaatttggtattatatagaccgtttcacctatctaacggcttacaatatttaagggacacatttagttacaatcgaaacccctacgagttatttaaagtatattatctgctcaagagcattaatgtcttgtttgttcgtactcgacgctaacctttgggggtacgttacagaatcgactaaaagccaagtaaacgacaaagccgcagccattaccgtattattgtttggatcacataaccgtcacacgattatccttgactggctctggtactaaattggcattatatggactgtttcacctatctaactaatcataatatcaagaaacatatttagtggcaattctaacctatacgagttgtttaaagtatattatccactcaagggcattaatgtctttgtttgtacgtattcaacgctgaccttcagggctacattacaaaatcgattgaaagcctatgaaacgacaaagccacgacagttaccgtattattgtttagatcacgtaaccgtcgtacgattatccttggctagatccggcacaaaattggcattaatatcgaccgtttcacttatccaaatagaaaagaaaacatttaagaaacacatgcagatatttttccaacctttccaactacaaccaatatgatcaacgagcggtgacactctctccaaacaaaaaccagcgacacttttgctcaaccggttagccctaaccaaagcgcataagtggtccccggtcctcgcgctagttttacccgtacaaatcttgactatacaaatcttctttgatcttcaaactaagattcatggccacatagagatgctaacaacaagatgaggaggagtgatggatggagttggaatgatgatagatgcaatgtggtctagtgtggtcacaatgaggaaaatgttgggtgtgaggatggtgtggggggtgcacatagggacaagggagttctggtgggtttgtcaaggctgcaagggacagagttccacccctgatagtggttgggttggagtcccaaacccacacgagcggcctctgaaacccaaaaaaaaaaaaagattcataaaaacaccccaagagaagaacagagatagaaatgaaaagaacacaagacaggaacaacaccatctctcttttccaacccttttgccatcgtcctcaaagtaagtgaaacccctccccacacaaaaaccaaatcctctcacatgaagataaaaaagaagaaccaccctaaccaaaccaaaacaattcagttcagagagagagagataagcacaatacagatagacataaatagagatatacacaaagattgttttttctttcaacaataaaaaaaactctacttttcttttaaggaggcctgtggcatttatgcatttctgttttgtttttgttggttgggagagtcgaagccaaagcccccctctcctctcttattcctatattagccccccctaccccattttgccgttcgctgcagaagcaacaacaccaacaaagctatagctgtctctttccttgcatctcctctcctcttctcttctcttatataggccaccgcgaggtcggtctccatccatccatccattccagcatttcttgaagcttgctgtggatcagagaggatggctcacgagatgatgggtggcttcttcggccatccgccgccgccgcctgcgacggcggcggtgggtgaggaggaggacgaggtggtggaggagacggaggagggtggccatggcggaggagttcaggggaagctttgcgcgaggggacactggcggccggcggaggacgccaagctcaaggacctcgtcgcgcagtacggcccccagaactggaacctcatcgccgagaagctcgacggcagatcaggtaagagctcctccatggcggtgggtgcaatgcccaagaacgacgcgcattgaaggtgtttgtgatgggatggcatggcagggaagagctgcaggctgaggtggttcaaccagctggacccgaggattaaccggagggcgttcacggaggaggaggaggagcggctcatggcggcgcaccgggcgtacggcaacaagtgggcgctcatcgcccgcctcttccccggccgcaccgacaacgccgtcaagaaccactggcacgtcctcatggcgcgccgccaccgcgagcagtccggcgccttccgccgccgcaagccttcctcctcctccgcctcccccgcccccgcccccgcgccgccgccgccgccgcagcccgtcgtcgcgctccaccaccaccaccaccggtactcgcagcagtacagcgggtacagcggcgccgccgagtccgacgagtcggcctccacctgcaccaccgacctctccctcagctccggcagcgccgcggccgccgccgccgccgccgcggcggcgaacatcccctgctgcttctaccagagcacgccgcgcgcctcttcctcttccaccgccgcgtgccgcgcgcctcgcgtcgcggcggcggctgacacggtggcgttcttccccggtgcaggctacgacttcgccgccgccccgcacgccatggctcccgcggcggcgtccacgttcgcgccgagcgcgcgctccgccttctccgccccggcgggccgcggcgagccccccggcgccgtcgaccagcgcggcggcgcccaagccaccaccgacagccacaccatccccttcttcgacttcctcggcgtcggcgcgacatgattaccggcgacgtcctccggtggtggtggtgtacaggaaggaaggaaggaaggaagcagccaagatcaagcgatcaaaaccaagctaaggttagagttagccaagaacaagactaggacgaggaggaggaggaggaacaagacgtgctcgaagctcatcaatggcgttctcaaccaaacaagttttttctgctgctgctgctgctgcaagctagcttagattattcagatgaagaacaataagaagaagatgtagtactagtaaactagtaatggtgtgtgcgtttggaaatcaacaagcttccatgccatgccatgcctcctctgttcatcgatttcttttttttatctctctcctctgtatgaacaagtagaagaagaagaagaacaaattaatccattgctctcgcagatggatcagcaacatcaagcattgccgcattgtctctctctttgtgttcattgtccatgacgccaaagagaaaagaagaaaaattttcattgctctgttcttgaaatcgatcgatctctcttgttgcagtgatcatcaacaagaatagctcttgttttggcatcgaatcggctcatgtcatgttcatcgtccatctatctacctaggaagattggtcatttagtcacctaaaaacaagatatgtcattttcctctctccttaaaccttctcttgatagccacaagaagaaacccatgaagaaaaaaaaaacaaaaaaaaagaagcaatcaatttttttcttttcacatctctatctctctatgatggtttatcttgtcctcttccaagctactatcaaacgaaactgctgttgcgaaacgccgcgactttgctttgctgcttttgctccaggttagttaagtcactgaactttttttgtgtgtgtgtgtgtgtttgtgcgagctctgatgatgttgatgatgatgacgatgtttgttactattccagcttgatttgctgcatttggggtctccttcgccgaccattctctgtagcaaaaaaatgttcagagctactccttgctcagtggtcactggtcgtgatatgcagtagtaaaccattgtctgaatctgaatgaacagcagcagggattgccaagaagcgaccgtgctgcaggctcgcattgatcagtttcatcagatgtaggaaaaacaaaataaactggtccagtttgactggagtgcttgctgttgagaatctacagaatgtgtcagcatatgtgaacatatgttaatcctgaaaattgggctgctgatagattcagattagcagcctgatggtctgcttgagttagtcgtgttcaagttcaatcagcgagtaagttggggactgggtcagggtccaaggtaacaggccccagtttttattatgcctgagttagctgactctgcatatgactgatctgaagataagtttgggtttttctgttaactgaacttactatgtgtgtagaacagtaattaaatccgttttgtccgattgggattaatctgatgaactgggtcatattcaacggccatgtcaaagatggttactgtcagcaaaactaacagcatgtaaatgtttcattcatatcctgatttatgatgttttcacctacctgtactctgtttttcaacaatagaactcccaccgtcctacagatttaggtggaatgtaacatatcctaatactatgaatctggacatgaagcttatccagatttatagtactaaaatgtatcacatccaaccaaaatcccttatattttgggacggagtgagtactacaaaggtgtttacctgaagagaagaattattagagcttaaaacagaactataattagttagggcttgcttgtttcatcggacacagtagttgtactgatttttgtttgtttggttaaatagggtaggcatcattctggcatcaggagttatgccatgctatatgtgtgctgcttggaacagagtagcctctgcttttgctttaacttttttttatagttttgcttacgtgagttaaataggtgcctggaggtttatctttctgataagaaagacatcaagttgttaagagaaaaaggctacaaataggttctggaataaaatcctgcagagaacttataattacatagtaggaaattatgacccttttgaataacacagctcttgattactgtaaccagttgttgtaatcaagttaggctacagccagttattacaggacttgcaatatcgtgaggttacctctttggttacactgtaaccctctcgatttttatcggtaacctctccgttttaatttatgtggttaccattataaccgtgacatcactggctagcgatgaccccctcctgaaacagtaagagaaaccctacttaaccaattgcttctaataatatgttgctcttcttgtttagttatattagaaaaaaacagtcatatatttgggaagggggatggggtggggttaatatttatttggataagacaaacagaaacggaagggtaaaaaagtgactatacaaatgtccaactaagacaaaattggttatatagcaacaaaagtttatgttttttggctaaaggactcatgtttatagaatcaaagaagaaaacggtagctaacctaacttaaatttagtaaaaagttgcgaacgctaaaataatttgcatttagagagtataacggtgacaacccgatagatgtttttaaccagtcaatctcaattaattaatcgcattagcacttcatggcaccactaacatttaactactatctaatcaagcttccactacaattttggcacatgcacctaaaaatcacatgtccaaatattgcatgaatcactgcacattagttaaagaagtaaaaaaaaaataaaatcttgtttcaccccctccaaatttcaacattctctctttggtgtaacaaaaatttcaatcttcaacaaacgaataaaatcatacaaatggatgcctctccacacaaggaatatctccttacctaatgcaaatcttttaccttgtttcttgctacaaggaaaaacaaaaacaagagagattacaacaggttaaaaatgtgacgtcaatgtcaggaaattttaaatttttttttggagcaatgcgtccacctccccgtgcagagtgcaccgacgacggaaattagctgtggactatgatgtttcgatgtatgcacgcgtggacaacttggcagtgctgacatcgcctcgtttgatctcttctctcagcttgcaataaatttgtactaccatttgggctttggctagctgccatgtcatttgatcgattttctctgctagatcggtgatagttacatatatggtttatatatttgctttggttcgtcggtagcagacaatcgataggagatgcacttgatagtgcattgacaagggatgtacaattttaatcttaaaggtactgtgttcaattcccactacgctcacaatttcttctgaaaaaaaatgtttggatggatgtttctctattcaaatctcgtttttttaaggagataatcgacagtgatactgatatgtatttttaggttaattgtccatgaaatttacgctataaccagtatatgtatttttttccgccgtaatgaaatgaagagagggtagcttgggggtttccccgaaagtggttatttcagttgtggactggctcaactttgattaattaatctaaggttaatatatataagtagttttaaaagctgacagaagaatcttgcaatttatattctatcgaggtagttgggaactgtcacatggaacgcatgtagcaacaagtgtgctgctactttgttgctatacggcagctgatgagtcattcgacatatgcaaacattgttaattaattccattcaaagtacagatattctctcttcaaagcacacgcacaggattaaaaaaattaaaagattgagatttaattaatcccaagcatagttaacgttttctaggtttctcaacatgatcgatcagtccatttcatggtagttgttgaaagatttggttgacttgaattaatcgtcggcacctgcaattcttcaagtactatatattatgcaaagcacaggcatattttggcagttgaaatgatggaattgaagcatcatttctatctattctggtatatatatacgacaaggtctaatccacacgtacgcaacgagttagttagcagttggtgacgcgtgttgtgctgatcaattcatggattaattaatattatgaccggatgaggattatggtgatcaagagagggttggttaagaaaaagaataattgtcataggttgttttcatatgtttgcatgcattgatcgggtttatatcaatcactcaattcgtggcgcgatgctgtgcttcaacgaacttaatttgtagtaatcaattgataatagacctaggattgaagttaatcaacctaattgttttaaggtgagtgtggacgatggatgaaactaaatttatgacaactatctgaggttcgaatgaataaattaaatgttagaaaattgagaaaaccgaatttacgccaagtaagtttgtaccttctccattattgtaaaaagctcaaacacaaaacaaaagtcaaattgtagtatcaaagatatgctctatccctccgttcataaatataaatatctgtacgtacgttatttagcaaagattaaggggatatattcccttccaataatcacatcagtgatcacattttgaattacatatggattcccctcctaagcacttcatcggttgaaaatgctttccatccccatgcaataaaaatttgtgtatcagaaatacttatatattatatgtacaccgatgattatatctagaaatgaagatattaattatattggcccattccctaaaaaccctaacagccgtgttcgtcgttgctgcttgcagggaacaacaagaacaacgtaccgtgcgtgtacgtgacaaggaaacaattagaacaataacaatgacatcgtcgacggttaggggatcggatcctcacgcgtatggcgcccggggagcgagatgcatgccagcaaatgcgaggcagccaggctgtgtgggggagaggggagcagctaactagctactacctccgtttccaaaataagcttatttttcactcgtcccacatatacatatgacactacatattactccctccattccaaattgatctacatatagtttttttttgaggttatttctaaatgatctacatatttgtgttcattcattaagtctattcgttatttgtgcatttgagtaaatggacattgatgcatgcatccatgcacacaagtatttataacccacatgcaatatcttgatttgctattggctaggagatagtggggatggtgcatgcatcgagtttgttgctagagtaaatatagtatgagagagttattagcttttcttggtcttgctgtacctatgaaatatgtagatcaatttagaatggagagagtaatattaatacaaaactaaaaaaagctatatactctaattttatcaaatctaaatgtaattattaatttctctcttcatctgctttccctatatatatcctctactttaataaaccccgatacaataattgtttaaaaatatataaatttattttgagataaacagaaagaggtaaaaatataataataaacttattatgggatgaagaactaactaagggtcttatttttttttcttatacttatcagccaaaatttaaattttcaatcttaaatttggagttgattttaaggttttttcatcgaagtttatttttcagcttttgcttttatatcgctaaaaacacgcatataaaagttttatttataaattatttttcgtttgtaaatatgccgttttggctccgtataggcttgttagctgtcgtccggatggacgcatggatgggcatgacgcaggcgtatcgtcctcccccatgtcacgcgatccacacaacggccggccttgctgcttgcaacaattcctcctcctgggaagcaacaacaacaaaccaaacaaacaaattaacaaaccatccttgcgtgtgtgtgtgtgtgatgggggagaagaaacagaaggatgaggattcgatcccttcatgtcctgaaggtcccttttgatttgagaaaaaaaaatctccaatataactatttgcaacaaaggattgcatttttttcctatataattttttttaattcttgataggtaccaaaagatactatatttttagtataattttcgtaccttctattactgaaggtatcaagagatactagattttacaataagaaatatggtacgacgaccttccatacgaccatacctccttaagaactgtaaaaccacttaatttctaatgtcttaatatatataggttttggaggatttttaacatgaggttcaatctcatgtaaagctttctatgagtttatctctctcatccaattcctacggtctaattaaatggtcattcctgtatatttttttctatatgttttactattctctattttatactttaatttctatcaaaattctatgcctctattttttcaatcctacgtttcagagaaaaccaaaacgatatatggatggatggattattggttagttgggtttgatacaaatctctcaccccgggtggggagccaaaacaagcacaaaaccgtactaccaccccaagcagcaacaaacagagtgtgatgcgtgtgtgtgtgcgtgtttgttgcgttcatctatcaatccatgcatgcactttgcatcggattctcttctatgtggtcttgtcacacggcatggtaacttagctatagctagtggttggttggccccggttcttctttgtttggaaaacagaaagcgtgcgttgctgacatgagctaggctatagctcaatataattgtgaggcaatagtagcatttttagttttcattggtttttttttcttagttgagtggagagggacccttggtttgcatgcatgaagagagtcactactacagaaaacatcatcaatgtccaaagtgacataaactgattgttatcaatactccatccattctaaaatatatataaggcacaaccacccttaacccaaagaccaagaaataattattattatattgtagtttgaatcatcctaataaatactataatgcatacatccaatgtgattagataacatgagagtggatgatttaaaaaaaagtaataatttaatagagaagatgtcataattaattgcatgcttgcatacacgccttatattatagaatatctaagaaaaatggttgtgacttatattataaaatagagggagtaatatatttctatagatggtttattttaggaaaccttgtcgagattcaatgttactagtgattgtttttgataagttttcttttctgttactattttttcaataatgtttaatactatctcttataaaatattataggagggtatcaatagacctacttgagggttgtctagatggggccttttatggtaacgatcgagagcacatccaaactagtagacccaaatgcaagcatatctctatgcaaagctagccatgcattaaagccagaaagataggggtattccaagagctctatagctaaactgctaaaggttactcctagctagcattctcaagattctcctccaccaactgaccatccatgctcacatttggcatcaatgaaagaaaaagccactgctagatgtgtcgcaacctaattaggcgccatggcatgcaccacacgtctacacatacaccacacaaccctagctagctatctactgtactactccctctgtcccataatataagagattttgagtttttacttgcaacgtttgaccactcgtcttattcaaatttttttaaaattattaattattttatttatgacttaatttattatctacagtactttaagcataacttttcggtttttatatttgcaaaaaaaaattaaataatacgagtggtcaaaagttgtaagcaaaaactaaaaatcccttatatcgtgggacggagggagtatctatctctacctaacctgcttgctggatgctgcctctctgtagctatagcttaacatcaaataacatgtagtaggagtagtaactattggttgcaaagtgtaccatacgcagagtcatgcagtgaatagtgagaaaaaaaccactgttcacggtcactacactgtgccacggatgttgttcacttcactctcactcactcggtcacctgtaccatgctggaagatatatggctcttgctagctaaagatagctagctgtcaactggtgacttggcagaaaataagctgggaaaatgacaggcgtgcatgcatgcacggccctgatggccaagtgtctttgcatatagctgacactgacaaagctaaggatgagtctataccttctccaaactccaagagtgatctatgagcttatttcatctggattctactcactgttccaaaatttaaaatctactacgagatcgattagacattttataattatacaaaatgtggacaggaatcatatgtttagattcgtaatactatgaaatatctaatttgatagtactaggtgtttacatttggggattaaaggagtagtagattatttagcagaatttaaggttagttgttttgatgtccctaaggtttacttattaagaaagatcacgtataacaatgcaactagcaataaatatagtagttttttttagagctcttcactttgagtacaagatatagtatctgaacatacgtacaaacgcactccaccacacacacactccacacacacctctacacgcatgctagacctatcaactatacacacacctgctaatgagatacacgaagccacctaagcaaacacctgctaatgagatacacgaagccacctaagcaataaatatagtagttggatggattgactaaaaaattagtactccaaaattacttatattttatagataaattttaaacttaaaatctctatatttgtagatgaagggagtatatccctgtgttcagaactaaagtattccctctatatcaaaataacttcagttttagtctagggtgtgttcaaaacaaggtgaatgaaaaaaagaacaaagtatcatcattaatactctctttggcccaatataaattatcttttatatacgaatttgaatataggctattccagaatcaagataaaaagttgatttatttaaaacagagggagcaggtcgatagtaggtaagagtattaaaggaataaaatcgatcaatttacaaaccaagagaggtaagaagatagagttaaatttattatattactccctctgtctattctaaaataagttaacttttatgcatgattcaagtttactgagggagcggtacgtacttttcgccagcgtacgtttgttgcatgaatgttgctgccaaacaaacgcatgagtcatatgtatatggctatgtgcagctcaatttatttatcgtccttccctttatgaaggttgtattgcacgaaaataatgaggacaaccaaggagaaacttggttattagataatttacagaaatagtgagcatgttgagaactgaatacataattttggggttaaaaccaaacccccctaccactacactatcatatatgtagtacatctgtgaaccctacattgcattggtagctagcaatactatagatgtgatagtactgtagtgttaatttgtgtatgtcccggggtgcagtagcgttcgtatgtatgttcttcttcccggggttatatataggatccgggtaaattattcaattctaactgaattatttcatgttaactagcatattagttagttaataattaaataataagtatatatataggacagcggtaatttttgttgtcggctcgtcgttgaagccggcagctgtgtggtacgtgtgtccttgcagggtttggcatgcatgcattcgtgcgtgcgtgcagtaaatgtgagagattctgagtcacattcatgtgagccatagcagcacagggacagctagccataatgcagaagtactgtgtacggctgatgcagtgtgcgtggtgtaccacaaaccaaaacagctttattttacatcaacttccacatatcaaaactgatctgatcttgcagtgatttttatcatcgcacgatcgctttcccttctctcgttcgttctgatcgatatctgtgtgtgaccgtgtgcacatgattcgtggcacatgtaatacagacacacacacgtgtgaatgtatagcagtaaacgtgtgggcataagagcaagtttaatagtatagcccactattaacttcaaatcttctatagccaatgtaatagccaattcatataatagttgcttactatactagtaatatctgatcccacctgtcatacacacattacatcttgaagcccgtgctgcagctggctacagatctatagcatgctgctcttctctctcttcctttatctctttaaaatatgtttatagctggcttataggctgctattgtacctgctctaaatagagtatcaaacctacggattatatatactccctccgtcccaaaaaaacaaaccctgggtttccgtgtccaacgtttgaccgtctgtcttatttgaaaaattatgaaaaaaatttaaaagacaagtcacgcataaaatattaatcatgttttatcatctaacaataataaaaatactaattataaaaaaattcatataagacggacagtcaaatgttggacacgaaaacccatggtttgtcttttttacgagacagaggtagtatatatatagctcttgactgctggttaattgatttggaacctgtactgctgtacacactgtttgtgtcctgtgtatgtttgctacatgtgctgtacaaaccagaaacttcagtgaaaaatggaaggatatggatgcatggatgggcttcaattgaaggaattgagatcacctgcagttgttagtatgactgcaactttagcagtcatacaaccattgttggatcaaataataagagctcagatcacacagaagtactgttcatcagattactgtagcagacgaatcctgtagcgcacactgtagcaagtgataacaaacagtcctgctactaaatcctagccattgaaatctttgatctgatggttgtgaagacctaagactgttaaacttgcagtccctattcaaactgcatgggatccctgtaggatcgaatagcaagaactaagccaaccagaggagggggggggggtgaatggttggtatacctaaaaaccgaaaacttttagcggaaatacaagttaccctcgaattcgacggagatcggtctgaccgagattgatctgcaggtcggaccgagtggatgccgccggtctgaccggtatagatcgtctgaccgccgatgtcgcctgccgcgcctgtcgccgacgccggtctgaccgtcgtgctcccgccggttggaccgccgcgatgccgccggtctaaccgccggtaagtcgccggttggaccgccgaaacccggtgaaacacaaatcgaagaactcttaaagtagatgacgactttattacttctctctgtgtttacaaagtgcatcaacagcactccttacaaaaatttcgactaaactcgaaaccctaactaaaaactcaactcaattgctctcaaaagcgataccgggaagcctcacgctccccctctatttatacccgggtaggcagcctaaagccacgaaccaaactcatgctaggagtcctaaacaccttaggaaaccctctagtacaagaaagaaactttacataaccaatcgtaccaaatttggactccttccaaattcgactccgcatcccatacgcacataataactccatcgtatgccatatggaatctccatcaaccacgtgcatcaactctaacttaagtatcccgcatgatctctgaccaccacggacgtcgtcttatcaccaagccgactcttggtccatcaccgcaaatactctcccgagacatcgagtcatctacacatggaattacaaacaaagaaaccatattccgagaccaagctatctccaacttgactcattagtagcaaacaatagtattacatacgtatagtatccatctagaagtcataatcatgaaataatcatggatatccaaacaaacaacccgaaaccgaaaccgacacagcgtcggccggtcagaccgcgggctgcgccggtctgaccgcgcatatactatcggtctgaccggctaccagagcccggtctaacgggccacataaaatgacagtacctgtgattcacctgtaaatccaatcatctccaaaaccacttcgtgaataaattccaaataacaaaaccaataatctccgatgccaattgttcatcacagaataataataaaaacacctttgattttacaatcccaatcccaattgaagtaggagtagtaattaaggccaatagtgtaatgtactctgagtacattattattaatctaagtcagccaaagtactccgtcagactgtgtccggccgtccatttcgacaagtcaaaagactggaacttttatctaattgaaacagtactgctcgcaattacagaaccgcatgcagtatatatatagtactcttcagacgatgggtcagaaatcaattcacaagtgcatgcaacagtacagaaacaaattaaaattccaatcgacgaattgatgaaaaaaaaggggtctaattaatgtttggcaagctatagcttgctactaggtggccaagcaaatcaaggatatactccatccgtcctactccctatacatttatcaaatcaagtaaaagactagaagatctttattttatcaaatcccaatataattatctatctctttataaactccctatacatttatccactacatttacaaactccaatacaatgactactcacaaataaattattttgtaaaagtcatacataaggatccaaaataatattattttaggacgaaagaatcgagaaagtaacagaaagcgattgcaatttgagggcgtagtacgtctcacaagcagatcatgatgtacgatatcgatcaggccgaccggccgcgtacactgcatgcatgatggttatgtatgtacaagatgtatataatcgatccgtatctttgtgtaatgtgtgccccgagccaggggagcatccagagatcaaagtaagctacgacatatgggtccgatatcaatagttgaccaacgatttatgttttaaggatgacggtaaaggggagggggaggagttggggagagtggaaggtgagggtttccttgggtttagagggatgaccttaggcagtggctggctagaccagcgggcaacgtggttgtgggaccgccattgaagttatggagatggagacaaagcggggttggtggtggggggcaatgaaggtcgtggggttaggaggcggggattgacggccacgaatctaatggagtgggggagaggttgagagggaggtgggggaggaggccagtctggctggcctcgccggtgccgttgatggtttgtaagcatggtttttcgagtagtggtagtggaggaggtagtggaatcggtcacgggagagagacgaagcaactaaggcggcatcagtaattgggggaagaaggaaaggataagctagggttgcttcaagattgatatcctggccatccaaatttgactgaattatttttaccattttcaggcaactgaaggaaatatattactttcatgtatgtatagtagattctaaaaaaaaagttttgtatagctagctaggaaacataataccatttttgcgtgtggaaaatgactaacttttggagcaggggaagccaggttgttaggttgcttcttgtggggatgcatgcaaaatggatgcatgggtacgttggttgttacacaagcaacttgcatgtatatcatatataagttgttgcatgccagagagcgaggagtactaccataccatacgttggctgggaagcccgtgcgcgtaacgtacccttaatttcgctaccgccgtgccccagccgataggtggacattgaatttgatggtgatattaatatgggaatgtgatttttaatctcaatcttctattaggcagagatggtgaaaatcgatagagagtttagatattatggaggctagatcgtaagtaaaaaccgatttttgagatttgtttaggtaatgtataaaggaggaatcctctctgatcaactccttcccctaattaacctatatattgaaaaggagggagtttccccctcaataccccattccccatatcgcaccaaaactcccattcatccaatcacctccacgtactcaaaaactgcaaatttaaaaaatatattaaaaagcagctacaagaatctgatctcccttgggttaaaaaaaagggtcataaccatatgagtgcgatcaccagatgtcatgggaaagtttggcagaaaccctagttgtttatggttaactaatgtactagtactcgagcgatcacctaaggagatagcctaaattaaaataattgaatctgactaattaattggtctaatctgccctagtcctagctccaagtgttgtttagttagggtgacatatgccacttttgcattttgttccgttatgctacaaagctttatgtgctgattagctagttaacggcaaaggtgacttctgctgatgccttttcntagtatgttatcaaaagggtcttcatcaaggatcttaggcatagtatcatgatttggttgttcactaatataatattgagatgaggtttggttgttaactaaacatgctaactagtcacatcaaaccaaacatttaatttttatttcaaatcaagagcatccttctgttacagtgggggttgtttggccttacactcaacggaatatataacggatatactcttgtcgcataacctcgcaaagtgtttatttagttatttacagtctctgaagggataaaatacactatgtttcttttttttttggctagtattagttaatttgtggtaattagtacactagctaggaggttcatttataaaaatcaatctacgaattttagtgttaacatttggtaatacataggtgcatgcagtaccttgcagcacacctccttattgttaataaggaacagtaaatcaccgtctttgcgtaaattttacaaaactaatgatgtttcgataaagctatcaaaaaatataatgcatttaggtgaatttatcataaaactataaattgaaggtataatattgcaaaaaatatagatacaacatatatttttttggtcaaaagctacatgttacatgtatccatataataacgcaagaatgggacctatgaaatttgtagtgttgtaatacattatgtgctaaatttataattttattagaccagcatataaatatgtagtttggtagattcaatgttaaacatgtaatttgtgatacacggcggctttaatatataattttgcgatggttttgtcaaaatatataattttataaaatttactctttcttttaataattcatagtctatatggtacatgcatggctattgggaatgaactttaaacaacgcatgtatttcaacgctgaattataagatattaattaatgaatatattttattaagtaatgaaattacatctgcctctgcatctatactatgctcacagcccaaaaatatcgcgtctctgttatctaaaagatcaagctagctaggtagctattgtgttaagcacatgacccacaacggtagtggttatctcatcaagtccataagaggcgatgatatatatcctatatattaggttaggacttaactagacatgtctcgttacttggaagatagagacttattcgatgtgtacctctgggtcctacttaattggcttaattccaccaaagttgccggaaattaagacactgtatctacaatattaggcgacaggactaatgatggagatgacaaagctagctaacaacaagcatatcgatcaatgatcatcgtggcaaactttgattttagttgtgtcacatgcatcatttcgattaaatttgcattccttttgttcatagcgtctgtcattataaggaaaaaccgatgcactgatgcagataggggcagagcacatcaaaagtctaataatagacccaactaatgttattccattcaagtccaagtaaaattttctgctttctacttcttttttaatgtttttttaagaagattatctaactgtaattcatcatttaacaactgcgcagtatgtgcgtttaccactatttttttattttattaattagaactataggctgagcttgggcacaagttggagcagagtacgtacattatgaaatcgatggagtttgtgctgtacagggtaaaaactgttggtttattgtatcagcccacctccgatatggattggaggagataaaaaccattgtttcttcttaatcaaggaaactaagagaggttatgtctgatcggtaaaaactactactataatcctaatagaattaattagcccccaagccacatcagtattctattgggaactgccacaagttatttcagtaaaaaactttcacatatatctatattatgattaaaatataattacattatataactgcactgtaactatactgtacctacgatataacttatataaaacttgcattcaactatggtttggttagctagtacgaagatcttacgtatgacatgcatgaaaatttctttctatcagttttttcactcatgcacaaatctcgatacaatctgatgattaacaaatatgaaagttttgagagcaaaatacttgcgaaatttttttagcaaatccgtaaacaaaagagaggcaaaggggttgcccaaagcttcgacaaaattctctcaaacctttttttctatgaacatgtacacaaacaactttattaaacaagaacagatcaaactaggggatataccccagtacatatccaaagataagaactgaaagcaaagagccatccctatgataaggagggttaactgaacaagcaaccttctgatgtaaccaaacaacataaaatacaggtcgacagggagctgcgacaataccgcgacgactgctaccttgggtctgatttgtcgtgcactccgctcgacaagccgttaattcccatcggctgcctccacggaatggcacaaaacaaaggtttgttgctaagcgtacattttggtgtgagcatcatcggactcagcaaaggatttccacggagttagtaattgaatctgaggagctctaacattttatcgatctaaagcactaggattcgtatggctattcccagctagtgtcattggcatccagagggtgcttcgctacgtcaacatatagaacaccagcgaccacttcgtgatcaagctagcgccaccgcttccaaatatcatggcttaataaattcacaagcagatccgtagatctattctgaatagcagaagatgagatcatgttaggctaagatcaatgtaaattagactcgatattgtaattcagagaggcacattttttttattcacacattatattgccaaacttaaccgatacatgttaaatatttaaccaggagaagttttaattatcataacataagatgccatatatataagaacaggggtgctagcttattatagcttaggccatgaaaagactcttaattacaggtaatgatggaaaagaaacttgaactgtaagatttgcatattcttttgcagatcaatgtagcattattcatccaatatattatatacgtactctctctgttttatattataaatcattttgactttttttctaagctaaactcgatcaattcatgtacttaaaaattactccatccgtcccctaatataagggatttttgacatttttgcttgcactgtttgatcactcgtcttattcaaaaatttgtgtaaatataaaaaacgaaaagttgtgcttaaagtactttggataataaagtaagtcaaaaaaataaataataattccaaattcttttgaataagagtacaagcaaaatgtcaaaatctcatatattaagggacggagggagtaatacactaaaactcttaacaataataccctaacatttttataaagctaaaacaaaacttcttcctttatggaccgatgcgtatgtaactcgatccatgctaattgaacacaccggcatatttaatttaagaatataaagaaaaccattaaatagctgtcatatatataatgatctcgtacggttttgtgatgccgttgcgttgtcacattacaagctccacgtacgaaatagttgagcctttccgacaatttggttaattgccaatcctttcagattagaaccctatttttttgatgaaaagattagaacactatgatcactaggagctatacgaactaatgaaccgactttataaatatactatatgcaaagattaattagttatcctatgatatctattctgcatgtagtgacggaggattggctagctagctaatcactcaaatccagtgacagcgtgcatttcaatgcataatcgctgaaccatctctagcatctactccctcaaggaacatgtccaggtacattgtctcataagggatcacattttcttctaaattaattttttaaaggacagagggattgagtatatacgaacgtaaatatgtatgcaatgttcatatatatgtcatgtcatgcagatcagacctctttatatgcttgaatgatcttttttttttggtcttaaaaaggtgatcagtagttcatgcatggtgcagtggtgacaaaagccaactaattgccagtatgttaagtaacaaattgacaggatcatctgacggtaattaaaaagaaagataatggagtttgcgccatcagatgccaccagcctccttcctaaaaagtcattgattgcattggatggaaaatcaacaaaactaagtgtgctaaactagtttgcatcaccgcatacacaactttagtttgctcaaataaatactagtatatatttgcatgcatcagagagacccatgcatgcatatagctatcaagcaatctaacctccatgtctaaattaataaatattaatcacaagccctatatgatcaatagttgctccctttatatatatatatatatatatatatatatatatatatatatatatatatatatatatatagcgtatcctatgcacacaggccctcgcgtgtacacaccgtgtacaccaactaaaaattttcacaaaaaattctaggaaaattcatacatgtacttttaatagtattacatctacgtgcaaagtcgcatattcaaattcattctacatagagaataacaaaaaagataaaattctgacaaaattgtaaccttaaaacggtcagattttttgttttttttgttacggctaaaatataatgaatttgacgttaagattttaaccctaggtgtaatacaattgatagtatgtgtatgattttttctagattttttggtgatattttttagttggtgtgcacgtgtgtacacgtgagggcctgtgtgcataggatatgttgcctacatatgtatatgtgtgtgtatatatatatatatatatatatatatatatatatatatatatatatatatatatatatatatatatatatatatattatatttacaagcttatctatctctgatgaagcaagcactatctatagagctatctaaactagctagccaagcaagttaaacgcagcaatccttgacctaagaaaaggaaacaggacaacatattacttaattattataattatagttatgtgcataatgtgacggcgccatgtacttaaattaattagttaaagcaatgaaggggaaagaataattaatggtggcagctctgaccacccatgtgtcgacgcaaagtttggcgtgtcgcacgctaaaatgtctgtcgacgtgtgtgagcatatatatatacatgtcgcttttattctgttatgacttgtgataacggaactacatgcccctttatatgaagtacaaataaattagtactaatagtatgtagatagggaaattaattcagaggacgtgtcgaatcaaaattatttctcttaaaatatactactagtaatatatgaaatataagaggtactaacacatgctacacctagctagtttcggtctattccggtcatgcactttgaacctagctagctacgactaactttgttccaaaatgttgctacctactccaatattaaatgggactaattttgatttgtagtattagtatgtgtctcatccagttttagataatattttttgcgaacgcgtaaaaggattgcacgtcaatatattagcaggaaaagagtttctgttacacaaagcaatcagccagactgacttatgcctaaaaagggtgggggacttgaagctatgaactactacgacggttaaaaacgcaactccaaacagcgggagggggcagagccacgctacactctcaagaaatcccaaaaaaaacaacaccggctaaagaccacagctggcccagttttagataacaatattttagaacgcaggaagtactagttaatcggatgaaaattaatatatgccacaatgaaaattaattggatgttggctgatttgacctatactgctaaaatttgaccttgatggagattcaaattaagcataactcaaattttcaagttcaataagtttttctaagcagacacttacagtacacgtgcacttacctctaagaacacatgtactacgtctataaacacctctaaaaactaagccgacgtatcttgagtttaaattttatagcccacaattgcttatatgctttcaatcagtaagaattctatgagctatatattgagctagttcatatatttatccctctgtatgtacttcatatcgtttgctctactgataaatcgtgaaaaaaaatgaatgaaacaacccaaaaaaaacttatggtaaggcctttatatgtgcattcttaatgatataaatgccaatgcggcaaaataaactacaataaaaaaacttaaaatcaactctaaattaaaatttggttgtggctgataagtcaactatagtaacacaaaataactcttgattaattattgagtagtttaacactggtctgataaatgacaggtagattttcatacttgtggcgcatggttggtatcctccatgttcgacacaaatctatcaaccaaagagataaaaaatattgcaagtttatcagcgattcattaggccaggtaaataacttctgaatccatgcatcgcagtccgtggatagcagaaagaaatatcacatgcatacgtgggccttgggctggcattacaggaagtccaataagttagcaaaacaggccttgtgggcccaactagacagacatcagaaaactggactgtattatgggccacattcctctcccttaacagggcagagaataagtctacattgcgtccctcaactcttgtccttggttgaatcacgtcccacaaccaaagtccctcaaccaaaataccaggtataacacctcctccagttttgaaaactagggcaaatcacctccctgcgccgcatcatcctatgccaccaactctgcgtgcctacctgcgtccatctccgtcgggacgccggggacatgtgccgccgaccacgccccacccgccagggtcgtccacccatggggagggagaagaagaggccgcggcgcagatgaggaggcaaggatagggatgaggaggtgtaggaggggcgtgggaggggaggcagcgatggggagggatgagaggaggcggcgaggcttccttacccctctctctctctctgctcccgccgtcccgccactccgtcaagctcccgtcgccttgccgctcccaccaccccactgccccacggtcatgccgccccgtcgctcctgccactcccgccgagctcccaccgccccgccgctcccactgtcctactgccgccaggctcatgaagctctctccatctcgctcgccatgaggataaagagggaggagaaaggtaactgacatgtgggcccaataatttatttttatcattttactcactgacatgtgggtcccatttaggtttgtctttattttagtgccacgtaagcgctatgtcgatgccatatggaatgatgaccaagtcaactcgccacgtaagtgccatggaggacaaaaccgccgagggagtcgatttgcaatggttttgaaagttaggggatgggttatacctggttttgcagttgaggggtgcgattcaaccaggcacaagagttgagggagtcaaagtagacttattgcacagggcattaagctgggcaatccataggagattaaccacttgatctggcccatttttttctttctggcattttcgtcggcccgtttaccatttccctttttctttattttgtcaccactctttcttgtactattcacactcgagtctacgcatataagcatatctgtgaaaaaaaaaacgaatttgggtgaacaaaaatgttgagatacttataaatcagtctatatataattgctattcctagtatataaatttatttatttcgtgacagttttgctgatctacacaagcttaaaagaagggtatgcttttttttaaaaaaaaagatatttgaaggatttgaatcctatgaaattcctatatgtgtatctttgtaaccaaggaatgttcatctcaaatcctataaaattcatatggattgcctcaattcaattattcacagaattttcgaatggtttctaagatgaggtccaaccacttaggaatcttgttttgtgtttttctcttctctaaattgatcctttgttttctttttcctataaagcatccaaacaattttatttgaaaaggtattgtattgttgagatacttgacgattcatggcttatttcaaacacaaaattcgaaaaaaaatacaagaataaaaaagacacaggaataagatgtcaagacttattaaatcttacaggaaactgatccacatcaatttgtagtaaatgtcatttgtcaacaccaatggaaaatcataggaaaacctaatcaaggttacagaaaacatgatgccaaaccttacgttattttttctccgaaaatcccatgaaatgagttgttacataagaatattctcaaaggatttggtagaagtcaatccttccaaacgaccaagtaggaatattactttctatacgatgttaatcctcaagattccctttgttttttcttttgttccaaagaagatctaaatcagtcgaaaacaaccaggaaaaccccctaacattttcattttcattttttttaaaacggaatcggaacggtagacccgaaaacggtaacgatattggtaatatattgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgttcccgtctcggccccgagggccgaggcgccccgaccccttgtgggttttgcgccgcgtatatggggtaggtgagcatagcggggcatacctaaccacatttattgcggtttggacgagcgcgtcacgccgcatgtaacgcagtgcagcgcgctcgtttatccggtctgtgaccagtcacagactgatcagatcgtgggttaggtggcgacaggcggtctgacgcacgcctcgccccatcccgtcaggatgagagcctccaagcactcgtccctagccggagccggcgtgttaactcctggagatggcacgttggtcccggtcagatatataccaggcttcatcctaaccattacaagcaagacattgtatgaagaggggcgaacatgcagattgataaactgacgcgtggtgggcaagaatgaccgatttgtgaccggtctgacactgatcatgtcatcagcagacagccatgttcccactcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggatggatttttggatccagaacgatcagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccaggacccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctaggcgggaggaggcactcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctagacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcagccgccactccttcgtcagcgcctccgacccaggaagatctgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccactatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcactcatacattcagcggttctgtcaagtccgcaacaccataccatgcatccctgcacacgcggtgatctacgcgttcagggggggtgtgcggcacaaccgcatgctcgaaaagatcgcctccaaagagccctagactaccgcggagctttttcagctcgcggaccgagtggctcgtaaggaagaggcatgaacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgctttgcgggccacccgaaaggggaggcctgcgagcgacaaaaagaaggagaccggcgctcccagtagggagcgcccaaccggcaagtggtgcattgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagcctcaacatcctttcccccgcagcctttgacgctatcaaggccccggggatggtgctccggccgtcccagccgattatcggtgtgacgccgggtcacacttggccgctaggtcatatcgacctcccggtcacattcggtggatccgccaacttccgcacggagcgggtgaactttgatgtggcggacctcagtctgccctacaacgcggtcctagggaggcccgcgttggtgaagttcatggcggcaatccactacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgagcgacggcccgtccaagaccacacggatcggtggtcttctggacggcaaataggaagacgcgctcgtctctttcctgcgggcaaacgctggcgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccacgaggaggtggcgcgacttctggaggccggattcatccgcgaggtcatccatccggagtggctggcgaacccggtggtcgttcccaaggcgaacgg

SEQ ID NO: 70313 - DNA, 5455 bp, Oryza sativa
  unsure (1)..(5455): unsure at all n locations
ggatacttccccctctagcctatgtctcagaaagcagcagtagcaaacaaaaccatgcatttcctccacagcatcagataaaagaactacagatccagattactgtagcttcaaagtgtcccaactggctgctcactctaatcggtatgccagcattcattcccaaacatgatgaagcaactgtttgatttgaactaacagaacaagaggaaaggtaatataacccccaaagactcttcagagagcactgagctgctgatgaaccatgaaaaataaatacaatcaaacaaataacaagcgccaattgaaacaaaccttagttccaagccgtttgttaagggcttctttccacatgttggcagcatactctggttgaagtttgttccacatagtcatcacagaggcaacctaggccaatcgtaagattttgttactacaatcagcaaataaatctcaaatgcatagctcaaccttgcaagcaatccttgctatatctggtattaaaattaatccactaggtatgcagcatataataatctataactctaagcaaccagcctatgaaaatatatggcgataagatatagcacacttaataatataagcgttagcaaaatgctgttggcaaaaagtgatattgatcataccacatgagcatctaatggcggtggatagttgtcgcttatggtatcaatccaactaaaaatcatattgtggtacccataaggttttccatccatgctttttgcatattcccaagctgctgtctcattaaattttgcacgcaaatctggatgcaaaggtagtaatgcaatctgaggattggaatcatccttttttacttcaaagtcccaccattcttcccatggcaagatagcaataatatcttctccctgaaaaattaatgcatgttagcttactgttgctgaaataaatacgcctcacgccaagggaaacatcacattagctttcctacggtatataactagtaaaccagacagaagtatagaacaacatctgacatatcagtggtgtcccatgtttcatcttcaatggttgatgttaatacattctgttagagcaagaatataaaacattgagtgaattgcagtttgggccaccatttattaccaaagtttcactttgatcgccccccatcaatcttttcacttcagaccgggtaatcttgccctttttgcactatgaaccaccccagctctcatttctagcaaaatctagtgtctcctctggcaaagatgtggcccgtgtgtaagtgggggagattaccggcatgcaggtgccgatgtgcttaaggctattgatgcgcttgatatgagactggtggtctaaattgcaacaaagggtgaagggtggcccaaattgaaactttgtcgataaaagctagcccaagctgtaattcactctaaaatatccatgttacatttgaaagaatcattattgggttaaagaaattatcattgtacaaagccacaggtattaacaatgaaagcacgagagcacaattactcctatccaaccgcagaccaaaattacataagactattactatccaaaagtggtctatcatgcatcctgcgaaaaatagttaagatgctggaacttttcttttcttccattcttctatattcacagtctcatgcagtcaatctgtcatattcaaatgagtaaaaaaaattacacagttaatgaccactacctgttcattctcatgaccagattccccaacccaaagctttccttcagaatccctgaggcaaactgcggtatggccagcataagctccagtaacccacttctctagggtttcaaaaccaccccagcgcccacgaatttttgataaaaccaaaaaatctccagagtggatatcgtcaacatttaattctgacacccaaggtttcggacgttcctcgaaggttgcacccatatgcttctttagaaatgcaagatttgaattctcaccccattgagtatttgtaaacagggggaaaacatcccaaagtgctctaagtgttccaattgttccagatggcatcaggaatatggatactcctttgcgttttacctatgttaaggtaaaagatcatgcatatgtgtatcaatgatcagaaatgctgattacaaacaaaagcagctgcagcggggacttacatattcatattcagcctcgctttcccattctttgaaatcaagggtatgctcacgacctacaaagtagtaatcccatgtaacacgatatggtgttgcaaacacataaaggtctatgcaagtccagctatgagctttgtttgtctgcaacaaggaacagtgtcaggatcaatagtgaaataagaagaatattcatgtgtagagaaatgagaaccttcagaaagcaattaacttgtattaagaaatcacaaagctctgaaaaaaggttactgacttcaatccaatcacaaaccacatgcaagacagcagaaaccatactggagtgggcatgtccagttagatgccacatattgatctaactaagattaggcatgagccaagttttgtgaattgtgatatgcctaaatagggaaacgaacatatttgaatgaaccatctactagtaccatctagtacgctgtacaaacaactctggcaccgatcgatctacactaagctacatgactaaatttaaatgtttcactgaactgaacgcaatcgaggtgataatctcaaaattacgatcaagtccagggttgaaactagcagactgcaacaaacaagccacaaatccccaattgcctccctcccttggggaggaagaatggttctaccgcctccggctcagagtaacagagccaacactgggacgcggggcttgggaccggcactcacctcgagatggagcgtaccacctccaaggcccccatcagtcccgttgtggaactccatccacgcccggttatcgtagaagcaggcgccctttcactcggcggcgcgggcgccgccatcacctggctcccgcgcgacgccgacgaaagacgggaagaggtcggcggcgccgcgcagcgcgaggcggcggagcaacggctgggccaccggccacggcangatagggaggaggtctcgcgggaggaccgtggctccganggccnccttcatgaacccccggaggaaggggcgctaggcggccaagaggaggactagcgcggatagggctgccaagagcttgaggttgtaggctcctcccatgaccgccgccaccaccgccggttaggtctggtagccctccgcgagtttcgcgttgccccgcgctggttttcttcccgtgacggagttctttctagtcgatgactcgtttgggtttgttcactcaggggcggacactcgagtaaagataaaatatatctgcattttatttcccaaggttgcttctactaatcggttgtttcttctaataatcccttgttgcttgcaagtttccgactctgcacgattgcacgaattgactagaattggttgtattgtactgcgtatttcgatgggctacaaggagtatcgccaacatattgcttagccagaattaaaacaagatgttgcttagcaatagcaatgttatttttgaacaacgaaattatcttccgtttctatataaatttggtgtgcgctaatataagaatattcatgtactatgttcattatttttttttctgggaccggcgtaaagccagtcgaagtttagtaaagatttagaagagactttaggttacaaatactcctacaacattaaccccacaaaaaagcggccccagaaactccagggttacctgcctccccgtcccgccgtccgggacgagcctgactaccccaatagattactgacgaatggggagcttgggtggcggcagctctaatggcgccaatacagtaaatctatgttcattatttcactgctatagttttcccttttccttttttttccgaggagtgttataagtttagctgacaaatacgatactgttctctaagtgaaaatcttgctctcaagagtagttctcccttctctatgacggtatggccccctgtttcttttcttttagggcccctttaatcataggaatggaaaaacggaggaataggaaaaacataggattctgacaggaatgcaggtataaaacagaggattggaaaatataggaaaaacacatgaatgaccgtttgattggaccacaggaaaaacacagaaatcggatgagagagatagactcaaaggaattttttctaagaggttggacctcttgctaactttcctccaaaatctctataggattagccattccataggaattttaaagaatagtataggattcaattctttgttttaaaggcttttataggaattttttccataggattgaaatcttttaaatttcctacacttttcctatagattaaaggggccttgaaaggagaacggtggcatgtggtccataatttgatttggttgatatttctattccaagatataaatacgtgtcccagtcataagtcactgagttggacacggaagaaggttcggaagcggaagtagctgtggtcaggcgtgcgtgtccttctcttcctgcagcacagccgggatgtgcattgactacagtgacagagaatcgggaaaacaaaaaaagaggcaaattttcccgaagtctgatctcatcgtcttatctcatacacgatctctcttctcgcatcaatgcgacttcggaagaacagcgtatcgaactagccattggtcacttgattagttgttttagcttagcagcatgagccaaaattgcacacagttggtagtttatgccgaaactgaccgtaccttgatgtggagcgtgccgcctccgtacttggagccggagtcgttgtggaggaccagccacgcctcgttctcgtagaagcaggcgcccttccactccagccgcgagccgaccgcgcccggcctgtccgacgccgccccgacgaacaccgggaagatgtccgacacgccgcggagagcgcggagcgccgccatggccgcggtccgcggcaggaggggcaggacgtccatggggctgaacggcagggtggccgcggcagcgcgccgacgaggccgtcgacatcgcgtgggccggcggagtagagcagtgccgcggcgagcgaggctgccactagcagcagcagcgcagccgcgatgagcgtgttgttcttcgccatggtgtgtgggaatgtgggatgcgccgtccaggggactcggggggtttcttctcaggaccttagtttatccggttccgtgtgaaaaacgagcagcacggtgactggaggcgagggtggcggtgtttgggacgcaaatgtgttgcactctgttcttgaattgaggtgtgattatttcacttcaaaattaaaagtttggttaaaattgaaataatgtgatagaaaagttgga

SEQ ID NO: 70314 - DNA, 5590 bp, Oryza sativa
aaagtttggaactaaataaaaccttggtgtggttttggcccgaaggagtagtaggtcctggtttagttcctaactttttctttaaactttcaactttttcatcacatcaaaactttcctacacacataaactttcaactttttcgtcatatcgttccaattttaaccaaacttctaattttgatgtgaactaaacacaccctacaactgaagcttcacacgaatttatcacccaagaacagtaatgctgctgatgcgattaggaaaggtaatctgcaagatttaaagacttgtgtttcttgagaacggggtatataaaactacccaaccgattgaaaccgattgaaacgattttatgcttgtctgaggcacgctgatcatgttatttgcccaaagtttcaatcggtcgtaacataatttcagtttgggactacaaaagccgaacgccatgtacagtttggtcggtggatcggtgcgcacgaagaatagtcgggcaccgtcaatttttcccctcagtataactgtaacccaaaactgattatccaaattggtcatggaatgatggaatcatcgggcatcaaaaatccctcgactggtatatactctatacgacgtcacggctgacgccttaaaggcaataataataatacattgatccgatgatccccatctatcactcacctatacagcccaggcgcatcgtactatcatagtaccacaagtctacaggcagcccaaacagcccaactcccagcacgcgcgcgggagctgcaatgggctaaaggccacaagaccgcaaggcacaggcccatgccccgccccctcgacgccgcttgtccgcttcacgtgcttgtgaacacgagaaagcctgccgcaacaacgatcgtcaggccaggcgagcgcggcgccgaatctatcgaaggcggtgcaacgtacgcttccgcgtccgcagatcgcggggagggaatcatcacgggccccggccctacccagaacacgcacaccgcgcgggatgagccgctcccggccctagctagcgtgcacgccatgagtccaggacgcaggctcaaaaacctggacgtccaactgaacactcccgcagttccgtgcatgtagcacccggcgccaatcggcgatcacgcgatccagtggcgatggtttatgtagcaccttcctacctggaatgtctctgtcggatcaggactcagcgctcgctttttggtgaagccaagacatacggagtacaccctccatcctaaaataaaatataagaaactagaattgaatgcaacatttcctagtcctataaatctggatgatatcacattcaattctatgttcttatattttattttgggatgaagggagtacgttcttatctcaggccatgtttagttgcaatttttttcttcaaacttttaacttttccatcacatcgaaacattcctacacacataaacttctaacttttccgtcacatcgttccaatttcaaccaaacttctaattttgacataagctaaacacaccctcagcctgtttttctcttccttcttttggagtgtgggccacaggcaagtttttgggtgccggtcgcgttcagctgtatcctgtagaaaatgcggtgcatgcagatcatctcgtgaagaagatgagaaacgaatagctgccaaaaaaagaaagaaagcaaggaaagaacagtcttcaccgtctgtagatttctatttgatatatagatgcaggtcataactttcatatgtatcttgtgtttggtctcaaactcatcgtcaacaaacaaaaaaaagtgcaattcccacagtggagcgtattcctcaaattagccttctttatacaattgtaaaatatctttacaatgatttcccctacatttatttacatattcttcgacttctttttgagcgcgcggatttttgtacatgtcctgtctgaacaattgatgaattaacccaaatgtattctagctatgcacatcaataagcaccgaaattaaatctggtgcagagtaaagaaaatgtggtcatggaaaagaaacatggaggaaagcgacaaacttcttggaaaaataatcaagcggcgacttaaccaccaagcttaaggcgtagaatggaactcatgactccacggcctccggaatgctctgcagggcgggcttccagtgcgcctccctgtgctggtcgtggtggtgcacctcgccggagttcatgatgtccgccagcagctgctgcgtggaccgccggctgatcttcccgtggccattcccggcgcccttgcgctccatcagctcgtgcagctgcctcttggtgatcctgatggtcacctctgccacgtgctccatccgctcgcggtggccatcgtcctccgacgatgacgacgccgccgcctcgtcctcccactcgtcgccgtcggcccacgactccacggcacgctgcgacgccccgcagttccccatcggtttctggcttgttttttttttccttgtctatgaccaacaacgactagatttctccttccgatcttactgctagcttagcttgatctagctcgatcgtgagctcgtgccttttcgctgattccgtgtccttgtacgctgctctgagatgggatatgtaatgtaatccaaatgggttttggagtctatttatagctgggaggttggcaggggagggcaggaaagagatagcgcctaccggggccaggtcagcgatgattccgcacatgacacgaaccaccgctaatacaattcgtccgtgatgtcacgtggggaggcgaatttccttggctccgacgtggcgagacggtcgtaggatagaagctaatcctcttgtgttcctctccacccggtgccggcctcctagaaaagctggacgaactggcgcgccgcgcgcgtggtgccttgccagtgacagtgagttgcctcggcgcgacgcgctggcaaaagcaatctacgctggcgcgacgcgcgcgccgagcccgggtttccatagaagcaggtcggttgacggttggcagcgcgttctaactgggccggtcctggtgtgaatgggctctggaacgaatcttgagaggcccgttcgttcgcgcttccgtatggtcaggacatgttccctctctcggtggagactttgcggtggcgtggattaggagtactggtgaattttgtcagggtatctggccacgtgttcgttagggataggcacgtttttaaaatttaaataaactttataatttagaggctatacctttttatttgttatatggatcttgaaatggatgtattggtgtaagcactaatctactcacgttacttggatttgaatagttttagtatggtttcgagggaactagctcaaaccgtataactcaacttttagtatgatttttttttgtgtgtgttctctaaacaactgaacaacttactattagatcgcattttatttttggcttatggggattatgaattatagattaattatcctaaactactaaacggtgtaattaaaaaaaattattcatcagcatttttagaaaacttccttaaatcaactttttaatatttctatttaatttattcatctgtcccttgaataatcgtcataactcggtttcatccacatccatcggctacagataacgggtagttcatcccaggccccacctatcttgtagcgcccgttccgtcgtggcgtctagcgggaaaactctctcttaaaaaccctatttgcgaaatccgtttctttgcttgttgtctagtgtccgtgccatctcagatctcaaatccccgatctatcgtcaagttcaatcctgaatccaaatccttcccaaatcaatccctccgcaaaagtctgattcgcctccctcgggttcgatgggccgaatccctctcggcccatctccccctccctccccggctctctctctctctctctctctctccccgctctgcccgtgagccgcgccgagccctcctccctctccgctctcgctgtcgttcccgccgatgccgcccaaatcgccgcgccgcccgcgcgcgcgcgcgcgccgtggtggccgaccggccagtcgccgctgccatcagtgcctgtcgcacctgccccgcgtctgctgcccgtgtcgccgctccactccaaaccgccccgccgtcatcgccatcgtcatcgacttggccccgcctctccccgcgcgtgcctccaagggacggaggcagagctccccccctctgccgcgtcgccctctctccctcctccttttccgcaaagcagcaaggaggcaagccctctttctctcccccctttttcccttttcccctcccgccagcgtcatcctccccccctcctgtcgccgttttggccgcgagcgccgagcgccagctcgctcccttgaccgcccaaggtcggtttccaaaccgacatcgccgccctataaacccaagcgcctcccttcctctttcccctcccaatcttccccgtttctcgcccgcgccattgctgtctctctcgccggccgccgccgtcgcgtgtgccggaggagccggtgcgcgttaggacgcagaaggggacaccgggcgctcgccttcttcctcttccccggcccgaggccggagagatcactcccgtgccgtcggcctctcgtcacagtgccccgcctcatctcggtagtgcattcccccgttctccctcctcgatccatctcctccccttagttttcggtagtagcatgtgtagccttcccgtagctagctggcgccgccccgaccgttgccgccactcgctgtgtgctcgccgccgtcgccgcccgtgctccgtagcgcccgctcgtcgccggcctcgctcggcgtagctccgcccaatccgacgctagcaacggattcccgtagccgcgtagatgctctcaccgccgggaatcggcccctcgtgacctcatcgccgtttcccccttctcccgccgccggttgccgccgccgcaatccaccgccgtcgagctccctccggcaaatccgagccattggctcgtctcccctcgtcctgtgcaacatcccggtgtgctcgccttcgcctgtatcgccatggttcgctccgccgctcgccgctgtcgtccgccgtccgttccggccggcgtcgtcgtctacctcccgccggcccgcgtggcagccacgtaagcgccacgtcggcgccacctcagctgcgaccgggtcaagcagaccccggtccgccgcttccctccgccccctcgcgcgcgcggtccaccgcgagccgtgaggctgcgcgtgggcccgccgcaccacgtcctccgcgaaccgcgcgcatgcgccgcgcctcaatccccaaaccctagcatgccccgcgtgcacctcgctcacggtgagccaagtcgccgacaagcgggtcccacccgggaccacgcgggatggacccggcccaccggctctctctcccccctccccgcccgcgcgcgcgctttgggccgccttcttgggccggccggcccattaagctcggccgagccgccccattctctcgggccgcgccctagccgcccgagggaagtctaatttccctccctccttcttttctt

SEQ ID NO: 70315 - DNA, 12604 bp, Oryza sativa
cgtccacggattggaagtaatccaagcattccgaaatggacgtgactagacagctaccggtcgctggtttgcgttatcaagcgaccactccatccagtgtaaatccacctttaacttaaaaaatacaaaaatatgtatctttttttaatctatttaataacttatatcttttaaatcacatattggttttaagatctatttgcatcattgtactacactcaaaatatatgataaaacgagatccatattaaatatatttaaacattttattaatttaaaagtaatttattacatgttaggtagtacttttacatcttatacatgattaattcttattagttactttaccttcatcaatgttattttcaatccatcaaaggttttatcttctattctcatactacatgaaaaacaaaagtgaaatcaatgcttacaacagatttatagaaagttacttctgaaccatgcaaaagttacttccaattaacattgaagttacttttaaaaattattaaacttactagtgctgattaaatttaatttctagatagagtcatatttttatccctacaacaaatttacttctaatgtcatgacaaagttactttccttttgttttaagttacttttataatgtatgtaaattactttagactttattgaatttacttttatatgtctaagaagtaatttagtgaaatctaaaagtaatttagatatattataaaagtaatttgtatcataatataatcatgtgagatcttattataaagatttaattgttacgaatacaacggtgtaatcagatcgtagactatatgagtagtttaagaggaaattttatttgaagtatagatggttcctatttgcttgatggactagtaatatattttctgtagagtaatgtgtagagtaatgttttcaatggtgtcgcgttgtaagactaaaccgagaggcttctcggtttagattttgagttccgaaatctataagtatgtctattatataaaattaaaaaaatgagaaattgtacgatacttatatatatgtacctataggcatcaaaattttatattaaagattttaagtaccattaaagataaaatatgatacctccttgtattttctaaagaataatatatacctaaaataaactaaagggttttcccacgtgattccatagtgaactaattttttaaggtacaattggatttcttatacaaatcttagtgtctgtgtacataaaatatataagttgtatgcagtagatcctaaaaagagaatttgattttatatacaaatttcatattctattttcatagatactagttgaatgcctatgctttgctacggataaaagaaaatatattataatattttctaaaataaataaaaatatcctcgcaaaataaataaataaataaataatatatttttcatgaaatgtgtaccaatttagattttattgtgttttatatgtagttatccatttagagttgattgtgttttcatattttaaaagttcagggataatttataaaatttacaattggagtatgtagagtgacaaatctactatcaccaccactatcttttcctttaaggatgtatataaaattgcacgattttttatgcaatatgtctgttaacagtgaaatttggtaagcccaaagttaccatcggcttagagtcagtatcggcttcaaagttctagaatcggccgatgagagtcaagtcgccacgatgtcgtgttcttggtggagtcggatcagtcaaaggaagcttatctagaagagtctgagttcaagaaggatgcgatatgacagtttatctattaattaggcatagtttgttagtttccttttatctttaggaaagtgtgtttagtgtccaataaggactttatcttttcctttttagtttctagctttcttgtccgacaaggactagtatctccctatgggtataaatatgtacacccggggtcattgtaatctatcttcacgattaatacaattcggcgcatcgccacctcttaccttttctgctttattttatcgtccggcaggacttggaacctgatgcggggctgcatcggtgttcgatctccggcgaaggggtaagtccaatgttccgtcggcccaggcaattgtatcgtctacgtcggcatcgttcaaggctacatcagtacattcgacctcttggattgctctagtttggatgatatatttgcctacctatttatcatatgtctttgttaatctatatcaatttagctctatcggctgcttctcgttttagggtttatgccggtatcggctaaatcgcattgctagattagattagcctaggcatctaccaccctgaaaactcagtcaacagcttgattgtctagatattatgtttcttttcatacttagtgctgcatcagttaagtttgatctactaagtcgagcttagaaccataatctctagccagcttcttgattgccaataagggtttcatcggggtttcaaccgatgagttatttggacgttgcatcggctcataaggattgcatatacatataagttggatttagccgatgacaacaaaggtttcactgtttaatctaatcttgtggatttcatgacatcggatctacagccgatgtgtgctttaaccttcggatcgatgcttatttatcatatcattgctagccgattggtttatactggactatattgttatttcattacatcgtcatcagtcgattgcctttatatcattatctacattagacattaagccgattgcttaaaccctatcgctatcggctggtatcggcattggctattatcggctatcggctggaactgctccattggcttgtcagccgatcggctgttttgatctactattttcatatcttgtcagttgcaggatcaaactgactggcacgcccacatctcatcaatctttggacctgcacaggagttaagcagatctccctggccggtgtgttcgatttttttcgtcaacaatgtcttaaattttttttatcaacaattctaggaatgattgtgtacatttatgtcaattaattaaatttgttcttgtaacctaggcctacgatgaaattttaattttttttcccatcccttagatgataatttaatgattctcataactgacctattaacttattacttatcacatcatatccaactactggacaataaactattctaatataaaaaatgtataagattgcatgaaataaacttgtaaaaaattacaaatttacatgaaaaaaattaaacttagataaaactaaagtaaaaccacatataacaactaaatttgcacattgcatggcaccaaaagtttagccttagccatgtgtgattttcaatgatagccaaaaactttgcaaatgtttgtaaatcaatatcgtgaatctttctctttcttcaatgaaaccaagcttctaaagcgaacatgatgaatctttatcatctgtcctatcgacgtacacactccttactataaagaatcaaatatgactatgaatttagacaaacacatatctagattcctagttaggatttgaattttttttaacggatgaaataatagatagatagatagataggtagataaatactccatccgtttcatattataagtcatttgacttttttctagtcaaacttttttaactatagaaaaatatagtagtattttcagtacaaaataaacatattatcaaaatatattcaatgttagatttaataaaactaaattaatattttagatgttactaaatttttctataaacttggtcaaacttaataaagtttgactagtaaaaaaaagttacacgacttataatacagaatggagggagtatatatataggtatggatggatgggaaaatgaacctctcgctttttttaaaaaaaaacacacacacacatacgactttaaatcgatttaaagagagaaagatgttgcccttttatggtcactataagactatagattgatgagactacttataatactccacatgtgctactaacactataatcatttgaacagttacaaactaaattaccggatccggagtgagcaaagtttattacaccggccacacaagagggcagaggctgatcttacgtgtacactagatgactccgatgaatggatgaaaaaaaaatatatattgtcactagaccaatcttcaaatgttgaagtagtaggagtattaattaagcgtaatgccaattcagttgataatacgcgtcacatcagatcacctaaacaaaagggattaacaaggacttactccatccgtcccaaaataagtgcagttttacactattcatgttcaatgtttaaccgttcgtcttatttgaaaatttttatgattagtatttttattgctattagatgataaaacatgaatagtattttacgtgtgactaaatatttttaattttttcataattttttaagacggatagtcaaacattgggcacgaatatccacggcagacagaggtagtaccgagttagcatcaatgcatgtaggagtacacgtacttaggccatgtttagttccagggtaaaagttttggcgtgtcacatcggatatacggacacatatttaaagtattaaacatagactaataattacagatttcgcctataaattgctaaacgaatttattaagtctaattaacccatcaataaccattgtttactgcatcatcacattgtcaaattatgtagtaattaggcttaaaaaattcgtctcgcaatttaattaatctatatatttgatttttttctaatttaaaaagctagtaaactttttttttctacgataaaaaatgtttacgttggaagtaaacatggtcttaccccgtcttgtgcgctaggtactagctaggcagtttactatagccactagaatatttgcgcatcgccgtggtgcctgctgtcaggggccaggttcgttgcatcgatcaaataaatatcaattcacgaatttagtcgactttcttttccacgtacccccccaggtaaaacatgcgtccagtcttataatattaagatttattatattatcttttttcatttagggttattttttagtttgatgtcaacatatgccctaccaaattattgatattttaaatagtagtttgactagtgtttagtttgctatcaaaatgtatcaataagacgtataagttgtcaaaacattaagggtgtgtttagttcacgctaaaattagaagtttggttgaaatttgaatgatatgatggaaaaattggaagtttttgtgagtaggaaagttttgatgtgatggaaaagttagaagtttaaggggaaagtttggaactaaactcgacctaacactatcaaaatttacctatagtttagcaatgcaaatattttgacatggtggcaaaccaaacaagtgcttactttttgaggaagtaggcaaaggccgagtttagatataaagttttttttcaaaacttccaacttttctatcacatcaaaaacttttcaaaacacacaaactttcaattttttcatcacatcgtttcaattttaaccaaactactaattttagcgtgaaataaacacacccatagtataaacaggcgaaatgcccaagctactgtcggcctgcaggcatgctggtctgtggccggctggatgtgggacgcacctggactgccggagatccaggttcacctcctctcctcccttcacttttgcttttcttttgtgcagtgggggggggggggggtaaagcctgtgccaattcttgtttatgcaccaagagacatgcacagaaactttacttgacacgtgcatgggctgaaattttggaggattatccaaacaaggccttacgggtgggcctaatattgcacgttctctggaatcccgttccgggccaaacaatcacggccctacacgcttacgagtgtcagagatgggctggggtccgacagatcacggcctagcagggtagcacgctgcatccggcccacaggagacctcaccggcgttgagaaactgtgccggcgagatgccgagatgtgtgcttctgaatccgagtcgctcttgtcgtagagaactaaatgcgtgcaggttgcagactagcttgcagttcatgcaaatgacgtgcgtgcactttgaatcatgaatggtaattgatctgtgtggttcaattcttctctcccctcgatcgatcaatccagacaaaagtttgaagaacttttttttttaaaaaaaagagttggggagagaagggttttcatctatacggcgcgaacccccgaagctcccgcgtaggcggagggagaaagcctcccccaaacatggctggcgtaatgcaaagcaccgtcacagtgctacacacacgacgcagcacacgggggtttgccggcaagcctctccgcgcaacccacctacgcccatgggaaaaccggccctgaaatcccctcgattattcccctatatatcgggctccgccggagagttccctctccggccaatataaatatcatcccatcggggtggcgcacacacgcggcaccggcaacaccgcgggacgaacgcaagccgcgggtgcacggacaattgccggcggccaacccacccctcgttttttaccccgtcgcggcgcttggctcgcgacttgaccgggcccagttgtgtgacacgatggaatttttgcctgaccccgacggctcaaagcgccgccttagacgaaacccagatggggtgctcgatcgatcggccccctttgtcgctgctccccaaccctaccctccgaagccggagttacagacctgcgctactaggcccggcgatcggagatgcgaagggcgcgcgctttatcgtcagcggcttccgatcgaaatggcgaggtgggacaaaaatgtagcggctgctactcgatcgagccaatcgggttcaaacttccgcggcttgatcatgccgctgtataagtctgcaacgctaagagccatggccattagggcagtcccaacccatagtgtccatatgtagtgtctatagtgccatgtcaataagacatcacaatagaaactacactctacaacccgtggtttcttaaagtgggccattaataaatacatcatctctcttctctaccaatcatatttattcttcatctattatgaagacactattctctcccaatgtaaaacttgatagtgtctaatgcataggttctcatgttgaagctgtgtcttgtatgagacccagtttcttcctctcttcactctctcttaattaaactagtgccacataagctaaaagtcctacatggcaatatatgctatagataccatcctagatggagggttgggactgcccttacttatttacttccaccagggtgatgaaatcggaatgcaagctagcgtgggattcccatgcatgtgctctagtttaggcagcgtcatgtgttcatatttcatcagtcgtatgggacacagaccgaaccacaggtttcagcctttcaaggcgcaaaatattggaatccaacgctgcaccaatgaacacggtcagttgctctaccagtccaccttatctaattacagaaaaactacctaacggcatcccgtggagacggaataagtggataaccatccattcttatccattgtctttctgtctctctctccccgatcctcgcttcgtcgtcatcctccgccccactctccctccgtaacttctcttttcgttcctagtaggggttgggacatgattccatggcaagccctttaacaagatcagaattgtccagtatttcatttgctaatgtcgcgtcgccgacggtggccatggggctctcacatgccaggtccgggaagagatgcaacgatttcaaggtgggaggtgagttgaggtgtgtcgcagacgcatcacacttgtgtgggtgtcaaggatatgggcaacgacgctccggatcaaggatggcaacgataatgaatggcatccctccacctctaaggaagtagccatctcattttcacgcttgcctttgccttttttcctttctcctcatggctctcatcggtgtgaagacatggtactcgcagagtatttgatgcatgggtatcaagttcctgatacctaggtatcgagtaactggtacccagattatccagattagtaccataagtaacagccctgatacctcaggtatcggtgtaccaggtacctatatcagtctagcacccataggtaccagacctaacactggtatcgggtagctaggtatcaagtacttggtatctagatcagtctgataattgtaggtaccaggtacctagattggtctgacacccataggtaccaaacctagcactggtatcgggtagctaggtatcaagtatttggtatctagatcagtctgatacctgtaggtaccaggtacgtagatcggtctcacccataggtaccagacctagtactggtatcgggtacctaggtatcaagtactttgatatctagatcagtctgatacctgtaggtgcgttttgatgcgaaaaaacacacactgccctgaaagatctacttaacttcagtgcaggtccaaaatcttgcttttaggttcgtgagcgtgccagttgatttgatcctgcaatcaacaagaaagaaagacaagaaaaccgcggttaaatccataaacaatagccgatcggctagttgccgatgacatatcatttatctttgagccgatgtcatattgagatcgatcggcagttataggaaaataaggtaaggctaaatctactcgatatatcggctgtagatattaacgatatataatccttccgtcgatgtatatttaaaccaagtgattgggatatatcagtcgccatgccgagacagtataaatcacttagatcaaagtatacattaacacaaagattataaacatttatagcatagccgatcagatagatctagcatgtatcggctaatactccgataccactctatattaagatattaaaacaggtagaatatatcaaacaagaagcctaatatactttaatacaataagatcttaatacaaagggcagatttagcatatcagtcaagtatataagatataaagtggctaaatcaggtaagatcggctaaaaccccgatgctatctctctcgatgatcataaagcaagccagatatcataattatatattacttaatagatcgaactcaaccgatgcaacattaagcataaagacaagtataagatctaaacaagatgatgaaaatctataagagatggtagatacatgatataatctagattaataacaaaacataactctaccgattgcttcctaacagtaagaaccagtcgataacaagttatagagcgcaattaacagaggttacaacgtgtatatgataacttgatgaatcacataaacaggattagagtgccataaagatggaagcactaatcccgagaacgtaaaccgccatgacaagtttacctctagttgaagatcgaatcgatgtagctcaacccgaaagtaagaactcgtcgaaatagaacgaaagtaaaaagggtggcgatgcaccgagattgtattgaactgttgttaattgattacataggttcgggtcatatttatacccgaaatacaaaatatgtccttgccggacacgactcttatctctaacaaactctaagataccataagtctttgcggtagacttttgtccaaacatatctctaaggaatttacacgaaatgtcctaattaatagatacaattgcctatcgagagctttatctctatcgtggcaatcctcatgaagcacattgatcgattctagaaacagctctaaagccaccgccatcggaatcggctgcatcatctctatcggttgtcctctgtccgatccatctcagccgatgtcatcgcagccgatgcatactctgttcttcgaatccatctctttgcgaatccgccttgattccaatgtcgaacctggttcatattttaccaaatttggccattaacagtaccagacctggcactggatatcaggtacctaggtatcaagtacttgatacctagatcaatataatacctatatgtatcagacctggtactaggtatcgggtacctggtacctacctggcactgggtatcggatgcctaggtatcaagtatttggtacatagatcagtataatacctatatgtatcagacctggtactaggtatcgggtacctggtacctagaccaatctattactcaaattggccctggtgttagcatcataacaatcgaaacaggtgcgttgtgtctgagaagttgtgcacttacgtgtggtcccttgtgaggacacgaagagacgtgggctgacacatgagccctcacgtggggtgaagttgataaaataataggagaggttagttgctcaaatagtcatactcattaaattatctcgttggaacggaagtccgtgctctagtagttctctaataattaacacggcatcagcatcactcatagcaagaatcgatcaattattcaattgtattcgaattcagatgtatggctgaccgggaaatctaaaatgaacgtggcagagagggggggggcgcctcctctccccggcgctttttcttttttcgggatttttttcttttcaaatctcagccgacgcttttttaactttgtaatgtattttaaaatttagatctttcatctcaaattttataattttcaacacaaaattaaaaacttgaataaatcttgagttgaaagtttttagattttgacttcaaagttaattttaaggtcatagtttttaaattttgacttaaaagttcaaatttcaagttgaaagttttaagttttgggtatgacttttaggcttttaatagaaagctttaaattttatttgaaactatcaaatttgacgtacagatttcttaaacttttagtaaaaaaaagaagaaaataaccttaaaggttaccttaattatcgtcattatcactgtccaaaagaaatgttaccttaattatcattattatctcctaattttattagttacactaattatttttaattaccgttattattcaaactaattcggatatatatgcacttttccgcgtggcactggggctagtgtggcttagagcatatacaacagcagactataaaccaactataaacacatcttgagaagataaaagaggagagaaaagagcagcgagctgcagatttatagaattgtggttgatcgggacgaatatatcggttagaaaagataatgttggtcggcaaaactataacactaccatctgatgatcagttggcaaaaatatgtatgtggcctttgccgacagatccttcgttggggattttgtgtcatggtgtagtctgcatggccaaaggcaaagaacaaatccaacccctatatggagcatggttcaatctaggatttgtctttgcttttcctcgaatctattaactatcgtggacctccgtctggaccagtggtttaactgaaaaaactagaaccaactcttggttcggtctagttttgtcaaaagaccgtctaaacatatgaacagtaaaaactagccagttgatctagcggtttaatatagaaccagtgaaaaagctgaaaggccgccctccaaaaccaactgagcaaagtttgttgttggttaaatatataaaatagttcattatctctctgagtaattcataagaatctcggttggacttgtctatatctgtcaatctgtgtgtgaatgttacattcagttctcatcgatttgccacacattatttatacgtagattaacaagattaagactgtgtttttctctcaactttccagcctctactccttcatttttcacgcacacgttttctaaactactaaacggtatatgttttctttacaaaaattatatataggtaagttgtttttaaaaaatcatattaatttattttttcaaagaaaatagctaatactgaactaatcatgtgttaataagtcgcttcattttgtgtacacgagagatgagttcttaacttactgagaaagaacgcaaccttaacaaagaaaagaaaagaaaatgaaaaaaaaaaaagagttggcgagaggggttgaaagcgcgtgagagagcccaaggctcccaaacccccaacggggaacggggaaatccccggcgtgttagttgtatttacacgttaggctcgccggaccggaggcgccggaggcccatgtcctcaacggctcacaccggtcactgactcgattactacaacaatggttaagttgccggggccagaaggcaacgtttgaaccgcgggggggtgggtccggagtccggacgctgcgatctgaccctgggccggagacttctcgcgccaaacaaaccacgagctcgggctccgccaccgaaatggcgtcccacggtgagccgagccttgccctcgccaactctaccctccgaagctggagtgacaggcccgcgctaccagacccggcgaccgagtcggggatgtggccg

SEQ ID NO: 70316 - DNA, 11216 bp, Oryza sativa
  unsure (1)..(11216): unsure at all n locations
gactccgttcaacttccaaaattcctcaaatctcgagatctatctaatggcacgcttagaggtcaataatagggctttattttcgccgtttgctgagttgtcccgtttcgcgtgtagtttcgaagcccgaagacccgcagtgcgaggatttcgaggatcaagctcaagatctcgagcgaggcaagccacctttgaacatcttgagcttatatttgaacttaattatgttgcttgaaaaatattatgcattgataggatcgcacttaatctgcttgtcccgtctgcaaggcagattggcggacctacctaatttgttgcatttcacccctccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccagggtggtgtcggggaggacccctgggcttcctggcatagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcagatgtgaggtgattcctagcgtagttttgtttgactactgccttgtgaaatttgctgttgtggaatgggtttgatgtttggaaaatctgcggctgatgggatcagccaggctcgggtggccgtttgaaagctgttggccgggtgccaaccttgatcgattcaaaagactgatacattgcacatactccgaccggacgagacgcactgtctcatccgtgtcgtttgagaagcactcccttagttgtttcagaaaagagtttaaataaaatcaatcacaaaaacaacaacctttccttgaagcctgcattaaacacttatttcccatggcttgctgagtactcccgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtttggtccaagtcttggctttcggttccctttgtnatgcangtgtgagctcgggatctgtccgcagcctaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacatatctgctgtgagagcaagtataatagtaggctataagccggctaaatgctaaagtgaaggagagaagagaggagagagagaggagaagcgggctataaacttacatccggcttggacataagaaccaaaaaactttatgagagagacaagtgggctatgtattaattgtaaagagctaactattatatgggtaggctaaaaaaaagctacaaagaaccttgtagccaataggtcggctgtattattagcctttctctaactctcgaatgagtgcatcttctagttcccatgatttgttaagcaagtgtgttcgtatatgtttcccaaaaaaaaaaaacgtgttcgtatatatgctttgcaaacggccggatatatacacagacctgttcatagctgttgtgattatcttcctagcatataacgcggagcgctcggcgccgcatggaaatttctgtcatataaagagacgaaatcttcgatcggctacacgcctagacctgctcgacggtggccatggtcctctgcatatatgaacagctcgattttgagacccgccattattgatctggatttttttttcgaaaattattgatctggattagttcaacttcaacatgccgtgcgttcacttcacctcagcataactttgatgcaggcaggacaaagaatgcttccatccattcacaaactttctcgattatttaaaaatttcaggtgttataggtccatcatatatcaatatatcatatatgcaagcttctgacgctggcttaaaggtctaatatttcagtacaaaaatcctcactgtctccttcggggtaatcacgaacaccgactaagtcttcgttgcattggctttctgaaaattcacgaaattaatttccttacccaatccacggtggattcttcttcaacgccattgtgatggagtgcaattcagcagtaagaactaaggaccaatgtagcctcaagacagtgtgtctctttcaggatgtcgatagagttggtgaagacttgatctttttgttgcatagcgaagggcgcgaggtcataccatgcaagccttggttcttggaacaaatcattgtagatatatagaatggaccaattcagtgtggaagatacagtcattgagctaacaaattaaagggccaaagtggtagtaagtgtccatttctgcaacagtgtcactttgactgcaattgcaaagggatggaaattctagttgggcatatagagccttcacttgctggccttattatagctataggtagtggaaattactttgcgaaggctcggttctgacctccgacttaattctgataaacaaaattacaaaatcacggaggagacgagcaatttttggctcaaaattttcattactagctgtgaagttcatcgtctctctgcagttcatcagtgatcatcgagacatctgaggccatatgagtacaaagttcagggacagagctatatcagaaatctgctcaagtaaaaaaagttccagcaatctctctcaatcagtctcgtagcctgtacatctccgaaagaatgacgatcaaactacaatatcttcctagctagagcaactatacacatgtggagaatcaatcaaggaacataaaacagtcctatggaatcaaaagatccactgaataatctatgactcgtcggcctccggtatgctttgcagcgacggccgccagcccgctgcctcctgctcgtagcaaaccttgccggagctgatcatctctgccagcaccttctcgaccggccgccccttgccctcgccggcggccttctccagcagctcctggagctgcctcctcgtcaccctgatcttcacctccacccgctccatcttctcgaccgccgccatctcatgtagatgctgctgctgctgctgctcctcctcatcctcccactcgccgtcgtcggcccacgatgcggcggcgcgctgcgacttgaagcagttccccatacacgcagaaattcagaactgaagagatgcgagatgatcgatgcgtgtatctcagaatctgaagccgcagagctttgctttgtactaggcccttcgctagagttgcttgacggtgctcgggttggtttaatggttgctttggttgcctccgtttgtgagagcttatttatacgtggatgctgggagaagaggaggcgttcagcgcgacgtgccaacttggacctggctggagacgtggatgcgtaggcgtggagaccgagtcgcgcggggcaccaccgagcagcattccatcgggccacgtggacggccgggacatcgagcgtgcctcgcggggagggcactggacggccgggattgggcggggggcgagtcggtggtggggacggcgcgagtggcgggcgtacgtggtgggaaagtggcgggaaaggggaatcttttcagcgcggaggaaggcctgccggtatgaacacggcttttgcaggggatctcccagcgtcgtcgtggtcgtactgatctcgtatggaagaactctttgatgaagccatcgccgttgggatcgggattcctctctccagcgccaatggtatattggtatcgccaactaaaaaaaaccgtgcatatttcggaacggcacttgagaagttgagatcaaaatccgtgccgtgatgtctaccggctacccgccgccatcacgagcagttttaaattgcacctctcgcctgacgttttcgcaggaaagaacgaaagaacatcaagtttaaagtgggtgtgatttgagatccatgttgaaaacctcataaagtataataaaaagcagctggtgaaccatgtctaaactttaccaggcttatcaccaagctagtgtgcatatttttttttctcaacaacttaagattttggatgaaatgattgcacatggtggagcttctgttctatcgatctcagcttctattcttttctcaaccaaactttgtgcattggtggtcctctgtatcatgtagctaggcagctagctcaaaatttgatttgtgactgaatctaacaaagcaagaactataagtctaaaaatccaaatcaaacaaccgaccgggtaattagtactagcataggactaccatgcattttgcttgtctccaaaaaatatatgtggagatagattttctttcctgagaggacattcacgtttcttgaatgacacttaaatagtcatagaaagtttcataaaagaaattaaaaaaatagatttttatgagatatatcacttaaagaaatgcaatgtcaaatttcacttctacgagttgtgatggaagaccaaactaaactgaaactagtatattagtatataatacattcgtattaaatattttatttttttacaacttgtaaaagtcaaattaaacctacatgcctgtgaactcatattaattaacttgtcctttttaacttttcatgactatttaagtgagataaaaaatgagagggtgtctccttaagggaatattttttttctaatatatatgcatatatgatggcctttccaagcttccatgaacaatagaaaattaggccccctttaaaacaaatggaaaacatagaaactctagagaatttttattttatgggagataatctatggagtgctttaaaacaaaggattgattccaaccaatctatttaaaattcctatggagtgaactgttatagaaatttcggagagaaaaataagcataatgcccatatgtttttcttctcgtgtcttgagtttgtgtttttcatgtgtgctaatcaaacgataattttgagatgatctgttgaaacaaatttcacaagatttacggagtaattttgtaggattaaaatcccatagaaatttcatctatttgccttttcaaaataaaggattggagtttttcaaatcctatgaagtttcttagaaatggcacaatgcatatagattttagagaaaaaatagtaagagctcgtacctcttgaaaaattttctatgagtttatctctcatttggctactacatttttcctatggcctattcatataatcattcatttattttcctcatgttttctgattctctattttacacttgcatttaacatgtgtttgttcaattcttccgttttcttaacactacgtttaaaaaaaataaaaatttcgtgtgtcttaaaatcctattaaattctttgtgaatattacattgtattcatactggttttcccttcacgtcttttgataatgctatgtttcaaacaaatccttaacattgttacaagctagcaagtggcaagcttccacggaattaaacatttgtacgtagccatttatgtggagacttcctctttaagataatgcaagctttatgtgcaggctttagctaattccgcacaagaagtctgcagacgcagacgctgaagtaccattgcgatactattatgtcatttctgcgtcagcctagacccttttccatgaaactataattcgtatggcgaattccaccagtttttttattctcacctaataattgtttcatctgttaaccaccagctgcattgagctgatcggaattgacactttggtggacaaaacaatttccagagccttgttgttgggtagtggccgggagagcaacgtacaccatctatccgcggtcaaaacgacagcaacgccaccactaattcgaaattaaatcgattgattggcacatcgagcaaccctcgacgcagacttttgtcttgtcaacgtgttggtgagagcacctactagtgtgcgtcgactgatatctgccccccatttactttgatatatgtatagaatttatggaaaatattttttacttgcaagtgcttgcatccatggccagcagctcaaaatgtatggattaatttgtggtgaagatggcctttcaaacttaatgctcagatgtgctgagttgtttgggtcaagtctcacaaaaaaaacttataaatgtttagtaataatttcgtagtttactactactatgaaacattttcgttgcgtctgggtttgttttacaagctggaaaaacaatgactacctaactgctagtaggtaactgaacattttgcgcatgaaagtgttctcttgaaaaactaatcaagatcattatcttcaaaaaaaaactaatcaagatgtgtatactactgtttcataaaaaaaatcatccaaatgtaggataaaattagcttattctcgcctcatggagcaatcaagtgaacaaaactgctctagatttttttaataccgtgttgaaccaaaaggaagtatagtaaggtttctgtttagtccaagctctgctgtctgcatgggtaccacaactttaccagggagcagtagagcacccaatcattttgagcagatctcgttgaccattaagaaactactacctccgtctcaaaataagtatagccatgattttcagcgcccaactttaaccattcgtcttatttaatttttttttaaaaaaaattaaaaacataagtcatgttttatcatcttataacaataaaaatgctaattataaaaaaatttcaaataaaacggacgatcaaaattgggcgtgaaaacttatggctgtacttattttgggacggaggtagcaatgcacgaagggcacttaattgctcccatgatcatcatgcattttcacatgaattaattctccattttccatgtctcagtaatggattgtggacgacagatcatcttctttacaccgttgtatctgtcatcacttaatcatcctactaatttacatcgttcgtggaatctgagctaggagagaacaacaacacccataggtcacaaaaaagctgtgttccatcgaacgaagctgcaaggatgcagccagagaaaagcaaacgaagttggccacgccactgcaggacgtgtcatgactccatggcggcctccgggatgctctgcagcgcgggcttccagtgcgccaccctgtagtgctggtggtagacctcgccggcgttcatgatgtccgccagaagctccgcggccgaccgccggctcttccggtagacgtggtagccgtggccgccgccggcggcggccgccctcttgtccaccagctcctgcagctgccgcttggtgatcctgatggtcacctccgtcatgtgagccccgctcctcggcggcgcggtgccttcctcccccgactccggcagctcccactcgccgtcgtcggcccacgacacggcgtgctgcgtcacggcgcagttccccatgtatgcgcagagatgatcgagatgatcttctttcctctttctgggttgatttctttgctgttgctgcgctgctttacttccggtgtcggagtaggtgttcgagatgatctttgtgtgaccgattcggaagggaggcagccgttttatagtttcgaggtaacccgggtcggtcgcggctcccatcacctaaagttacgccgatgtggaggtccagtccaacgtggacgccgaggtggacggcggcgggtggtggcccccgcgcgggcggtggtctgaacgcggggacgtgggggcatctcgcataggtgggatcgcgacgcgcggggtgggaacgcggcttttcgagggggattcccctacgcagcacgggcgcggcacgagccacaggcccacagcgaccccaacgtgcggtttgctttgagttgcttagccgcggcgggttgggaggacatcgcgcttggtttggggctttgggccgtcgtgatcgccgcgtgctgttcccttggcgtctcgtcggtggcgcgcggccgccgaccggctatagtgcgtgagattgatcggcggcggtgaactggcaactcacgtttgacacatcctgtggcggtttgcccatgattggggtgtcgcctcaattagttcgtgtggttgatcgttggcatcggatctcgtcacacctcctcccgttaactaatcacgtcaattaaaaacctgatgcaactgtgaaccaccgcaagaattttcctctgtagttgagacttgatactcagggaagggatgagctaggagttccaactccaatggtacaggacatgcttccgtgtcggtggcgttcatgttcatcccgttcatttccaccgctagagcgctactgtaggaacgatgcttgcacttggccgggtggcatgaactggcagcactccggcacgccgagccactgtgggctaacacgcaagaagttcgtatcagaagagttgactcaaatgattgcacaaaggagtagccacgaagaaatttattgacaactcatgtctttggcaaaaactagatttatgaggctcatttctttcacagctgtaccacctccgtcacatgatatagaatattttaaaattaaacgtaaatattaaaaaagataaaattaagtaataaaatattatgattagttgagaagtggagacaagtgaactaaattaaatgataaaatattaggattgaaaatgttgatggataagttgttatattttaaaataatttttaaacactaaaagttattatattttagaacgagaggagcgatatttatgtagtgttttcatggacaaaaggaatttgcactgcaaattcgtacgcactttggtgagtcgatgtgaacggaatatctcttgtatctgatactctgatgcgtcagcgtattgtgttgtgtgggcttgtagcatccttccaccaatctggttcataaaccgtgtgcgcttcaattgtcccaactcccaaagcgtacaagtgcgcgtagaaggctgcactagccactggccgtctggttgtgccgtttaactttgacccactttgctctcggcttctcgctacttgctagtgcttgtaaacagcaaactctcgcttcaatcttatcgaagcttagccaacagactgtacacgtcgtgctcgcaacgtcatggctcttttgtgtctcttcttcatccatcaaatgggaggaaaatggtaaagtaaatgctacgagaactacagacgacagatgtttcaggattggacactgaaaatcagaacaaattaagccccctttacactgtacaaattacaaaaagatgcaatacgtacgtctcttgggaccgaaaatatagttggaatctgagtgatacgcaatatcacagaaagttgtttgttacaacaagatatgttttaactaagagaacaattggaaagttgttttgccgaaagatagcaattggaaaggcgaggataatgacactagagaacaattccgtttggtcgactaggtgcaacaacccaactttgtcttttaactaagagaactagtttaagaaaattctccaactttgggtaacgtttcattagactggtgcactggcatgggttaattaaaaggactggtgcactaactgcgccttgcaaatgacaaatggtgatgcttgccaaatgccaattatatatagaacttgttcttcagtaatattattgattctgatctactcatgtacacagtgcaatctatagcatcatttcctggcatcactattacaacattaactcgatctagagaaggaaaaaaaaactgagaatcatttttccgattggcggttggtttcatgtgtgttataatagcattattttgatcttttatcattgtttatgaccatagagggcataaagcttgtaaatttaagtagcaaatcatatcatgcatgttgtcgagttgaactctaaaacgtactttgcaattggagaactttagcccggaacttcattcagcttcagcactgccaatttatttgtctgtttcgggtgataaaatttcactggaataataattctcacccttcattcaattcatactttgtatagatgcatacgcaaaatctagccacatagtactctcttctctcggcccccgcgccgccctccctcacgggtgacacgggaggcgaaaacaatcggcatcgccgctcccccctcctccctctgccgcccgagcggccgccggcaaagccgcgcggctgcaaggacggcggcggcggggcttcgtcgcctttgtctgcctctcctgtcggcggtggggggccgcgcgagacagcaaaggccgcccagatccaggccgcctcggctggatctggcggggaggccgccggcggagggttggcctgaggtggcggcggcaattggtggtggtggcggcggggattgaagatagcgaggtggcagcgacagttggtggcggctggcggcagggaaggcgacgacggcggcgggggcgacggcggcgtcggggatggtgagggggcgccgccggcggggatgaagatggtggcggggatggaggtggcggcgaggttgacaacggcgggtggctctggcggcgagaccggcgacggcggccggatcaggtgctgcaggccattttggccccccggagggcggatctggcatgctgcaggccgatttgcccccctccccccgcatggcaacgacgtcggggcggctgcattggaggtggcgacggttttgcgacggcggctgctggcgtct

SEQ ID NO: 70317 - DNA, 1038 bp, Oryza sativa
tggaatgggtttgatgtttggaaaatctgcggctgatgggatcagccaggccccgggtggccgtttgaaagctgttggccgggtgccaatcttgatcaatttaaaagactgaaacattgcacatactccgaccggacgagacgcactgtctcatccgtgtcgtttgagaagcactcccttagttgtttcagaaaagagtttaaataaaatcaatcgcaaaaaaaaaatagcggcctttccttgaagcctgcattaaacacttatttcccatggcttgctgagtactcctgtactcacccttactctatataaataatcccccctcagttgctgaagaagacgaagcggatcccgctgacgaggagttcttccaggagcaagccggctacgatgagttttagggtttcggcctagttcccaagtcgcgcctgtgatgtttggtccaagtcttggcttccgcttcccttttgtattgcagttgtgagctcgggatctgtccgcagcccaacatgactgtactcctactctataataaagagacctctgttgctgtgatattctgtcttcctgtgataccagcgctgtttcctgggactggtatcaattaacaggttaatttggagcgtcacgggctagttccggtcgggactagttcggggcgtgacagtgggtaggagcacgggtggggtgcggcgaatttttttttcgtcgagatgattttcgcaggtgggtgattgggccgcctgcgaaaattatttttgcaggcaatggcatacatgcggatcgctcccccgcctgaaaggttcagttttggcctcatggaaaaaccatttttctagtagtgagaagaagaaaacatacacgtacaattcgttccaaccaatagatggttgtcatgcatgtgcccggcggttagaacaatggtgggattatgttgtgatggttagccggtgaacagcagaaggcagcaacatcatcatagtcattattcgtggcatggaaaatactccatctagctagttgcagataagtgatgtg

SEQ ID NO: 70318 - DNA, 748 bp, Oryza sativa
agccactgagtaatttccatacatggaccgtcaatgcccacaagattttttgcatcttcatagagtgcaggtagacgcggatcaacttccaccactttgggaatgcttgaggtagatacacctagattggcatacctatcacggcgctcagccacctgcatgacacgagccttgagttcttgaatcttgtcggcaatctgatagcgagcacgcaaattcctgagcttgcgtgcagtcttcctgagcaagccatccttgttattaccatcaccaagatggtacatgaagacatcaatgcagtcctcgatgtcgtagaccatctcgcggatgtcattcctccacagcttctgctgtccatctagcttctccatatctgcaagattctccaacacagcattcatttcggtcaactcatggctaaggaactcaatgttcttacgcattcccttgagtttcttgcacttgttgctgagcagcatggcaagtttggtgaggagtggcgccatgacccccatggaagagttcactgctgccatcataaaaccaatgtgtttgctcgcctttgctcaatgggctagctggtcagagtggatgcctgaatggagaagcggtgctatcagtcaagcaatatattggtccatatagcctaccttaatttcttggaagctcgatcagttctcaattgctacctttggggcctgctattgattgacatgttggccattatatgttccatcatcaagaaatg

SEQ ID NO: 70319 - DNA, 860 bp, Oryza sativa
agttgtcatctaggctttcgtcgaagtcgtcgagatccgggtcgttgtagagagagctgaactcgtcgtattccacgatgtcggtggggcgcgagtcgacggtgggagagctgtagtagccatccagctgatccgtcgaaaccgtgccgagtggttggaggatgacgccgacttccctgaagctaggcgagatcggtgttgaagccgacttccgcctaggcctacgggatggagacgctgtcgtgatggagatggccgccaaatcatcggggagcttcatcaagaccggtgggtaagccccatcatcttgatctggtgtcgttggagaagatgcgatctcgcccgagtggtttgaagccgactcgattgagatggtcttggggtaacttttagccgcgtttgggagtccaaacgggactgaaatccggttctctcccgactggtttgaccccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttattcaagaagtaataccctactcctgtccggggatgaatccgccgagtgtattattgattgtatgatttggagaaaatcaacatccgcccctagaggcacccggaccccccttatatatggaaggaggggtaccgagctcgaatt

SEQ ID NO: 70320 - DNA, 4596 bp, Oryza sativa
ctgaatcaaagcggtagcagaagttctcctagaaaatgcaccagcaccaagtccagatcctgcactggcaccagcatcaccaagtccagaacctggactggcactagcaccaaatccagaacctggactggcaccagcaccaaatccagaacctggactggcactagcaccagcattaccagcaccaagtccagcaccaagactggaaccacaagcagcagcaccaaaaattttcccccaagctgtctttttcttaccagaagaagagcttggggttgccctttgtaatctcacagcaccaaatttactttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgctttagaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgagacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccgcctgccgctcagcgacctgcaagaacaaatgaaacaacgacgagaacagagagtagttacggatctgatcgaatagagaaaataaactaaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaaagtacagaatggagaggaaatcgacaatgcgaccgtcgatccggtgaccggagaggcggagacgaagagctcacggtcacagatcagccaaagagatgaaagaaaaggatagagaagagacgaccctcaagcccccagcgggagcccgctgaccctcggtgctagatccggcgaggcatccatcggagacgccgacgaagagggatggaggcgtggagggctgaggggtcggagcctggaggtggaggcggagcgggcgagcggcggatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgctgggccgtgccggcccaccgtgccgagggagcggcccaagcacggcccggctgttgggccgggccggcacgggcacgaccccagtcgggccgtgccgtgcctgggccgggccaatttgtcgtgccttgggccgggccgtcgggccccgggccttatggccatctatagcacgtccccagaaagccacgcattcgccggcgcgcgccatctctttccatcccttcggctcgtactcgtagtcggcggattcttttcttggaacatcgtcgtcgtcgtcgtcggattcctcgacgtcgacgaaggcgtcgctgaaaccgaagaagtcgtcgtcgctgctgcggttggactgtacggaggcggcatcatcgcctttgttctccgcgtcgtcggagttggattcctcgacaagggcgtcgctgcggctgccatcttcgacgggaacggagtagccgtcggaatcgtcggcatcgtcgtcgtcgtcgtcgccgccgtcgctgaagctggagtcggcgccgtgcgcggcgacgtcgctgtgcaggtcgatgcggcgccacagcgcgggctcgtcgcgcgcggcgcggcgccacgaggagcacgccaggccggcgccccggaggatctcctcctggccggccgcggcgaagacgctccacaggaggtcgctcggcagcgccgcccagtccttcgacgccgccgccgccggcggcgaggcggcggccatgacttgctagctagctagggtatttttgttgacgcagagcaccacgtgtctacgtcttcgtgtcgcctcacaaggcgtgcttatatatacaaacacgtggctacgcggaatcctaattttgtttttttaatcagctccctcccctccatattataagtttcatattataattcgtttgattttttttcaaattaaacttctttaaattgaacaaagtttataaaaaaatattagtataaaataaatatattatcaaaataaatttaatataagatatttaatgaaactaatttgatattttagatgttactaattttttctataaatttggtcaaacttaccaaagtttgactagaaaaaaccaaatgatttgtaatatgacacggagggagtatattctaatcgtgcgtgtcactgaatgtgctgtatcagaattgtattagaaacagggtttgaatctttgacgtatttttattttagagctagagcgtaataggagcaattcaatactcacgactttgacaacattcatatggagtacaacacatatcagggtttgcattacgtcggtaaccgcgcggtttttgcggttaccgcagggtacgataatagaaaaaccacggtaacctccttaaattcaaataaattttaaaaataattttaattttaataaattttgtatggttttgtacggttttccacagttatcgcggtaaccatacttaccgtggcatggtaaccccggccggcggtttgggaaaccctacaacatatacttcatgagaaaatcgaaatatcatcatgaactgacaagtgagcattggcatcgcaaaattcaccccttttgtttgacgtgtctaagagattgcagcttggggaaaaccgtggaggatccacctattatatgagtctaattcaactcaagtggcatgtgttttcataaaactttagctgcatatctccgctatatacatgtcctgggtataacacctaccaaacattttagttgaactacgtgacttgatttagaatagctacattagcgcaagctgagttgagttagataagttacattagcacaagttgcactaacaggggatattttggagagcacccaactataaaattagaagttactaagaataaaacccacattctaacaacgcattttaaaaaaacagagtgaagtgaaacaaaaaaggctatcacaacattctgcacgc

SEQ ID NO: 70321 - DNA, 7942 bp, Oryza sativa
aaagtattgaccttaataagagatgcacgccacctaatccacctgaccactgacagaattacttggaaaaactagtaacagtactgtgaacgttagcatttatcactgaatggaaagaaggaaaaaattgccatcttaaagaatgagtatgtggttttgtctattcaacttcatttatgttgcataactcatgattgcttggacttcatgctttgcttataataacagaatcagtagaagaaaattagtcacagaaaaaaagaatggattatgaaaaagaaaggttaaggatgactggagaagttgcaaagacatccttatcagtagcacaaacattctatagcaaacctacgataaagcaatccatgaaaccactcatggaaaatctagtcgtaattacaacttaatataagtccagaaactaaagtatgccacattaataaaatattaaatatatatgaatcaaaactaatcaaggactatagccctaaaagataaccagcaattcgtgctatactggtcctaatctttgcaatgtgagtttcactcatgatccacatccagggtatgaaattgattgtttagatacatgcttgccaattcggtagattaggtcaagcttgtgaagggagggctaagaggaggatctttgtcattgtctcctgtagtatgtgcgcgactgcaaataatttttgttaaccttttagctgcttttgtgggaatttgccttgttgatcacttttggtatatccagttttgttctacagtaatatacctgaaattctgaacctgccttgctgttagcttcaacaggttgctaagcattaaacagtggagctgtatttgtttatattcatttaatttgaaccatcgggaaaagggaactgctatatctgcctgtgctcatagaattttttgattgtgctgtctgtttatatagaccttgtatgtgtttactcttgattttgttttctgaaatatgcacaacaagaccttgaccaggaaaaaacgttgccctggttctccagtcctagtattcacttttttggacaattttgtttgatgtgtttttccagagttccaagcattagcatgtaacaacatgcacaatccaccaaataaaatggaaattacttaacatttcttagatgttcccaatttttaatcatcaattggaaccccagaaacggcaaacaatccaaacaagcaagaataggcaacaaattcatctcgaatgctaatgctggaatcagtacaggtaaaaaataaaaataccctaatttcagccaagcaagcgaaaccgtactgatcaagattataggcgatatcatggataatggaagaaaaaggaaaaaacttcgatacggttccccacctgttcacggcatcctcgatggactggaagggtgtcttgatgtcggggttgcacacctgcatcacgtcctgcagagccatctcaacctcagggctctgcacccttgccacggctgccactgccgcctgctgctgctgctggagggacgcccacgactgcaacagcgacgggccccaggagtggatctgctgctgcggcggtggtggctgctggggcaggggttgctggaagcggatcgggccaggcaggggcaggtgggcatcgatgttggaggggaagaaggacatggcctgctgcgacagctgctgcggcgtcggtgtgtacccttgcccctgcgcctgcgcctgggcctgggcctgctgcatgaggaagatctggcgctggtgcagctggttctgcgccacggtggatgccgaggaggtcggggtggagttcgcggcggcgtccatggtgggggcggaggtggattggctagaggagaagatctgggggaaatggtggggcttttgtttcgggcaaaatttgttaaaccagtcctaaacttttttggaaaggatacaccagtcctaaacttgccagttggatgtgactacgcagataccttttgggtcaaaaccgtgtgggtccgaatggaaggtagtaatcttttttatgtgctccgctaatcaaaacagtgccgatttagtattttaaacatgactataacattggtaaaaatggtaatatctaaacagaaaatgtggtacacgccacttcaaaacacggcgtttcatgccacccagattcttaaaattggaaatatgccaccctgtaattcccattgtttttaaacaacgcaaattatatttaacaaaatagatgattacaaccctgttattgaaaaactaccaaaactaggactgatctgccttccatcatgcatgttaacaaatagaactcctgtggcaggcagccaaccaattttcagaggttacactattaaacttatggtccaagtattaagctttttatggtctggaagaaaaatggttgctgtgaatttaacaccttgaatgccagaggcaaccacatatatcaaaaggaaacaaatctagaagcgtgtatactgtgtgcccaactataccataaaaagataatagaaaaagatctggttaatatgtgcactaaaaatttgaaggaactcaagtagtaattgtatgcagttagtcctatcgtccacagacagttagaatatttgtgttctcaaaacatatttatataatacttaataatttttgcacagacatcctaacattaaaatcttttttcccagtttttctcataaagagtagtttcatacagaacaaacttgttggtacataaattggccccagtacccagaagcaactctttttctcaagaaaatattcgcactaataggtgcagtcatatttttctaagaaatcatacaaagatatataaggtataccccttccagtgaaaaaaatatgtcaatttggacatgtcctaagtcaaaacttcatacatgtatatcttttcaaatatttggattgtaagcaagaaaaatgaaaattgtatgtgtagatttgttacagaaagtacttttgtaatggagttaggttttataaatacgttgtaaaagaaattagtggtcattgttacattttgaaaaccatgttagtgcgcaaagctccatgcaaagaatgaacaggaagctctcattgtagggtggtcattgtgcctcatacatctcttggaatgcaatagggttcctataaatgttcccaatacaatatgcccttccatagttctacctaaatcattatacaatatagtaagatccgagcaaaataaaagagttttctactagcaaagaaaatactgctaaataaagtattgaccttaacagcagatgcataccatttattccactcaaccatggtcagcgattatttggaaaagctagtaaaagtattatggacctttgcatttatcaccgaatagaaacaaggaggaaaatttgctatcttaaaaaatactgaatgcagtttagtttattcaacttagtttatgctgcataacttctggttgctctgactacattctttgcttgtatgctcattaagcattttgagcagaatgctgaaacaagaatttttcagtcactaaaatggaatggatcagggaaaagaagttaagaatgactaaaacagttaaaaatcttatgtgggttaagaataactggagttaaaacatctaagataacaatctgctaagataaagcaatccatacaatcactcaagttactacacgaagaaaccagcttgcaattactggttagtatatgaccaaaagctaaaagtatgtcaccttaaataaacaaaatccccatcaatagaaaataaccagaggcacatatgccgaaaagcatgtcacctgcaattcgtgctaaactggtcctaaattggaccacgagtttcactcatgaaccacatacagcattaacaatctgctctgtggaaaagaaaagacatacaggccaaaatgttgtcctgatcctccaatcccctaatgcccctactattcaccttttgggagaattttgtctgatttgtttaacaaggaatgaagattaatgttaaaatttctaagacgctcccaaattctaataatcgaaacccaaaaaatgggaaacgatccgggcaagcctcgagcccgaattggcaacaaattcatccggaacgcgtagcctaaatcagtatacagttaaaaatttaaagcaccccaatttcagctgacgcagcgaaatcaaatggatgaggattaccagcaaaatcgtggataataacgtatataagaaaaaaaaaagatgcagagaaatttggtgcgattcccccacctgttgacggcgtcctcgagggactggaagggcgtcttgatgtcggggttgcacacccgcatcgcgtcctgcagcgccatctccacctcggggctccgcaccctcgccgcagccgccgccatcgccgccgcctgctgctgctgctgctgctggggggacgcctgcgactgcgacggcgacggggccccggagtgcggctgctgctgctgcggttgcggctgtggcggaggctgaggcggctgcggctgcggctgcgggggctgctggaagcggatggggccgagcgggcggaggtgggcgtcgatgttggaggggaagcgggacatggcctgctgcgacagctgctgcggcgtcggggcgtggccctgcgactgcgactgcgcctgggcctgctgcatgaggaagatctggcgctgaagctgctggtgctgcgccgcggcggccgcggctgcggcggcggcggaggaggaggaggaagtcggggtggggttcgcggcgtcgtccatggcgggggagcagcgaggagtgagatctgtgggggaaacggtggtggagcttcagtttcgggcaaaatccgttacactgcactgtaacacgcgtacgttttgggagaaaactgtatggatccgaacggaaacgggaggttttgctggatttttcacaatttggtctttttgaaaaacttatttcgtaaatagacttctaaaaaaacttatcctaaaaatgattctttttgtggtgccagccactctggcgccgtccttgtgctgacgtggcagggcggtgatgaggtggcagggggagggcatcagtgtggctggcgccgcccccctccccggcgccattttttttctcttctcctctatagcgtagaggagagagatgtccaacatttttatttttatttttttcacacttatgagcacacaagaaccaaccataaaaaaaataaactcgaataaatgaaatatgtgacttgtagaattttctaaatttctaccgaaaataggtgtcattcgggtgtcatttcttaaaataggcataactttctcatacagactcgaaattaggcaaataattagaaaatggcgcggcagttggcgcgtttattacttttataacgtgtatataacacttatgacttatttagaacatatatttattagttttctagtttttctacaattttcaattttgtcaattttatttgtttttaaaactcatggaaaatagattgtacatattttatggtttatttagaacacaataattttacacaattgtcagaacggctagttcaattctcgtaaaatttatttaggatagagagtttagttttgtactaacttatcgaagattaaaatatttccaaatatcataaggaaatttgatgtatttttgtaaaaaaaaatcacaaatctgaatattttttcctttacataatatttagtgtatatctctatctctagagggggtatgtggaaacatcataatttacccaatagagtttcatatgcacacgacatagcaaaatttagtttgatatatgcacatgaattacataacaaaattacttgtccaacttataaaaaaaatagcctacttattaataagttttatcttagggccatttataaatactccaaactgagggcttatttgtaaatttaaattttttgagatgaaaaagttcagcaaaattgttttggtagaactggacatttttctttatcgtctgcataatttttacccagggtgtgtaaaaatcataatttacccattagaggagcgtacgcatatcatttagcacaattttagtttgatatatgtacatgaattatatagaaaattttaatttgatgcccattgcctcatggcagagcaaaatttgaacttgataaaattagttgcgggcaacctatcaagcaaaaggcacctctcttgctgtttttttttctatccacgtttcattttattcctcgtttcaacaggtgaaaacaatctatctattttattataaagatagcttgaaaataatacggtatttgctttgatcgcatagaaattgttacattaattaataaaaaaatataatagttgtatatacgtaatataatgattgtatttatattaaatgtcacaaaactacaattatttggttaaatctaatcatgtttttaaaatatgttacaaaatatattgtataaaagctaagaattgcaaatttaattctataattaaaatatgttgcataaaacaatagttgcaaaaaagaagtacatgtaatcctagtgatatttgcgtgtgactttcgtcgagttcgggtagaatcatcgagagtttctacagtatttggtgcaccgtactaccatactatataggttatttgctcagtgaatcatagtcgaaaatactcattatttctcatagttcttgttctatgagtgatagggtgcaccataatattcaaaaactgctatccacttagcatactcattcatcagagtagcttggacgtaacgacaagagatagaagtgcttgctcaattacatcgagttagtgaacagaacacttggtttgatgatatgattgagcttctaggtccattataatttcgatattgaatgtatatgtctgatatactatagattcaacaaacttctagttcgcgatatcatcagtcatcttggttaaaattcccgcaaataattccaatatattttacgtaattatatatatattacagcaatattaattaaaaaaataaaagcattacaaataatcaataatcataaatgcgattaataaattttacaatcataaatatctgaaatataatttaagtgtattttacaaatttacaatgtcattcaaacaaatattccaaatacagagggccatttatatattttctagaaatgtcaaggtttgaaacgcaaagtttccaatgtagaggaatatgcgattaattttcgaaaaccacaagggccattttgcaaaatatatggagattttttccttttctactcttctttccttcttccttatctttcttcccttccttctctttctttttctttccccttcctcccttgatggcgccagcgggtgcagaggccggacgggcggcggcggcgcggcgggtgcgaaggccggtgaggcgttgcggctggccgtagacgtcgtggccgggcgacattgaggacgaggccgtgcggcggctccgtgcgatgtggaggccgggacggcgtggtggggctggctgcggcttcggatggaggaggcggtggcagcggctgcggtcgctcgcgaacacggatccggcggcagcggccactattgcgcgcggatccggcggcgacggccgctcgagcgcgcggatccgggtatgtgccccacggcagcggcgcgccctttcactccctctccttctcgtccccttcccctctcttctgatccggcggaggcgtcggtggcccggttgcggcgccatcccctccgccagatccggcagcgagaggggaggcggtggcggcccggcggcaggaggcggtggcggcgtggcggcgggaagcggtggctgcccggtggcgagacgattatttagattttagatattcttgtgtgatgttttagtgaatgatttctgtgatgtttttcaatgtt

SEQ ID NO: 70322 - DNA, 5668 bp, Oryza sativa
gaattttttttttttggactgggtggagcaccggatgaggagggccacgtggcacgatgttaggggaggcaatcctggatgctggtagcgccacgtggcccaatctcaagccgggtcttggacccggaaatcgtatatagagatatatccacgaatatctacagaaaaagttacatccaattcttgcaagagactccatggagtatgggctccaatgttgggagccgttggatggttgctgatcggtttgattggatggttgctgatcggtttgatcaattgagtgtatgagcataatgggtatagacccgtttagagtgcaggttttaatagtgaatggattcaatagatttgaatagattaaaaaaggaagtaatacatttatatatgcatgcatgcagtgcggatgagagaatttccataattgcgtgtacatttcaaaaatggaaacattaattgccagtgaaatttgaaataatatcttgtaaatatggaaagttacgtgattgcacggtgaggtttgaatatatggtaatataatggtgaaaaatggaaactaatcatatggaaaattggactttttttgccaactaggtatgtaatactaaatattgatccttcgtatttgaaaacatggaaactaattattcggaaacatggatactatatatcgcagcacatttttatggtaatgtatctaccaaattattccattcatgacaccattaatttagctatttgagtcacaaaatatgccctgcgggtcactttccaagttttaggtacacagcttgacatatacacgcggacgtaacaccaatatacttcggagtgtatatactcagtgtcgacgtttgatgccgcgattccggtatttgcatggtatggggatcgttggtactaggatatacgcgagactgaggtaaaagagacggagacgaggatttttatacaggttcaagcccctgaattgtcaggtaataactctacatcctgttggccgaagccgatattgctcttattcaccataatcacaccagtataatatttggggtagcctatctaactgttgtcgacatggcggtctgaagatctgactcgtagtcgacaacagggtagttttcctcctcaaatccgtgcccggcgagatcagagatagcgcttttgtttctcctaacagtatctggagacatcgtaggggactagccgtgcctatccctgaagtcgatatccggtgtcttgtcttggcgtatgttggcttgtatgttgttccgtctatggtgggtgttgatcgtgtgtttcccctctcctcctagagggccttgtatttatacccatatgtgtccccttgtccaagtagaactagggaaaccaatatggatacaattcgattagtccttgtcgtttccatgtagaactctggtttttttttccttatccggaactccctcgagatcagtttccgtataagacatggtatgtggtgggctctgtcgagatttagtcaactactattatgtatgtggtatccataaccctgacagtagcccccgacttcaatgcaaatgagcgagttcatattctcaaccgcagaccttggagaaactgttatcgagctcacgtgactgttctcggtgagttcagagataacgttagacttcctttatcagcctcgtgcgggcacctaaagggttagtttgtgtcaatctctgacgtcaaccaagaaagtatagagcatatgactaagtctcctgtcttgctgtaatcgagaatttggattgaagtcaagaaattttatctcggccggtataccatctcttcatttcgtattccttgtcgatatccaccaaccgttctcgagtgatcaagaaggcgcagagtctgcgacggagccttgtcaacatttgtcatactcgccttagtcgatcttggtgtagaaccatagagacatgaagtcttcgacaatgttgaatagaattttcctgaaatcaacactcagaaaagaacattagataaaaatagcccccgagcgagtgctcaaagggtaacatgttatagaatgtatggaaaactgaaaatgaattaggtttacaaaccaatgttttgtatatgagcgtccactcttttaccgacttcgaccaatcagtttgttgagttatacactctccctagcccccagccttgtcgtcggagaatcgttctcgggtgataagactcttggacctttgacctgccttagttgaacaagtactgatcctagcccccagccgtgaagttggaaaatccatttccgattacacggcttggttaatacgcacggtgagaactcttacacgaccagatcttacatggtctttcgtctctgaaggatccgacaaagccttatccgctctgggcgtccccagccgaagttcccttaggttcctcagaggctttgtcaagacgacgtaaagggacattaggataggtttcaatgctaggtgtcttttgtggtaagggatctctgggcaaaacacttggcgatattgtgcacctgatatcaactctgttggagtagaggtaatgggagaatcgctacacctctggtcgaggaccaggtagtagtcgtaacccgaccacttgaagtgaaaatagtgggagaatcgctacacctctggtcgagaaccaggtagtagtcgtaactcaaccactagaagtaaatgtacgagagatcgctacaattgactggttgaggaccagtgagtaggtgtctctcaatcatttgaagtcgtggtgcgaggaccgcttgtgttattgctgtagtcgttcctcgaccatctgaggttgcggtgcgagagattgctacgtactggttcgacgaccagcgaacgagtaaaattatctctcgaacaccaatggaggttgcggtgcgagagagtgctacgtactggttcgaggaccagcgaacgtgtagaattatctctcgaacaccaatggaggttgccgtgcgagagagtgcaacgtactggttcgaggaccagcgaacgtgtagaatcatctctcgaacaccaatggaggttgtggtgcgagagattgctaagtactggttggagaaccagcgagcgagtagaatcatctctcgaacaccaatggaagttgcggtgcgagagattgctacgcgctggttcgaggaccagcgaacgtgtagaatcatctctcgaacaacaatggaggttgcggtgcgagagattgctaagtactggttggagaaccagtgagcgagtagaatcatctctcaaacaccaatggaagttgcggtgtgagagattgctacgcactggttcgaggaccagcgaacatgcagagttatctctcggacaccaatggaggttgcggtgcgagagattgctatgcactggttcgaggaccagcgaacgtgtagagttatctctcggacaccaacagaggtgctagagttggtttattatgtgcgtctcatgtggctagcttgactcacacacccaacttgtagcatatccggatgtccgttcacaatcatatcgggtgatcaagccgacggtgttcgcgaggaattgtccgttaacaaccttttctcaagtagtccagccatggccagtgctatgagataggttgtcggtcttagttggtaggttgggcgcgacgactctgcatttgttgagatcgttctcgataatatggtgtactcgaccacaacctactcgagtgctcaactgttcctgaaaaatgttttctagaaggcaagacatatagcaggtaatatcgagtatgtattcgaaaaactgcatggatcttctagtattatcaggatataacgagcagattaaatatcaggcattatgtacaccgtaacaagcatgatttatacagaagaaaatagagcgagcccccagcgttataccgtagtcgatttaatatcggggacacttgcacaatagatattgtataaaaaacatgctctaggtagacataataaattactgatctgacaatatcgtataaattagaaaaacaggtacgataaattacatataaaatattgcgtacctgtgtagatacatgccggatgtatctacaaaattagtagatcaattaaaataattgatccaccaattacctgtatcgatctgtaattatggaagatgattgggcttgagactttctaagcagacctccattcacacgtagcaaaggacatgccacatatatgacattgaccgatgaccaatcgccgagtaaacttgatgagtcctgaccactgctcggtctaataaccacacgtgtcatgcacatggcggctgggcctgtaatcctccgtatcatgtattattccgtttcattgaccgatacgaagacgatcggaaggcggacacatgattcagaagtagctctccctgtgactggcgcacgacgtggtgatgacccgagggcataatctgctcgaagcctcagcgttgttggttttgatgtcggactgacctgtaactgacattgaattggcatcctccgtggcggcgacgtggtttcaaagtaatcaatcgggccaaggcctcacgatcgacgacattaaaccattattctccgcggtagcgacatcttgaagcttggtcgatctcgccggatcgaatagttgatgatgatgattccgatttcgtcggaagacgtactccggtcgtgttagatctccccacagccgaagtcgtcgagtagtttgttgttagagaatccatcttttgaatccatctcatcaaaatcctgaagcaccaaaatgcccctacctggcgcgtcactgtcgacgtttgatgtcacgattccgttatttgcatagtatggggatcgttggtactaggatatacgccagactgaggtaaaagagacggagacgaggatttttatacaggttcgggcccctgaattgtcaggtagtaaccctacatcctgttggccgaagccgatattgctcttattcaccataatcacaccagtacaatatttggggtaacctatctaactgttgtcgacatggcggtctgaaggtctgactcgtagtcgacaatagggtagttttcctcctcgaatccgtgcccggcgagatcagagatagcgctttcgtctctcctaacagtatccggagacaccgtaggggactagtcgtgcctatccctgaagtcgatatccggcgtcttgtcttggcatatgttggcttgtatgttgttccgtctatggtgggtgttgattgtgtgtgtcccctctcctcctagggggccttgtatttatacccatatgtgtccccttgtccaagtagaactagggaaaccaatatggatacaatccgattagtccttgtcatttccatatagaactctggttttctttccttattcggaactccctcgaggtcagtttccgtataagacatggtatgtggtgggccctgccgagatttagtcaactactattagatatgtggtatccataaccctgacactcagcatatattatatatatatattatatatattatatatatatataatatatatattagcaaaagtggccgtgcgttgccccgggtgattacggagtgtgcacagtgacaaaacactgatgtttggtttagccaccccatatgctaaaaaaaatggttgtt

SEQ ID NO: 70323 - DNA, 536 bp, Oryza sativa
tatatttaaagagggtatgcaggatatcagtttttgagttataatagagagaaatgcacaatacttttttgaaacaggttcaatccctggaaggaatatgctattattaatataatcaaatttatctctactattgcctccaaagaacagggaaaaacatatatcaaaagggcccaaagaatgactcagatgcaaagcagttattaagtcacctgctctttagtaggtgctgcagatgtctcctctggtggtgattcatcagcaggtgcggcttttatgctaatgtcatcttggctttcaggatcatgctgacatacaaacccaatatatatatggaaaaatccctcaatgtgatactccctccttccaaaagtctaagacctatttcattctttggtttttccaaaagtctaactcctatttgtagtcattatgtgctaaattaaattgttgaggaacccaagaagccattttaatgcttattggttgcatgttcattggttttgtcatatggtgaatgaattaattgcttcttg

SEQ ID NO: 70324 - DNA, 611 bp, Oryza sativa
ttattgaatcagaaggttaagtagaaacataaattaatgaaatatagatgtctccttagtgagctgcgctgaataataaaataatagcaaaaggtaaagaaacattacacgccttcaaaatcctagccatctcagatgcttgaaattccaagatatcagctttcgtaggcagcagaacttagcatttgagaagcatatctagccatcataggtgaattttatcgtgccctgcatttagttgtatttggagtataattttgaattgacatgatgttgtttctacaatcctgtgcagcttgatcactggaagaaagattacaaatttgggtttggtatggttcttggagagtgaggcagtgtcggcggtttcttcggagacgcatgtacgattatagcagttggcatttgtcgacagaactaagacaattttagttttgcattcatttgttttcagttcttcatgggtttgctattgtctacggcaccttttttaattgtactggcctcattacttaaaaaggctcgattaggataatgtagttatgagatggtgttggattgcagtagcaaacctgaatataattcaaacgtgttgctcttttttttgtgcg

SEQ ID NO: 70325 - DNA, 3375 bp, Oryza sativa
tgtggtgcctctttgtgagggggatttgagaaggggagagagttggattgagagagtgaggagttgagagctagtgagcttcactccatcctttgtggtgcctctttgtgagagggatttgagaagggaaaagagttggattgagtgattgagaagttgagagctagtgagcttcactccatactttgagcactcgagttcatagcaagcaaatcttcgattgtgtttgttactcttggggactaaggtctcctagacggctaggcgttgccggtgagcacccaaggttgtggtgtgccacggaaagtttgtaaaggctttgatttcgcctccgcaagggaagaaatcaagagtgaaaccgaggagtgcatttgtgcaccctcgtgaggaaagggttgaaataggcccggcccttgtggctcctcaacagagacgtaggatccgtggatccgaacttcgggaaacgaatcgcgcgtctcccctcttggtttgcctgttcttgcattctctcatattgtgcttgagcttgtttttacccgatctacttgcatgcttatttgatttagtttgtgaccttatatcttgcttagataccttatttgtcaccttttgattcatatacattttgtttgtttgagctacaagttcatagctagtgtttattccgttatccaccgaacttttcgattgagaccggaacttccaatcccataccggaagtttcgatttgaatcaaaagttatcatcactctaatatgctatgaagttgtgataatttttaggaacacctattcacccccctctaagcgatattaaggtcctttcattccaaaaaaaataattctctttttgcgcacacagtaatatactgactaggcctctatcctaaaatcaaactattttgttcaagatagacactttacttatttgaagtgtcgaggaagaacagatcggcccagcaatccatcaattggctcgctttcttcacgttcatcatgcttctctgtgacatctctactattataagtatatccagtatcccggtgtacgaaataggcctttagtccactttcaatcctcgtttcttcaagtttgatttttcaataggataaagttcttctagaggcgcacgtggtaaataattgtgtttgaaataatattatatgtcctttggtttttctttaaacaaaagtagcagttctgccgatcaaattagatagaagaaaaatcagaaatggtgcaaaatgacatataattgtgcagactggcagtcactcattctgggccctctggggcaacactgaatccgtcactttcttggataaaattgacttgagtaatatcactgcataattctacggaagagcattttaattcatccctcaagaaaacatcatctcattttcttgcatgttatctaaaaagtatttatttttttaaaataagatatatctaataaatatgcaagtttaaattcgacttctataagttataaaaaaatagcaaatatagttgtaaattacacatagtactagttttaatttaatttgttcattttattataacatgtagaaatcgaatttaacattgtatattcatggaggagtgatatatctcacgttaatctatctcaatcaattattttttaaaaaattctataatatatatttatgcgacatgcatgtaagaaaaaagctctcgagatccgaaaatcccatatgctatgtttggcagccatacaaactacaattacaaaatcgatgcaagttgactatgtaaaatatcagccgcacacgcccataatatacaacttcttccatgttccaacacacacatcatggaataagatggacatggcaagccccgaaagctaaacccacaagagcacgtaaaagaagaggttaaatgatatcttccaaaaaaagagctctatatatatttctttgttctgttttttctccatctctattaatatacgaggtaaagcttttgccctctttaaaaaaaaaaaggaagaagacggaacaggggcaaaagtaagcggtcattgcatgagagcaaagttttttttccccccggggaacaaagagtttcttccatcaaaaaaggagctcaaaggttcttggtaggcaaatcgttgtctaagacccaaagctgcagcggcaggtttgttgatgtgcatgcttgaccaaaccgcaatattggtgagtactcgtgtctaaacctgattaaatttattgggagccaatgtcacactagaacatcaatcttgaacacttctcaaacgtgcaaccatgggaaaaggtgataaggaaggaatactgaatcctgttttatgatgtgaacaaagtggcatcaaaggaatctccggtatccatatatagagccatagaggtacaaactgcgtacacttcgattgacctcataacaccagttgaaattgatggcgattatttcagtctaataatttttatttatgtctttgcggcctttgttatgatgagggaccaatagatagggcccaaggtggcaggagagctaaaaagacaaggccggtacagccgacgtactcatcggcctaacagctgcacaaacaaattaaaatagaataagttcactttaggtcccttaatttgccgccgagtctaagatttgtccctaaccaaaataccaaatacaacaggttcctcaatttacaaaaccggatcatctaagatcctagacaatattatacccgattttagctgacgtggcaagccgagtcagcatggacccacatgtcagtgtctagtattctcttctcctctctcttctctctcccctctcccctctctctcatctcttcccacctaggtcacaaggacgggcggcggccggcctagcgcgctcacacgcaacggtttcccgtcctccatggccacgcccggcgtcaccggtgccgttgtctaggacagcgccgtcgtcctcgccaagttccttgagcgtgccgtcaagtcggtacgccttgctctccgagacgcgcgggcgctcgagctgggagtaggttgcggccttgctggctgcgttgctaccctttttggagtccacgtcctgctcactgccctccctgaccgcctcaagctcctcaggaagaacttctacctcaacgttggggacgacgcgaggggctctgctctggtcgcccaactcgtcgtggggtgatgaacctcaaccggacttgctcaacccacctttagctagattacaggtatcctcttaccctcctccttctcctcttcttcttctccttcccggggatccccaccttcatcagcatgaaccttccctcctcccggaacaatcggaagcacacgcacggctccttggaatgatgta

SEQ ID NO: 70326 - DNA, 3997 bp, Oryza sativa
agaatttagggataaaatctttgtaaacgcaaaataacctagctatattaataataatatggtttttcaagggtattatatcataactaatggaacggtaacgcaagagaattcagtagatgcaaaagttagttgaacgagagttaaggtggcaagtagtagtcacacgataaaacgatagttgtcggtgtcaaacacggtagatgtgaggaatcatatattcggggatctaccaggggctccgaatgcaaacggcatgttcgattgtgctagggagtaagagagaacatgatcacgtatacaggtttagcctctcgaataatactcctctcctggtcactatcgaagaagttcgtataagttttgggaggctctcgagctagcttagcaagccagatgctcttgccaatttctagtgtttaaccctcctacagggtttaagatgggcatttataacctacaattaatagtcatctctttctctctgacgagatacaaaacattgtgcacactcataagcttgagctacctccttcgactctccattagatctactatagtagtcgacctcctgttggaatccatgctaggcccacttacagtctcctcgatattttacgcgtcttaaaagccacgcctgatgacctgagagtgattgaatcttggatactttgtatctctttgtatcttggtttggtcttttattttgttgggtgtgtttaatttcattatgaactacactcttcgtttgagtgatacattgtaataattggctgtagctttgatgagcaaaggccggaatgttcattccattatcttaaaaaaaatacaatggacgagctctatagcttgtgcatgctcccaagggtggcatagtgccctattgaacacacatcaacatgtcatcagcacgcgagaatgccactctacccttgacgaggtgccaaggttgattgcaatatgacacatggagtgcagggttcaccctcgggtgcaattatatggtggaccgcgagaaggggtgacctgcctactccacttgatctcactagccaagatacacctagtagtcctcaggcaacccaaagtcatgtacccctagcatgacttggttcctaggtggctagccagcatgcctcatgctccaacgcaaaaggatacgtgattgttttcgagcagctctgggaacgaattcaacttaggttagttgacccaaccagagtctcgaatgtctagcttttcttggcatgtctttagacagatgatggacacgtggaccttctcgaaagaccttgattttggtttaagctatggaggtgttggcccataatccacacagtttcgatggcttgccttctgaactaagcaagatggtcaagtcgggactccctctggcaacaatattcacttgatgaagcaataggtatgggtctacatacggtaatttagtgtcattgatcagggcatgtccatcccaagtgttaaagagtgacgaccgtgcatatattaattattcataacttttatggtcattttcatgctaaatggaaaaaaaaccacctaataagagataacttttaatcctaccgatatactattcctatcttattttatcctaacttttttcactcagttttgttcatatttttttatattgcaaatggcaagaagagtaaaacgttaaccaatgtttaccgcatttttatccttacaagtttgtttcgacatgtttttacataaaaatattcttaaatatgtatcaaagagctttcaacatttaaattcggtgactattgatctatgtatagatggcgttcctctcaaaggttgctaattggaacatactcatcaatgggaacatgatacatgtggtcaaaagagataaatggggcctgataagtcagagggtcgagagtccctgataagtgaggcccacacctatgggcccataagtcagagagacacgtccctttgacgtacgtgagaggagccccaccgggacataacataataatagcactcaaaatcttttttcttcacttggaaaaatatcaattgtagtttgatcaaattatattttgaatgttatgtacttatgaccaaatcaccgaaggaagggaggatgacatttcacattttgttttgatagcacgtgtttgttactttatatcaaactagatttataaaggctaataaatcttaattgattatgaaagtttctttaagacaaatatactaataatatttttattattttaactaaaatgtatcattcatcaaagttttaaaattttgattgatcttacccaaacattgaaattttgtgatagaaaggaggaactagctcacacattggtttatcttagaaacgtgcattttttatcctcaagacgagaaacattttgtagggtgtttaagatgctagaaggatagggagttgccaattagtcacaatctgaaaaagctaaatttcttagcttgctgctactagtttgttttttacactatataaatacttatttcaaaaccaggaataaaaatcaaggtcgagaatgggtagctgacggatgttccttaaatataacatatttggcgtgtttccgaagataatgccagcgcattgcgaaaaaaaaattcaaaatgctaaggaatatatttacagtttggttaattatatcaatgccattataaatttatcaattttgaaaaataccactactatcacataattaaaatcatgtgctgcaaaacatcaaaattccacattatacgtctaaaacacattatgaatcgttttgtgactactctattttttattttttatggactaaaataaaatcgtctcttacaactcaaagaacaacaacactatccttcctcctgccaactccacaattggatgctttagttctaatcaaaattttcaatctaacatttgacatcgctaccacaacaaactgctaccacttcaccattcataattcgtgtacaaaataattgaatgaatatcatataaaaaactacataggaaaaaaagagaaaaataattgggtggtggaggagccaggtcgccgttcacgaccattggcatcgctcgtcggcatggaggggtcgccgtccacgaccgctcaagtcggctagctggcactcattgccagcaccagcaccattagcttggtgctcatcggcgcctagactgcgtatcgtagctgtcgaacgtgtcgtcctagaccttactgcctccaccagtgctaggtctgctcatgttgagctcgccgtcgccagaaccgactttgcgcaacctagatcgaaacttcatcgttaccgtgcgccgccactgcatatgcttgtgtcgagagcaagctttgtatttagctagtcgtcacttgccgccggcgtcgtcgctgctgattggcgctccccacgttggcaagattaggtgatcgatttggctatggtcgttggatttgaggttagggttaaaaggagacataaaaatacagtaggaaagaaaaattcaaaacgcgtatatggatcaaattatataaattgtaaagatattttttaaaacagatgattttttcaatttgcaatggcaatgatcccattaaccccctcccccgctttgaggaagaagcgaacacactccatgcgcccccgcagcacacgtatgcatggtacgtgtccgccggcgtcacacgcggcgtgcagcgcgacgcccgcggcgcatctcggcggccgcccgcgccgccgcctcatccatctccagaggattcctccgatcctctcgccgccctcctttttatcccccacccccctcctcctcttcatcctccaagaagcagagagcgaagcaagctcgaatcgatttccaacccagaggatttgattagctttgacgcataccaagatcatctgatcaatggcgtccatgcagaaaaaccgcgaggagcgcgcggaggcggcggcgcacaaggcggccgactagctccacgcc

SEQ ID NO: 70327 - DNA, 6418 bp, Oryza sativa
tcaccgtcttcgtcgtctttaactatgtcgtcgtgtcctcaaggaccttgctcttgtcgacggcggcgacgtcaatccacaacaccgtgtgtacaagagggcttgatgatggcgacggaagcaggcagggcgccgccccttctccccgccggccgccgccggtcccggtgcagattgggaggaaagggaagagaggagaggagaggagagagagaggagagtactatttactggcatgtgggggccgcgggagatgactcggcttgccacgttaagtaaaaccgggtataatactgtctaagaccttgggtgatccgattgatttgagagacccgttatatctggtattttgaattagggataaattttagactcgacgataaatttaaggaacctaaagtgaactattctaatcaaaaccagccccatgctttcacttctagcccatcacaactctcgcgtccttcccgatttaaccaggccgtcttctagctcagtgtgtcgtgtatgggcttcattgttggcaagtcctactggtgcggtattcgcaagtcctactgtcatacagcagtaacaacaccgagaaagctatttgggctgtgtttagttccacgttaaaattaaaagtttaaagaaattgaaatgatgtaacggaaaagttagaaatttgtgtgtaaaaaagtttaatgtaatagaaaagttaaaagtttgaagaaaaaaaagttggaatcggccttggcgtcgagatttcctcaaactgccacggctgactgccaatacccaatagagaatagactatgttctcccatgtatacttggacagttgatcatccgaagacgcaagcaacttttgcattattactcctttccgttctttccgcccatccccttaatcccatctgacctgaagtcctgaacgcctcacacctgtccccgccggaaaagataagcacaaattcacaatagtggctcgaagggccaaagaaccgaagaactcaacctctcaaaaaaaaaaaaaaaccgaagaactcaagaagcacgcgcgagtcgcgacgccatcacgagaaggtggaaagctcagtagctccttcgaggcggaaccgcggaaggggccctcctcctcggctcctctcctctcccctctcggtgccgcctgcgccggcctccttgcagtctcacgctgcgtgacgaaagggacaaacgcgcgctcgacttggccgtgtcgtatcgtacgtgtcgcggccccgtgtgcggaaggaaggatgggctgatgggcattcgctgaacccggcgtgacgcgagcagcgcgagcgcgacgccgcaccggtgacctggccgttcgttttgtactatcccccctagctttctccaccaggaccaaccaccacgtgccccttctggttgcggcggctgctggccaggtgggctggttgagcaccatcatttatcacgtccctccgcagtgatcgcctctgctacaggactacaggagttcactcctgtacatgcgtgacaggtgcggtcgccctatccgattcacgcgatgaccaagctagctgccgtgttcgtgtgggtacagtatcttggaagacaagggagaaaggttataatcatgctcctgttgtctgtctggagcaagcacggccttgagcatcattggcgcggtacgtatgtctctttcgatgttgaggcgataatggagcacatcttttcgtattttcatggatgtcgcatctacgatcgttccgcgttttcgagcgagttccttaggcgcgacgtgtcttaagacgttaggccgcctctggttaattctgtaacggctggcactagctagttaacgacgatgcatgattcaactttaacagacgttaatcatgcatccaccaatggctacggatcaccttttgcaaaatcctcccatcctcgaatgatgatgatcttctgcctcctttgtgttcccgtcaagacttttggctacgatcatgcatacagccgatgcaaccaccgtgacgccgccgcgcgcccactggaacacgttgcgttgcagctggccgatcggtctcggagtcggagcgcaccactgacccccgtgtggccgtgtcccggtgccttttccacgcccaccgttgctagctaccgagccccccacgtacccctgggccgcgcggcaaaaagacgtgctccgcgccgtcgcctccgcgcccctgccagctgctcgaacggcagaccgccacaccgcacgcgaaggctttgaaagcccccgccgcgtttggccattacccggcgccctacagcgacggacggacggacggcgtcacggcggccgaaatgacgtgaacgcccctgtggaaaaggaatgaagcgagcgcacagcgcactgcccatttatttctggagaaaatctgtggcgtgactcgactcgaggacgttgtctgcatagaccgttccactacttgaagtcttgcagggacctagttattagctagctagcggctgccgcctgccgcccagcaaaatcgagcacacagggaaagcgccgagaagaatagtggacatgggacgggagccggagatggaggaagcacgggagaatgggggcgtcggcggctctgtgctgcctctggcctcgctcatctctccaactgggaacgaggtgctcgtcccgttcatgctttgtttctgattctctactcgatcggttcttgtcggttaaacttgcttgctgttctccggttttaaagattgcttatccaggccttgtactgtggcaagcgaacaataagcacatccttgatttctggggtggatttgaacatgctaggctggatataaatcatgcgggtgaattgatctgatattacgaaaatcaatatatattgtgctatggatgtatcagttcagtcagacggcaaaatcaaagtgagtaactcctcaggaatggttgactatccttaatcatcagtttttcacgatgaagctgcaagccttatgatcccatcgactgttgagtattaacctctcaaacaagtggctaggaacggggtgccaaagaattgaattacgatcctaactcctttgccagctctaagaaatctcaagtcccaactctcaaggttatacttataaattacagtataagattattttttggttgcaaaagtaaaaacgcaaaccgaaagaaaggttctaatataatacgcagatgcttttttttttcttatagagaacatccaaactgtatgtggattttgtgaaatagaagaggaatcagatttcggcttttagaacagttcggtattctgtagtccagtccacactacaagaatcagaatactagcttcgtgcagaatgtgtttgcaactttgctgtctcagtgttgacatctgtacgccttcttttgtaccgggaagcattcctttgctgccttttttgccatatcttgttccccatttctgtcagccatacatggtccaatggtccatgaacaatctgatcaaaactcaaaggaaggtgtatttttcacaggtgcagatttctgagctagagggcaagatcatagggctgtacttcgctgcaaactggtaccccaagtgcgaggccttcacccccgcgctgaccgccgcctaccaccagctcaaggagcacggcgccggcttcgaggtcatcttcgtgtcgtgcgacgagaatcgaccgtccttcgagaggttccaccgcgccatgccgtggcccgccgtgcccttcggcgacatcgggtgcaagaagcgcctcagcgagaggttccaggtcgagggcatcccgcgcctggtggtgctcgccccgaacggcgaggtcgtgcagcctgatgccgtcgagctcgtgcaccgctacggcgatcgggcattccccttcacgtcggcgagggtggcggagctggaggccgacgagcagcgcaagttcgcgtctcagacgctggagaagatcttctccgtcagcgggaaagactacgtgaacggtagccaagaacaggtaagttttgttggcaatatagtcattaatcggcatattttaatccaagaaattgaaacaatgatcatggcataaatagcgtagggtgatcttaacataaccagtagcatactaggcgcatcatgaatgtcagaaacaggaacataccagtaacgcgataacatgctagaggcatcatgtagaacaggaacaagaacatagcgcacatagttcgctaacaatgggaacatgaatagcgctagcaacagtagcaggaggagaagattataccccgagaatggccctccgctggatggtgaggcagaattgcctccgttgttgttgttgtcgttcacggcacctcctcctggcgcaccagctccggatccggatccagctcctgtcggcggcgtaccacctccgctggcagtggcggcggcaactccagacatggcgacgagcagtcgtgtgggaggcactccccaaaaacctgatcacccgcctacccggtgcagatctcaggcgaaggtgtggtttcggaggcactgctctttccaatctctcgtgcgcgcaagagatcagaagcgaggaagcgagagcaactcaggcgcggagaaggagaaactaacaccgggaaagaagcgaagaagacggatcgaactcgcggcctccttatctatcaggagaaagaacgtggacgcgctgttgcggagggaatcgtgggaacgtgggttagtggctgcaaaaggatagcgacgtgacgtgacgcacgcccgccgccagccagccacgcccacggcacggcacggcccggcccggcccggcgcgcgcgcgcgcgcgtgtggcattccgacccccacctcaactggtcaacagggagcctccaataactccctatttaggttgagatatttctcgcttaaatcctaaggtggtattattatcctcaacatttattatgggcctttgagatttaatattataagttgggcctagcccaattattctaacaatccccaccaaattttaaggctcataagaaatgttctcaatgttgtgcctgtttgatataccagggttttggtggagactgttaagttgaacttccacctaggaaatgagctacatcagaccacaactgaacagtggactatgccttgaattgtaagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggaaaagccactcggatcacattaagacataagccatcctaccatgcagaaaagaagagaagcacatcatgaaaatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagttttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggtctcaactgtcgcagtatctagtgctgtaagttctgcttccattgttgacctcgttaagatggtctgcttgcaagacttccaggaaacagcgccacctccaagtgtgaacgcatatccacttgtggcttttatctcatcagcatcagatatccagtttgagtcactatacccttctagtacttttggatacccggtatagtgaattccatagctcaaagtgccctttagatagcgcattactctttccagagcctgccaatgatcgtctcccggatttgagacaaaccggctcagcttgcttacagcaaatgagatgtcaggcctcgttgcgctagccaagtacatcaatgaaccaatgatttgagagtatctcagttgatctcttactattcttcggtttttccttaatagcacgctgggatcgtaaggagtaggagctggcttgcagtcactatatccaaagcgactcaaaaccttgtccacatagtgggattgcacaagtgtaatcccaccctcatctcctctttgtagtttgatgttaagaacaacatcagcctctcccaaatccttcatttcaaaat

SEQ ID NO: 70328 - DNA, 3806 bp, Oryza sativa
cccacccaatcccccccgatggagcgcgcggcgcgaccgcgcaaaattcgatcgatcgggcgaacggcgccccccacgacctccgatcgaatcggaggcgatccgggtagcgaggggcaggggaggtgagatggggaagaggggaatgtaccggacggcgaaggcgactcgcggcggcggcggcggtcggcggcgaggaggaggagagagagagagatggatgggaaaggggaggaggaggagaggatggtggaaggggagactttttctcctgcgtcctctcccatttattcggccgtcgatctggatcggacggctgggatttgcccgggcccacggcgcgttgacggcgacgatgctccccgggtttctttctttcttgcggaggagaaagatgaataaaattgatgctttcaagtgggcccggggatgttcttattccaagttgattgaggtacaacgaattgggcttgttcttgttttaaaaaaaaaattgttaggtttccactaaaagaaatatactactagaacaaaagttgtggagtcagctttgtcatctaacagctcgaagggaattcagtctctcgtaagtattttataaatgcttgcagatgattaagtattttctaagataactttaaaaaatgacaacacttttttcaacaacgataaaaaaacaaaattaaatgatcaatttcgatgtatcatgatatgtttatggttctgagatttgataatttagcacttctacattgtcattctaattgaattgatattggtgacaatgacaaataggcataggtggtttgtacttatgtgcatttcccgtataccaaaaatgacatttaattgtatttgctcaaaacaaatattgtcctattattctagagtggaagcacgaatattggcgtgaaactaaaactcgagagtaacacagcaaatagagataaaagaaaagccattgctcgtagcataacgatacatgtaagtgtgtaactacaatgcacgctacaaaagtcatgaacattttctctctaattagctagctagtcctattgtccgatctaagcctttctaatcaaaatcagcctataatccatcgcacactatttgacctatcatatctattgctatagcatgtcaagaggtggaacaagctttctcaaaactacttacttctatttgctaatgagttgagggtcgtgcattgtacacacgtttaccctaaaaatagtttaagctgaatgggatgtaacttcattagaaatattgaatttgcacccatatacagcctttcctcatgttattcctctcccttatcctttgtcacctccaaatctcgccagtagttgtcgataatgcctctacgctcgatctccatcatgtgcccacgggtactctagcaactaatctattgcaccaacaccttgcttacttagatggcagctagaattcaacaagctaggggcaacagctacaagctaatgccactgcagaatggactcgcatgaggtaggcggtgactggagctcagcaaataggcaagcaggacatgatggagctatttgtatgagtcaggtgtcagccaaagctctatgcacgggccgatgcaaaagggtgatggagatcaagcatgagagacaccaagtgtagttggtgtgctcgcattgaccaatggatggctggagatgaacgcaaaatgggtgttccctacgaagttgtggcaaaagagaggggttccacttggctatgaaatttgcggtaaatgagcaatttttgcacaagttttggtacaaacccctgtcctgttgacaggttatacccacctatggtatttgtaatgtatggggatcattagtacaagagcatacgtgagattgcggtaaaagatatgggagacagaaatttttatacggataatagccctactcccattgtccgaagtcggtattgcttttatatatcaatctcacacaaatacaatagagaggaaaacctaatctagtctctagtggttagctgttgttggcttcattgaatattaactcgacgagattgaaggtgtcttgtattgtcttggcttttgtggcattgtattggtcttatcttggcttatcttcgtctcccccgtctcctcctcgagggttttgtatttataccctcaataccccccttgtccaagtagtattacggaagcaagtatggatactatccaagtagaccttgtaggtatcaagcagggactctatttatttttcttattcggaaaccttccacatgaaattttattccatataggacttggtgtatgatgggtccaccaagtcttaatacgcaggtataaggtatctcatatctagaacactgactcgtctcattgcattatagactaacatataaatctccctttaataaggatattatgaggttgttgggaggaagacctaaccttagtcgaacttgctctcggggggatgttgaggtttgctctcgataaatatcccactcccaagtcccaattggtttgttttttgataatggaaaatatgcatcctagccactgcttcaaagaagctataaccaattattacatcgttcattgctgatacaacttcaattaacacctctcaaaattcaaggtgacaagaaagctgaaaggacagccaacgaaggatagacgtaacatcatcaacaatacgtacacaaatgccccagatctccttgtggtttagctcaacaagcattccattttgccaatctatatttttccaaatgatcatgggcttgtttgttttgctaccataccaaaatctaggcaattttggtagtttcaattttttggcaacttatgtttgtcattggtgtattttggtagcaaaccaaacgctagctaaagtatttaaagtcccaacaatttggtagggtgtaggccctgttaaaatcccaccccaaaatttttcaccctgtcacatgtaacgtttggacatatgcatggagtattaaatgtggacgaaaaaaacaaattacacagtttgcgtgtaaattgcgagatgaatcttttaagcctaattgcgccatgatttgacaatgtggtgctacattaaacacttgctaatgacggattaattaggcttaataaattcgtctcgcagtttacaggcagattatgtaatttgttttgttattagactacgtttaatacttcaaatgtgtgtccgtatatctgatgtgacacgccaaaactttacacccctagatctaaacatcgcctttggcttcaaaccaaaatggcccaatcattttgattaaaaaaaacttgatatgcagtaatctatatttttagaaattcctcaatgggccttgagaaaataaggcataaacactacaaggttagttccaactacttaactttctataatcttccattccttgtcagcttgcttcctatcgaggattgtactaatgaataagaagaccatgaatgaaaggatgccacacccttatatcctgtgtctttaattttttaagaattataccatccttcttagactacttcggtagtaggaggggttgcataatagatatatcaaaggataagatcccaactggtttgctatgggtcacagacatttttttttggatttctgttttaaaaataattttaggagaaattattacttattttcttatcaatcatgaaaagggagtcaaacagcgaaaaggttactaagaaaaccacaaacattaatcataacatcatatgaatcaagcatgctctagccaaattttactatacatcagtcaat

SEQ ID NO: 70329 - DNA, 7819 bp, Oryza sativa
catatttagatacgacacatttattggactcaaacacaagtctaaaaccttctctacacaatagagagccgctaactagattcttctttattgaagggacatgctgcacgttcttcagctgcacggtctttcccgaagtaaactttagatcgaccgtaccaacaccgtgaacagccgcaagcgacccgtttcccatcaacaaggaggaacctctcccgacctgataagaagaaaacagagaaatatcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcccttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacgatcatcgaccatcttgtagtcatagaactgctccatgacatacagctcactgccggcgtcagagactccgaacttggcctcaagtgcatcccacatgtccttcccagaaggcatgtgcatgtacacgtccactatgttgtcagcgagtacactgatcaatgctccacggaacaggcaatccgaagcctcgaacatggcctcttcctcaggaaaaagaggtggttcacttcgtttgccccgtgaaacataaaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggcaatatagtcattaatcggcatattttaatccaagaaattgaaacaatgatcatggcataagcagcgtagggtgatcttaacataaccagtagcatactatgcgcatcatgaatgtcagaaacaggaacataccagtaacgcgataacatgctagaggcatcatgtagaacaggaacaagaacatagcgcacatagttcgctaacaatgggaacatggatagcgctaacaacagtagcaggaggagaagattataccccgagaatggccctccgctggatggtgaggcagaattgcctccgttgttgttgtcgttcacggcacctcctcctggcgcaccagctccggatccggatccagctcctgtcgcggcgtaccacctccgctggcagtggcggcggcaactccagacatggcgacgagcagtcgtgcgggaggcactccccaaaaacctgatcacccgcctacccggtgcagatctcaggcgaaggtgtggtttcggaggcactgctcacccgcctacccggtgcagatctcaggcgaaggtgtggtttcggaggcactgctctttccaatctctcgtgcgcgcaagagatcagaagcgaggaagcgagagcaactcaggcgcggagaaggagaaactaacaccgggaaagaagcgaagaagacggatcgaactcgcggcctccttatctatcaggagaaagaacgtggacgcgctgttgcggagggaatcgtgggaacgtgggttagtgttgcagagggaatcgtgggaacgtgggttagtggctgcaaaaggatagcgacgtgacgcacgccgccagccagccacgccctcgcccacggcccggcgcgcgcgcgcgcgtggcattccgaccctcacctcaactggtcaacagggagcctccaataactccctatttaggttgagatatttctcgcttaaattctaaggtggtattattatcctcaacatttattatgggcctttgagatttaatattataagttgggcctagcccaattattctaacaagtttaagagcgtcggtgcatggcacaagatcgagcttgcattaccattgccgttgatccaaagcatgaatgcatccagctgttggcctcaccatggctaagggctgcaggttcccatctcgagcctagtcgggaagacggtagggctctacttctcggcgcaccggtgtgcgccgtgcatcaagttcaccgcgaagctggccgccatatacagcaacctgaagggcaaggccgaggactttgagataatctacatccccatggacaaggaggaggacgggtacctgcggtcgtgcagcgacatgccgtggctggcgctgccgtacgacgacggcgcgtcgtcgggggcgctggccaggtacttcgacgtccgggagatcccgacgctggtggtggttgggcccgacggcaagacggtgacgagggaggggaggaacctggtgaacctctacttcgacatggcgttcccgttcaccgacgagcagatcaggctgctgcaggagatggaggacgaggatgccaaggggtacccgccgtcgctgcgccacaccggccaccgccacgagctaagcatcgtgtctgacaagtcgggaggagggccgtacatctgctgcgagtgcgacgagcaggggctcggttgggcgtaccagtgcatcgcctgcggctacgagatacacctccggtgcggtcgggacatggaaggcagggcggaataggagcatagggccctccaactcgtagtatattgaactgaacgtggtgtggtgtggtgtgtgtctattgatctgaacaaagcttgggttgctcttgccaagcctgatggcagaatagatgaggataacacaagtggtttctgtacttctgttatgtgttccttggctgcaaaagtgatgcagttcagggtgttgaataaacgtgataatgctggatacgaacgaagacttgggtcttgccttgcgtctccctaacagcaaattaatgagcccaagcttagtttcataacatattataacctccacagatcacatgatcacatcgaagtcttgtgcgctgtggctgattaatactagaatttatccagttcaaaagtgatagtaatcgatagtgtaagagctcataggagatgaatgccaaatccaaacaacaattgcatgagaagcgaaagcttagataaacacagtatacttttgtttagtagacaatataacagaaccgaattttcatataggtagcacgtacaaaccatattgaaacaagttgcatcaataaccaagagctcacaccgacacaaattcaaatgtcttagaagtagtaaaaactggtattatcacaacttcaggcttcagacacttcaatattttgtatcatataatagcacataggcattatgtgtagcctaaaacccgtgtattttgatgctctctttctttacaattccagcctagccaaaatagaagctcatcagataaaagcaatctgaacaaatatgaagataagcgttggtatcatatagattacctgaactaggaacgtcgcaacatttttacgctgatcaccttgaagttgaatgacctgaaaaaatagcagaacattcatcattatacacattcactatttcacaccagacaatgtgaatccaacacaacagaaatgctattttgtacctggcctaactctggatcttggactacagtaccattacaacagaattcctttttcagatccttgaggattttgttgtaactgtactctttcttcaagccctgaacagtagtcagactctttcttccgttgcgctgctgaatgcgcacgtgtacatagtcctttgatccagcaccaacgctggagtcctcagcattggcttccgcaaacggatctacagggaagatttcaaaattatcaaatgatgggttcaggcatgctcagaatagactaccagttactcctaatcaaaattaaatagaaacgaggtaaaccagataagatacaattctaaacaatatagctcgtaactggatatcaatatatcctgttgactgaaatatacaactaagagtaatctaaagtaatttagaaaagaaatataaatatttattctctaagaagtagaacctattgatcaaatcgttaaagcttgcacaggcgatgttatgataactaaatatccaaggaaatgtgtgcataccaaaagctgatggaagctggacgtcgagatcagacatgaaatttgctagttgagtttgattggtctcaaacagatgaaagctgatttctttgtctcaatgcaagctgcaaacattccaatcaaacgcatctaaaaaagataagtggccagcaagaagtgcatctccaaaacaaaattatttcttatcatgattgggtctgatggcatctatccaaaaaaaatgcacatgaaatcaaccagggaaacataagagatacaggctacagctcaagtacatccaacaaaaatcgaggtggatttaagcccggaaaaaatccaacaaaaatgcaccagtgccgttttacatattattatatgaccccatatatcctaccaggctaccacacatagttcctgttagggatggatttcttggtggtagaacagaacattcaacaatttatgtcaacgttgtattataaagcagatatggtcttgcaataagtcccactaattgggtaattcgcgcaggtacagaattatcaaaacgtatctgacgcaaatcaagcataaacatcaatacacctcccaacttgcaaaattaaattgtgttaactcatagacagaagccaattataaaatcgatcattctaagcagcaggaaatcgaaatgcctcttttacggacactaactaaaatagcgggatcatagcccatgatgtatgaacatattagatcaaaacaaaacaggtaacgtctattaacactaaaaattccccaaatctgacgcctgaattcgccctaaaaaaatccagcatcttcgcgtcgaggcaataacgaatgaacctaacctaccaccactttccactcccccagaccctggacaccaccacccaatcggacaaaacgatctccaaatcaacgacaggaccaccccccaatacctacgagatccacttcgctcgtggcgagatcacgaaacgcgtgaggaactcccaccacagaaggatctctcgtgcttcagacgcggaaaacggtcggaaacggtcggaaaaaccctctaccatttccattttcattttattttctcgaaaatggaatcggaacggtatacttggaaacggtaacgatatcggttatatcggtatcttggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccaccgtctttcttttcctctctttcttttattttttctctctctcttatccttcccttctctcggttccttttcctgctctctcaatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaggtggccggctgcgacggaggccgtcggggcgaaggaggttgcggccagcgtcggcgacctggtggcggcgcccaacatggcgcggcggtgccccagcgccgatgaagacgacgatgcggtcaggcctagttggcttctttattcagaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaagagattaccgtttccatttccgataccgacaattaccgataccgattgaaacggtcggtgcaaaccggaaacggtagccggaattctcggaaatttccgtaccgttttcacccctactcatagacagaagccaattataaaatcgatcattctaagcagcaggaaatcgaaatgcctcttttacggacactaactaaaatagcgggatcatagcccatgatgtatgaacatattagatcaaaacaaaacaggtaacgtctattaacactaaaaattccccaaatctgacgcctgaattcgccctaaaaaaatccagcatcttcgcgtcgaggcaataacgaatgaacctaacctaccaccactttccactcccccagaccctcgacaccaccacccaatcggacaaaacgatctccaaatcaacgacaggaccaccccccaatacctacgagatccacttcgctcgtggcgagatcacgaaacgcgtgaggaactcccaccacagaaggatctctcgtgcttcagacgcggaaaagccagatcgatcggggtaagagaagggaaggggaaggtcaccttgatcggcgaagcggagcggaggggaaaggcgagggagacgacgacgcggcacggcttgaccacggggcagacctctcttctggttctgggcgcttccggccgcctccaccacgcgtcgcttataaacgggaggaaagcgaggaaagggacgcgttttggttaggcgaggcggcgaattagaacgtgccgagctgttctcccctcacggccgagctaaatttaggcattcggccttcttgggcttttcagccctcacatgattttgactaggaataagttcatcggaggtccctcaacttaacagtgagatttgattttgtaaagtcccttaaccacaaaaccagaaatcttcactcctaaactatacaaaaccgtctaatttaggtcccaagtcagtatagatacctggttttgctgacgtggcatcctactcagctaaaataataaaataaatatttggggcccatatgtcagtgagagaaaatgatt

SEQ ID NO: 70330 - DNA, 2305 bp, Oryza sativa
atacttgtctattgttatatgaggaaaatgtgtggagtttaacaaatcataaaaataaatcttattaattttgtgagagtgagtattgttttttatttacaaattgcatctgaggtagacataaaaaatgaaagaagattagacaatgagggaaaaataataaaaaacaagagcggacaaggacatagaaaaaaaagccgaagggatagggcaagaatttgttttattatttaaacaattttaataagtaaatacccgtacgttgcaacaggttaactaaaattataacaaatataaaaataatggatcattaggatttagtttttacgatatgagcccttcaaaaaaaattccttatagaaataaaaaagttgtaaaaaaaaggcccattataccctatcggcctactattgcgcgtccaacacatgaagcgcgtgtggtgttgtggcccaatatggaggccggcccgacgcgggatcgatatgagccattcgttttgatggacggctcagattgattctaaatccatcaacaccctaaccctatccacacctacacccgaccgcgagctccaccttccgctcggctctccccctcccctcccctctcctgaccagcgatgcctctccccctccctcccctctcctaaccggtggcgccgctcctcctccaccgtcccctctccgccgctccccacccctcccctcctggcggcgcctctccccctctccgctactccctcctccctctcctcccctcttgatggcgcctctatagtgtggcggcttcccgcgggtagatccggcgacaccaacggcgccggccgcttcccgcgtcccaatccggcggtggcggtggcttcccgcagtggatccgacggtgacgacggtgctgacgacttatcgcggcccgatccgccgacggcaacaacggcggcggcggttcccacggcggatccggcggcaccgacggctacgtgtgtggcggcagcagcagctgcttcccgcgttggatccgacggctacgaaggtggtggcggctttcggtgatgtttttattttttttcctctttcgcttgattgtcctattagattttgtatctatgtttgcaatgaattttcacttaatcgctcgtgcatttggttgttgctgcggactctggatgattttttttgtcttgtacgtctcatctcggatgttgtggacgagggatttttttttaggacactaacaaaaatttaacgcgttaacggacaatgtgacgaaaggaaaataatggatcttttaattaaaattaagataagataagaggtgccgttgttttaaaaaaccaacacttacaaaatattataataggtgtcagttaatttaaaatcgaaaactataatatattatacggaattgctagtgctctgttgacagaaaatagggtgctaaatctttcacttttttgaccattcatctctgtttacaattcgtgctgcatttggattgagcaaagtcatgtacggctgtggactttgagatggaccgagcttttgttgttgcattctgtggactttgttgttgcgttctgtgggtctcacatatttaccgttcaatttcgaaacacacgcctgctttttttccttgcatttgagcagtgttttctactgctactttgcttatgatccacgcttactaattacatcgtgcttacattataattacatatgtaattttatgacttacatcgtaaatatactaaaattatatatgtaattttatgacttacatcataaatacactaaaattacatatgtaattttaggaacttacaatataaatacatgccaactttttttgaatagttactctctaaatttaaatagatgagattaaatttatcctatggcttgaaaaatttgcatgataggaggctagaaaatctatcgcatgatgtataggcagtccctatattatattactggcacctaaaaaaccaaacagagtcttaggccttatttagttggggaaaatttttaggtttgattatcacattggatatacggacatacatttaaagtattaaacgtagtctaataacaaaacaaattacaaattctgccaggaaactgcgagatgaatttattaagcctaattaatccgtcattagcaaatgttttctgtagtaccacattgtcaaatcatggcgcaatcaggattaaaaaatttgtcacacaattttcgtgcaatctatataattgattttgttatactatatttgtatttgtgtcaaacattcgatgtgatagcgatgtgatag

SEQ ID NO: 70331 - DNA, 2407 bp, Oryza sativa
caacggagataaggccaagcaggcgagctggcgagcatattgaaaggaaccgagccggcggggcccaccgaggagataaggacgagagcctgagatccctgattttctttctcgctctctcgtattcctctcctctctctcggtcctctctcgtttttctctcctctctctcggtcttctgtttcgctcactcccctctctctatcggagcggcggagccgaggcggcaggcagcggcgcaagaggggaggcggctggcgacgggtggcggcggcaggtggagacggtgcggcccagcggcgggaggcggcatcagcggcgatggtggcgccctcccctccacggcagcagcgtgcggcggcttcggcagcgtgtggcgggaggagtggcagccgcccggaggcgccatcccttcgccagatccgacgggaggaagggcttcagagccgcgccgccaccaaatgcgccggttgccttgatgctgtccctgccgccggcccgcgtcgagctcgtccacaagcccgacaaccacgccaagcacttctgccgccacacgtcgcctgtaacccgacatgcctcctgctgccttttgtttgccagcaaattcatatatgattgcctttgtttgactttctgtattgccggatcagattgggagggaggaaatacatgggtattaggtttattgtggggatcaaattcatgaggtcgagattaaatttggtattttcgtgttgtttttggttgtctggttgattaattgatttgggaatctatctcggggatttttttttaagacagactcggactcggggagggacggattgcacggacaggtgaaaattcgtgcatatggacgaaaatcatgtgacgaccggaaaaatactaatatttatattatatatatatatatatatatatatatatatatatatatatatatatatatatatatatgacactcatatggggcaccatggtgcccgggcaccatggtatctaatgtacaaaatcactcaaatttttcaaaattttcaaattgtgagtatatacctagttataataattcgattcatatctatacctatcaacaaaacaactcaaatttaactttatttcacaatccatgattacatacctaactaattatatgtatggatgctatatacctagaatcaaaatctaacaaaaacaagtttaaattcagtacaaacatgctttgaactagttagtaaagtagttaatgttaatacctaagtaattgaaaaagtttcatactcatttgaattgggtatatactcaatttcaacaatggtgcccgggcaccatggagcaccaaacaaatttactatatatatatgtatatatatatataggatcaatgttttgtactcccgggagtacatactccctctccttagtggataacccattagcatccaattaaattgctggggaaaaataaaaattttaatttccactaatcgctgcatgatgcatgcatgcacaggtatacacaccacatttggtgcacaattgaaccggggtgcatcaaatttgaacattgaacgtacctaaccatcctctaaagacatggatcttctaccgtgcaaactgattagaaaaatccgattataaacattttagtatatacttttttttcctacttagtagtagtataaactttactcattttagttaattagagcagcatatactacttttttcttgtacagtatatactgatttattctccgaaagagtatgtaccgatttatttcacaaagaatatatatgaatgtacatatgtactgctttctgcatactctattatagcaacgtagtaaatagtatgttcgcatactcttataagtatatactgtttattggaacagtatatactgttttcttataagtatatgcgctacttataccttggaacagtatatactattttcttgaaatttctagccagtatatactacattagtattgaaggagcatatactttttttttagtttggccagtatatgctgctatagtactacttttttgttatgctttcttgtttgctcagtatctgcatatactactcttactctttttgtttcttcagtatatggtgcatatactgcttaaataagtatatacactatttcttagatttagtagtatataccactattacttagataagccatatatagcttttcacgtgtgtagtataatatgctttttcacgagcaaaattcagaagtatgatacaaaattcttcgtaaataaaaaaacaagaggtatatatatgatctcatgcatgctcacaagcgaacgaaaaatagagaaaaagaaacaagaggtagatgcatgtatatgcttctgaaaaattcagaatctatattcagttat

SEQ ID NO: 70332 - DNA, 2201 bp, Oryza sativa
actcttactctttttgtttcttcagtatatggtgcatatactgcttaaataagtatatacactatttcttagatttagtagtatataccactattacttagataagccatatatagcttttcacgtgtgtagtataatatgctttttcacgagcaaaattcagaagtatgatacaaaattcttcgtaaataaaaaaacaagaggtatatatatgatctcatgcatgctcacaagcgaacgaaaaatagagaaaaagaaacaagaggtagatgcatgtatatgcttctgaaaaattcagaatctatattcagttatctgggaggttcgaacaaatgcattaggtgtcgcctctgatttttggcagcctatgcaccatgtgctgcagctgtaatgacaggatcttcaagactattatatttatacctctagaggtataaatatactcagatctactcctgggtttagagtagatctactcctgggctactagtatataccatttatttcagaccagtagtatatatatactgcatatactacttaattttctatcagtatatactgcatatactaattatgtttggtcagtatatactgcatgcatcatcctcgctaaaggagggtactgcctttttgtttgctcagtatatatatactacatatactacttttttttcgctcggtatataaataagcatataccactatttcttagataagttgtatatatattgctatccatggaagctggatatatacatatgcttttcacgtgcaaaattcagaagtatgcacgatacaaaaattcatccatatttaaaaaaaaaaaacagaagtgaaacaaaaggtatatatgtgagcaaaaaacagaagtgaaacaagacgtatatatatgagctcgtgctcataagattcagaatcaactaggcgaaaataaagagaaacattcaagaaagatgtatatgtgctgcatctgcatgatcgcctgctacttttggcagactcctgtagacgtatgcacaatgtgctgcagccgacgctggtctgtggttcgtcagtcaccatgcatgcatgcgtcctcgcatggcatctgcatacaccaaagaaattagtttcttatgggggcttaatcattcatggtctcatggagaacatcctcatcggcaataagtaatagaagcagatctaacaagaaaacaagagggatgatctaactagaaaaagaacaagggcttgccgcaccgatctgctgtcgtgcacctgcgattttcgccgcctcgccgccgctgcctttgcttgagacaatctgaaatcaaatcgtaagtgatgacgaaattaaataacaaaccttctatcggattggaaaaatggttatggatactcacaatcgtgacgatcgatagccgctggcctggatgggcatttttgatctggtgtagcgggaggattcatcatatatacccttgcctccacggaaggggtgcgatggatgtcctgctgcctgatggcgtttccatgggatccttagacgacggcagggtacaagacgatgccacacgcctgatggattgcatcgtcgcctccgactcgccgtagagccaaatcagcgttgttccctccggataaaccgtagatagcgcttccgtccaacgacctggcttatctagaccgaccgaccaaataaatattaaagaacagcggaagcttgactacccaatcacaagtacaccgactaggggtttacccccgttaagttctcatcctaaaagaagcaatcgaaacccgtatcactcaaagactaattctaaacctgcaaacaaaaggttatatcaacagcaagagtcagtacattaaacatgtaagcacaagtcaatcctaacatactacatgtaaggcatatattcaaaggaaggcaatatgtagttcaattttagcataaagcaaattttgtttcgcaattcttttgtaaaagagtttatgcttcaattaacaaagacatgttttaagttttaacattaagttcatcatatttccatcataatcaatctcttgatgtcatctttcacaacaagtcataatatatcatcacactcacacaactcaacacattttatcaatttcaaacctagtcacatgttcacattttaaaacatagagtctatacccatgacacttcaccaaagcgctcatgactgtgagtc

SEQ ID NO: 70333 - DNA, 693 bp, Oryza sativa
cggacgatttatttagggtttagggttagagagagttgagtcattacacagcctccctcctctttctttatatagcgacactggtagggctcgggggtttatctcaatctaaaattcgaatctattttgtaccgatcacacaaaacagatttatctcttagtttgtatcttattaggatagaaaaacccgtaggattttaaccatatcctaactaaccggcattagccgataaaatcaaccaacagacaccggcagcggccgcggccgcggcatgtcgttcgccgcggtggggacacgcatcgtgggcgtcggtgtggagttgaccaccgtctacgaccccgaggcctccacggagcgcggcggcccgcgactcgtcttccccaagttgaaccccgtcctcatctcgatctcggacgacggcggcggcggcggtggcggcggcaagctctacgctctctcccgcaccccggccgtcgtgaggcagctggatttcgagccatggttcttcgtcctcgacgacctcagccacaccgtgtggcgccagctgccgtcgccgccgctcttcccgtgccgcctcaacccgctggagttcctcgacccgcccaaggtgcgcgtaacggcgtacgccctcgtcgggtcacacatcctcctttcggtgtcggtgcaaccgccgcaccagcagcagcaagatc

SEQ ID NO: 70334 - DNA, 20273 bp, Oryza sativa
  unsure (1)..(20273): unsure at all n locations
accacagctaaactaagggcaggctcctccttgagcctgaagaaaaaaaatagtagcgattgttacagcaatatctaacggattcgcagcagtcggcaatcaaagtaaatgaaaaatcaagctgacaaatgaaagcatggaggcaagcaaattcttaccccacgactagctcatgccaggtacaatccatcgattccaccgtgtttctacctcatgtcggtgacgacggcatccggaggctgccctcggcgtcaacaagaaggggtgaaggcaaggggggagggggactactgcggcggcggaggcggcagcgggtggaatggcgatggcgacgagatcgatctagggcgccaccatgagctagagccaacgatgagaggggaggagtgactgcatctcgatccccttctcttgcctcagtaacctaatttctgagccaggggcacattggtcacaacacagccgattttgtgcgttaatccggcgaagatggagaatcagcgaagcagcgggttggcactccttggcgatggcattttagcgaagcaactttgcggagtggcattacagcgaaacccactcttgagagtggcataatgtccattttctcccaacccatgcgttgcatactctattaatattcatattataaataataaaattttaatcatgtgatgaatgtgttagttatattttagaaaataatttcttagaataaaataatacttggtaattactaatttcgaaattaaaaatattattttaataaaatatgaaacataaaatctatgatggatacactcaatatttattaatctgcattatggaattattaaaacttaaaagataataaggtgtccatagtattcgcaatgttatttcttatttaatatgaattttcaatactattcacaatacattacgatcatatgatttacccaatcaacggttatatttctagttaacatgggagttttcttcgagagccgaatcagtataagtgttaattctaattttcaaatattattctagaaaacagtagattaaatttcataattgttttgacactgtggaataagaaaatatttctttatttttttttgcgaacaaaatatttctttaacaaaagcatgcgttgcatatattaattaaatctacaaaatagtgaagtgcaaaaataatgaatcgcggatttataatattgatgaaatttattgtgtaaaggagctagtggaggtcgaacaggagcaaacgtcaatacatgcacctttttttcgttgattttggaatacagtaccatcaggtattttttgcctattttgccaggttatttatatcaccttgtactccttgccctgtagttgatttacaaccttgcgctgttcctggtgataccattgctattaacgttttatcagcatatatgtaagcggattgaaaaaaacttctcatcgtaattcctttgcattcaaccgcccccagcatacagcggctcctctgcggagatcaatctgcaacctgcgcctgcagtcattaacatcagaattgctactttcatgcatcgccctgcatggaatttgtgtgtaccgtatacgtaccgccttacctgaaggagtcctgattgatgttggttcagataaaaatcaattttggtcagggtctgagtcaatggagcttaaattgatggctcgagcgacacccgtcattggcgaagaagtactgctcgtggctgcctccagcgaattcctctccttgcgttcccatctcttcttctcgtgatacgtacgtgcgcttggagattagttctgcctctcccggacgctttggctggagattagattagatgtgctttttgaaagagcccacgaccactacacaatgtaaaagcataacatacaatctacggtcctgattaaaccacttatttatctaacggttatatttttctggttaacgtgggagctagtagaaagtgctcaattagtatagatatatagaggtatagattctacaaatcaacatgcaagcatatacaacgtcacctctcacatcattcgcataatattttaccaaatctatctatcatctttataatatttaatatatatacttatcaatatgttttacattaaagcgtggatatcatttgtattttcatgataaactccgatgttttattttttttcctttttactcatagcttgattatcgaaaaaaatatattgagaattgctttgtaattacctagccaagcatggggagtcacctagtacacaaagtctgtatgaaaaaaaaaaaagaggtagctaagccatcccattacttctcgtgtgccacaatgcatgaagtaaagaaagggatatagcttaaagaaccaacatttgtaatgtttcgctaataattaaagtttggatttcatagagaacttgtggaattgtgttttcttccctagcttttaaattttcaaccctatgatgctacgggaaggtttgtactatattacatataagttaaattatagtatagttacaacgtgatattacaaatagttaaacaaattataactcactataacatctatataatttagtataaaaagttgcatatattttttaatactttatataagttatattatagttatggtaaaattatattataactatactatattatagtaaattttaaaggttccaaaaaaacttgtcgtagatttttaatagtccccttaaagttttaagctgaagaatgtagaaaaaaatatataggcattacaattttaaatggttttacattaaagactgtagaaaaattataggccttgcatttttaaacggagagagtatttaagtaggaaaaccccactcctacaaacacaaaggtatgagggtattttttttagtatttgaatatgattggactttttttcatatcaccctttttctagtaagtgtatatatatattctagttccagtccaattagagcaagtttaatggtatagtcaactgttagctctaattaatctatagttagtccaatagttaattcatgcaatatttaactataaatatatactacatcattaataagtaatcccatatgtcatacgcatattatgtcttgaagttcatactatagcctattttttttctctctcctctctttatctccttcacatatgcttgtagctgacttaggccattcccaacccaagacactagacagtttctataaactccacatcattaggaaattagtactagacactactcttccaatgcaagcaccactattctatactaaaatttagtgctacttatctcacatgatattttgaatgttgtgtagaaaccatgtctcatgcatcttttcttatttattcacttgttatattattttttatcctaggtggcagcttgttgggttgggaatggcctaatagtctggtattgttcatgctcttaacgcatgcatccgctcctttgttccctttgttcaggaccctgtgttctcactggaccaggaagcttcctttgtttcacctcgagatcattattcattagtgccttcagcgttccaaagaaaaaggaaagttgccaccagccgaccagcgtcgtccactcctgtccctctcgtcattaatcacgcattaggtagattcgtggttcttgatttgaataagtcgagctcaccatcatgttcctatccagccacatggaaaaagacgagcagaagaaacgacaagaatcctactccctccgcccataataagcgttgttgtaggtttaattgtctaactttaattatccgtcttatttaaaatatttttattgttattagatgataaaatataaatagtactttatgagtgacttaacttttcaatttttttcataatttttttaaataatatggacggttacacgttgggcatggaaacttgcttcacttataatgagacggagggagtaattagcacagacacgtcaggaggtaattaagtggcgggcgtttttcggcctatacaatagacgcgttttcctttccttttacgcagcgaatctgcgaatttgagcaagactcagaaaaaacgagattagcctaacttttatacgtaattagttcctataatcaggtcaatcaagataaatgtttcagataacattttttttattttttactaaaattctgaaaactttcaacttgaattttgaaaacttttaagtcaagttttgacaactttcagctcgactttaaaaacgttcaactcaaatactgaaagctttcaattggaattaaacactttcatctcaaatttgaaaagcattcaacccacagttcaaaattttcacctcaaaactaaaaacttttatatcgaaatttaaacttacaactcaaaattcaaaattttcatctcaaattgaaaactttcataaatcaaaattcaaatatttcaactcaaattttaaaatttttgttcaaatttcgaaatccgtccattacatatttaaaactttcaactatttttcaaaattttaactaaattatgtgtatgtgttttctgaaaaataatgctaatgatggtattttttgctaattatgtaattagcggtacggacatggtgcgcataggtgggcctgagcgctgggagtcggactaagattaatatatgacaaaatgggaaaagtgtgtgctaactattctattggcgcagacacgcgaactaggcgccctactggcgcctggcggccatggctagcgctttttctatactcgaccgctccctgactttttctgtcatttaatttttcaaatttctgttttcaagagcattcttcaatttacagcttcaatatatacgtgatatcatacccctaataatttcacaaaactatttgtgcttctttattttattttttttcttcttcgtttgcctgctcctgggcgtgtgatactgtgattagcagccggcaaggcctaagcatgcatgagtccatgattgggctttaagatgctagcccgtgcatgcacccgtagcactcatagatgtatccagaattcgcgagacggcaagagtacccgtttcccacgctgcaagaaaattaccgtccaaaattccaaagatttatctgacaatttgatagctccacgtggaccaatcagtagtggcaaacctgtcggcttgagattaatagatcaataataatatatattattttgtctttaaaatgttttttatattaaaatattaacgaccctaaataaaaattgtagttacaaaataggaaggagagagggaggattgcatacctacaatgtaagtacatcgaaaatgctacgcctcggtcgctccccctcccccacgaagcgcggtgcgcccttgccccacgatgtgttcctatctatctgctacgtgtccccaccatatactccggtgcacaaatcacctatatattttagaaaccctctattanggaanntcgttcattttttngttcacannaaatgtttacctagtgtactcacaatgtttcactatgtatagatataatgttgcagtgaattaaagtattcctttgcacaaattcacccacatatattttgaaaaccctctattaagagaattcgtttcattntttgttccaccaaaaatgtttcacctattgtactcataatgtttcactatgtatagatctaatgttgcagtgaacgaaatattcttttgcaacaaaatcacccgtatattttggaaaccctctattaagggaattcgtttcattttttgttccacggaaaaatgtttcaactagtgtacttataatgtttcactatgtatagatctaatattgcactgaactgaaatattctttcactacttgcagaaacatggccttctgtgcttcgggtccccactagaagtcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcgaaggtttcttctagatccaagatcaaatcatccttttgcttggtcttgacgacaacatcatccacataggcttcaacgttgcggccaatctgtgttgagaagcatctctggatcatacgttgataagttgctcctgcattttttagtccgaacggcatggtgacgtagcaatatgctccaaagggtgtgatgaatgaagtcttcaagcagtcggattccttcagtcggatctgatgataccccgagtagcagtccaaaaaactgagaagctcacagccggcggtcgagtcgactacctggtcaatgcgaggcaacccaaaaggatctttagggcaagatttgttgaggtcagtataatcaacacacatacgccattgccccgttttcttccatactagaaccgggtttgccagccagtcgggatgaaggacctctttaatgaagcctgccgctaacagcttggttaattcctccttgatcgcgtcctttctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagagggatctaggggaatctttttagtcttggcttcgctttctccactttttgaagtcttggtagcgggcacttctccttcgctcgtcgcggctgcagccagtcggatatcctctcgggcagacgccatctcgcgggtttgggccatgtcgcaactctccttgtcgcatgtgacggcttgtttgatgtcgctccgtagggataggactcctcggggaccaggcatcttcatcatcatgtaagtgtagtgcggaacggccataaacttggctaacgccgggcgtccgagtatggcatggtatgctgtctcgaaatcggcgacttcaaagctgatattctctgtgcggaagttttcccgggtgccaaaggtgaccgggagagtgatctggccgagtggagttgcggataatcctggaattacgccgtgaaaaggcgcattgcttggttttagctcggagcgaggaatctgcatatcatccaaggtcttggcgaagaggatattgagtgcactgccaccgtcgatgagggttctgcgaagcttgacattgcggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagttccttgcggtggtcttgaaatcctgccggggtgtcgccgtcgtccttcttcctcgacgtgctttgttcttcgtcggagtttttccgtgtagtcttggtgtattgctccgcaaactgcttgtagacgaaacaatctttggccacgtggttggagttaggatggtgcgggcattgggagttcatgatcttgtcgaacgtgttgacgcgcgaacgctgtcgagaagagtgagtggcggttgcaacaagttcctcaggcttacgcttgcggtccttatggttgttacttccacctcctcccgtagccggcgtacccttgtttggcttccaactgggacccgactgctttgatgcggtgacggcgtcttcagctttggcgtactcgttggccttttcaaacatgagcttgactgtcctgggaggcttgcgcccgaacttgccgaccaattcttcgtggcgaatccctttggtaaatgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccatggggcaatccatggagccaagatcgggcggaatctgctaaagccactggtaaatagttcgccatggccttgttgtctcctcctgctgcgcggattgcgagaccgtagacggtaagccacgattcggggttagtggtaccgtcgtacttctctattccagtcggcttgaagccggctggccaatccactcgacgcaggtcatcggtgaaggctgctactccgtcaaggtcgtcgtcgtggcggtccggcgaatgatgatggcctcgagctgctcggcgttgtatgattgtgtcgcgaagatcgacggggcggcgacgaggtggtgagcgaggccgttccactcggcgctccctatgatgatcgggaggcgagtgaatggaccgctcgtcgtgacccctgctcctgcgattggatcctgcgccggtgatgctgaggcttggatgacggtagtcatgagatcggaagtggggaactcggctgccagtcggcgtgtagacgctttcggagttgactgggactgaagccgcgatcatggtcttcgtctggttcaagatgttgacgacgtgatcagattgattgagctcgttttctttgaggagggtgtcgaggagggtgatcgcggcaaccgcattctgttgaggggtgcggaaaaccggcgttccttcaacatcttgttggccgatgagatcacgcgctcggcgccctgcttccaaagctcgctgccgtcgatcctcagcctccttcgcggtccgctcacgctcctgctgctcacgccgttgccgttcttgttcttgtgcttgatgctcctcctccagtcggcgacgctcagtctcgcgacgtgcttcggtctcccgggcttggcgttgctcctccgtctcgttattggccatgaagacgccgaagaagagaggggtgtagttgtcatctaggctttcgtcgaagtcgtcgagatccgggtcgttgtagagagagctgaactcgtcgtattccacgatgtcggtggggcgcgagtcgacggtgggagagctgtagtagccatccagctgatccgtcgaaaccgtgccgagtggttggaggatgacgccgacttccctgaagctaggcgagatcggtgttgaagccgacttccgcctaggcctacgggatggagacgctgtcgtgatggagatggccgccaaatcatcggggagcttcatcaagaccggtgggtaagccccatcatcttgatctggtgtcgttggagaagatgcgatctcgcccgagtggtttgaagccgactcgattgagatggtcttggggtaacttttagccgcgtttgggagtccaaacgggactgaaatccggttctctcccgactggtttgaccccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttattcaagaagtaataccctactcctgtccggggatgaatccgccgagtgtattattgattgtatgatttggagaaaatcaacatccgcccctagaggcacccggaccccccttatatatgggaaggagtccgtgttacaaaagataatctatatccctaacggaatatgtagatacagataaaatacagccgtaaccgactaagtctcaaggtgtttccttgatgtacaagttaagaaacaaacccgagatacaaataagatattctatctatattcggtatcctgtattcagcccaaataccgtcgccgtgtagatatgggatatccataatctccacacatatatataaacatataattatcagaatttacaaggttgaccagacgaattatggagcgtgaaataatagatccagaacataagtcgtaatacaccactatttttatatattttgccattttatggtatggcttatgctagcttaagtgactaataaacccgtacgcaccattacacggaagtcaggtaaaataggacacgcaaaccgaggaggccaagaagtagcagccctcatcatgtatcagcccctgtctagctttcttctgtgttaggtttgttcctctttgttggcctcttcctcgattgtgtccataggaggtgttgctgattccatcttggccttcttcagtgtttccactaaacctgccaggcactcgtccgcgtctctcttcctcttgcaccgtagcatgtgattaccggccacgtctgccggtgcgtcgatctcatcgatcagtcgactgatttcaccgttcctcttaccccgcggcatgaggttatcggcaacatctgccggagtcgtgtcggtctcgtcgagcagtctcccgatttcaccaaaaagcgagtgctcggtgatgtccaggtagctcttggccagcaccttaaaggcatcgaggcggcagtaggacatctcgatgtgcttgtccatcctccccggccgaatcagcgccgggtcgagcctgtcaacgtggttcgttgtgaacacgaacaccctctcgctgccgcacgccgaccacagcccatcgacgaagctgagtaggcctgacagcgtcactttgcttttatcatcagtcttgttggaaagctcgaccagcacatggttgttgtcgacttcgtcgctgttgtccatcttcttgcccttgcgcttggtagtgagctcgacctcgatggcgtcgatgtcctcgataacgatgatggatttgtccgtcgtatcgaggaagagcttccgcagctcggcgttatccttgacagatgttaggtcgaggtcgtagacgtcgtagtcgaggaaattggccatagccccaatcatagtggtcttgccagtgcccggtggcccatacagaaggtagccccgcttccacgccttgccgaccttggagtggtattccttccccttctggaacgccctgagatcgtccataatctcaaccttcttggcatggtccatggcgagcatgtcgaacgtcgacgggggattgtacgggacactggtccacatgctgatctccccttgtttggagtggttggtgaacagcagcctctgccggtccttggcggttagctcgcgccaccgccggatgatgccgggcaggtaggtcttgagcacgagctggcggtggcgcttgtggaacaccagcctgtagcaccgcggctcgtccgtgtccccggggaacatgctgatgatggtgctccctgtgttcttggaggccttggggtacagcctccaccacatgcgagcaccatccaagcagtcgacgacctcctggttctcgtctagaatcacaagcgggtcatccccgatgttgttgccgagcttggccttgagcttggttgcgctgcccaggcacgcgctcctcaggtaggtggagacggcgtcgaacatcttgttccgccggaaccgctcctcgccgtactcggacacggtgatctgctcgtaggggttgaagtaggacataaccatggggaccacgctactgatgatgtacctagcctcctcgtggacgtgctccggcatccgggaccaaagcaagcccacgccggccatggccgacccgaaccctacccacgtctccagagtcgccatggctgcgcagtgcagtacgacgtcactcctttgcttaatcaagctggcaagctaggagctctctgtgtaattaatagctgccgattgtggatgtgtatgtctctccctccatcgtcgcttctctggccccagcttatataagggtgttccttgggtgtaaaggtctcgaagtatacggacacgtatttgaattattaaacgtagactaataacaaaacaaattatagatttcgcatgtaaactgtgtgataaatttattaaaactaattaatccgtcattagcaaatgttcactgttaaatcatggtgtaattagactcaaaagatttatctcgtaatttacgtgtaaactgtgcaattattttttcccccacatttaatacactatacatatatctaaacatttaatgtgacattttttaccaaaatttttagatctaaacgaggcctaaccggtgatttagcgcgtaaattaatgatccacagttccacaccgtttcagcgtggaagaaggtgtgagaacgcgcgcgtcgttgaagcttcgttgaaggaaagaggtcgaggtctttgtttggacgtgtctctctataatagggggctccactggtcgtgcaactatatataggtcaaccatggcaatcagcaatcatgccacaatctaacctatattttcataaagttataattatagccatataaccatgccacatcatcacccattagcaataattatttatttaacctcatgcaagcatacaacatcatatatcacgtccaatttatttaactaggaaggtagcccgcgcattcacgcgggcatgcgtcgtacgccaagtttgaggtatttataaaagcgacatttaacaggagaacatctgccacaatttctccatacattatttttgtcagcattaattaattctttaataatattctaacctattagatttatattatatcaaatataagtagtatctataagtaattatttataatattcttcatcattttaaaaaaaaggtagatttattttctttagaaaacatgtcaacgaaagtaaaagtaagtgtaaaataaaaattaaggtgtttttatttttttaattgtataatatattatcataatatgttaaaggatgaattgggtgggacattaatctacacaaaaaatgcacgggtttatatagcctaatatgattgatatattttgagaggcgatctacctatgaacatttcatgtagagtgaatgagaggctccacgcaacctagcaggaatacaataacgtcgaaatatcattgcacagtaatatttttaaaatgtcatgtaccatgaataaacacttgttagaaacaatggttctaccggtttaaaaggtataggagcgcacacatgcatgttatgcagtgagccagacagagattctgatagaatttgttttttccgaaaagatagatatgatggtataaaaattgggtccatcggtttaagtggaaaccgatggtcgattatatgagtgtttttgtaattaatagaatgccacatagcgacttagaagtgtttaggagtgctaggagcaatcatatgtatgatttagatgctatgatcattttaagatcgtttatttatcttttaaatttaaaatatcatttatttacaaaagcatcaagatcaattcgtatatgtaaatagcccccaggtgtatgttgtgaggaattaataaagtttttttatgaagaaattaattaagttggtagaaagtcattagatgtctaataatgtacttttaatgggtttaacagtttcattaaaaaattagctagcatattttgattttcaatgacaaattttaatattttcttttatttagtggagcactcaagatggatgtaggtctagaacgcaataaatctaatatagatattaaaattatatatttatttgaaaaataaaaatagatatataatttatggtacaaataattgtaaagactcgtaaaattaatccggcctttattaaaaagtctaaaatagcacgtttaagtataaattagttaatatatttctttgttagtttaatgcgtacagaatgtaacgatataaactttataaactttatttaaatagtgtattatttgaaaataatgctccacataaagggttcacgtatacctttatttaatgggtaaaaatatagtggtgtaaactttattttggaagagatatatcataatataatcatataagttatgattatataaaatttaactatattaactgttatctcgattatatatatatgaaaagaaaaaggagggagggagatggaaccgtacgtacgtacgtacctacggatggtgtggaattgtacgttttaagatcaatatagttaatctgacggtttctaatagtggacccactattttaaaatcaacggatagatgcttttcttttttctcagaatttctttgatttctctaatttattagagcgccaactggtggcttaagagcgtttgtaggaagattaatggacttttagtatataatagatagatagactagtcgtcaacccgtgcgttgcacgggttattattaaagcatggttggagcaatttgattaacatgcatactacctcaaagtgcatagttagcacaggaaaataaatatgatataatttcataatttgtaattcaaaatttatgagaatcataattttagagctaatataccaaggtaccttagtttgcaggctcaatcatagatatccaaattggtaattattttcatgaattcaattcaaaaaaactcaatgaactggtgtactgcatgctgtctcaattattataacagaatccataataagtttctcttatttcattcaaaattatatagatatccatcttagtttacagtctcaaatatatattttttttcataatttcatttttttcaactttttacaactcgccatgatgtaattccaaaattggaattaataagcatacagctgtattttgtgccggtcctgtgcattcacacgggctatttaatttataacatattatttttcacctatattagaaatatggaaatcttaaactgaaagtgtgaaatatctcggtcaatgagcatcgtcagcattattatcctttgtattacatgatctttactcatggatgtatgtaaatatagtatcaatatcatcaaaaagaatatcacggttataaaaggggaggaatgaataagaaatataaagcacgttataataaatataatctatttctcaaacactgtagatatagatcacccttaaaaattatatatagattcagtaaaatgttttttgttgaagcaactgttatattatctaatagttgaacttacctgaaatcttgtgtgataaatctatgtttgacttgtgcaaagcataaacaaattaactaagaagtctcgatagcatacctgaaaaaagataatatgttccatagtatttatcgaagttactttcagctgtaaaaaccccgaaataaaatagtagcacaatttacacatgcatggtgataatataaaacaaaggcaaggagttagtgaatttagatttatttgaataaggcctccataccaattagtatgccaacccatgagaaaatggacattatgccactctcaagagtgggtttcgctgtaatgccactccacaaagttgcttcgctaaaatgccatcgccaaggagtgccaacccgctgcttcgctgattctccatcttcgccggattaacgcacaaaatcggctgtgttgtgaccaatgtgcccctggctcagaaattaggtcactgagacaagagaaggggattgagagggctgcaggcggcggtggcggtgaccattctgcggcggcggcggtaaatccgcgttgccgatgccctcctcctccctccctccgactgttgccaagcaattttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgatgatctctagacagatagatcttatatgaatcgtatgatgaagtaccacataagtggatatataggaaaggaatccaaatctgccgaatcgctcatgttatgatcttctacatcctaggtctccgcgttccatcatctggcttatgttcttcatgtagcattcatatcgaatgactctatgaaattacgtcgatacttctacatattatgggtaacgtaggagacatccctattttcccccgggggtcttaattaccacagcttagctttcaattcgcctctgaccatcaaattaaatgtgaataacccgtcctcctctctttgaaacaaggggcgcttggccgacaccgagagcagccgccggaagccgtcgtcatcatgcagcgaagacttgccgccggaagcgatgatttgggaatgtcgcaaggtagctcatatcatgctcggctgcctgtaggatttagcggccggcctccctctcgttcgttgccctaggtgtggcgctgcaggagtcgagtgcagatcgatgaggcatggtggaaaggttttcttcaaatgtgaggaaaacgaacaagatgtgagtattccatttgttgcatttggtgtcttttggtctttgttactaatgtgcatttgttactaggtgccaaattcttgcaagtttttcaagtggatcgaatgttacaagaagatggttgaaggattgagtctacatgcagttgatgaagctcccagtgatgttgcattggagcatatggttgctgctcctgtagagatgaagctgaggtcggttgatgatggaaagatggataagttgataaattggattcaagttttagtgatgatcaacataggcctgctagttctttgttttattggcgtgcttgtgatgattttcaagtgaactggcttcccggggatcctctagaattagaccaggaatgtaagcattgcaatgtatctatttagactaatgaatggcatcttttgattgtcctgcttgcttgctgaaatatcaggaatggtattatgttattttcgattgttgtgcaattacaaaaatttgggcatttccatttgagatgagtaattttggcatgttttatgcacaggtgacagatctccatgaaacatcagttcagcacaagtgcaagaagttgttttgtaggaaatagtcctgcaacacataattccagacaatagcatccataatttcagcataagcatccatattttcagacaatggcacataaattcagtaaacgcatacataatttcagacaatagtgaaggcatccataatttcagacaatagcggtgcagcagtgcaccacataatcaagcatccatagtttcatacaaaacatggcataagcatttgtccacatcacaatttaggttcacacatagcacttaggttcaaatatattacattggactcctcatggagcaaaatggcctaatagatgaagtttttaggctaattcgaccagactaaaactaagttcaggttttaagtttcttctttggtgtgagcttctttctaggagacattctgggttgccagcttggtgctgcattgcttgtagcctgagagcttgaagcagcaggctgagagcttgaagccccaatgtcagcagtaggttgagagcttgaagccctaatgtcagcaggctgagagcttgaagatggaatgtcagctggctgtgaattagaagctggaatgttctgagctcctcccttcatcaatgatgctagccggctgtaagccatggtatttgaacaaatgagtgaatagaccgaaataggacaaaatctaaagtaatgtgaatgtattttagatgattaccttcttgtaattcttcctagactttcttcaagtattgtctgcactgttggtcttttgggactaggaatgtcagaagtgttcccatattttgtagtgttcctccttggcttcctcttccagcaaattacaatacaaaataatgcattacagttatgaaactgtactccagacaaaaaaaattggtattagtacactagcctttttttgattccattaagggaacacttgtagcttgtttgaacatgaccaaattccccacatcccttgcatcttctcttgccccttaccagcaccctcttccctgagtcattatcagttggagtagttttggctttagacttgccaccaccctccaggcaacttttgatcctaagctttatgtatcttccatttgtcttctttggcaaaggtgcacccaacacccatggcaattcaacctgtggccagtaagacttgtcacccaatggctctataattctcctataagccttcctgaacagctcaactgaaaaatagggattcacaaagtcctcaatgttgacatccctattttgttgagaggttatcaaagccaatgcatgctgacagggctttccagtgtgctgccactcctcacatgagcagtactgattgtaagccttcacaacatgtttctcatgggtggtgctgttgtcaacaatctctgcacagaagctatcagatttcactactgagaggtgacccaaacccctagttcttgccttaagcttctgtgttacagcaggcaagatgttcccagtcatcttctctgcaattcttctcctcttgttccacaataccataaccaacactctgtcttgtctgcaaggtcacatattggcaatgtcttataatccttgatccaattgttgaaactctccgccagattgttagtaatatagtcacactttattgctggattgaaaccactcctcatccacttcaatggatgataggcttcaagccaaggaagaacatcactacaagcttcaataacttcttttgtgtgactttgccaaatctctttcctgtatgcccttgctgctgggtatatgtgtgagtgcacatcaccaccaaatctcttcacaaagttcttcatcaaatgccagaagcattccctctgctcagcatgctcaaacacagtatgtacaaccttttctaagcctttacatgcatcagtacaaatagctaatggattcacatctcctatagccttatgaagttgtctcatgaaccactcccaattatcctaagtttcagcattaatggacccaaaagctaaaggatacatccagtgatgcccatcaacagaagtggcagcagccaaatgaccattccatcttccattcaaagcaacggaatctatactaatatatggcctacattcctataggaaaccgtctatgcagggcctcaaagcatagaaaaacctatgaaaaaatactttcccaccaacctctacagtgtctatctctatcacactccctagtgaagttcttagaacctctgccctccatctataaagcatgtgaaaactttcttcccatgtcccatatagctcaaccatagccttttctctacctctacatatagtgtcatagttaattgtgcactcgtgatcttccattagttgggtctacaaggctttagggcccatacctggattctttttaagaataggaattgcgttacttgccacccatttagctgttggtgtggtagtctttcttctgctgctagaagtgcatgtatgcaagtcttgtaacacagtcacctacaaattaaatgcaagaatccatcaattctgcaaccattatgccaaaatcaaacaaaaatcactgaaattaaatgccatcactgtcttctggttaggttgtttatgccccactatatgccaagggcaaccttcaactttgcaaccacctatgtatctttcagggtcagttttcaccaacttcaactcaaactcagcatttatagcaaactgtctcattgccaatctaaattccttcatgttagggtacactgtgccagccttcatgcaagaattattggggtcataggccatgaccctctcccctggtacttgatcatcgacaggaattgctgccccagtta

SEQ ID NO: 70335 - DNA, 2791 bp, Oryza sativa
aacacccctcacaacctggagaataaatagcacacagtgatgaataatgctaacaagaccaatgaaaatgatattgcttttaagaatgcttacctgatgctcaaggccactatattctccctcggtattttcacgaatagtcacaaggttcacatcatcatatcgagtcttgtatcctgggaggctgttgcaaggtctaacatttgcataaagaccaagctctttccttagtgtaagattcaatgaacggtggccttttccaataggcgtagccataggacctttcaagccaactttgtttctccgcaccgactccaagctttcccaagtcagaaaactctctgttctgggatcaacttctgtaccaacatagtgttcttcccattctattggtacccctgcaacattgaatacctgaaacagcaaaaggaaaagttcaaactaagatataataaatacataagaacgagctacatagtcagaaagcatgatcagaaggcacttggcaccatttttggaacaagaaggtgtgacttcattgcatcaatcgccggaagagttatgtaaggttgtatcctattttgcaagaatgaggatatttacatatagaagagttgcctagcatagtagcattgctcagtaagttttggatcccatgctctatgcaataattaaacaccccgtttaaacatgaactctaatgtgcatttatgtccaccaaaaaaactaggaagataattagctcagcataagcataaaatgtactaccttgttccaaaaagaatgcaattctagctatgcacatggacaaacacttgtctaggtgcattgctagacttgcattcgttttgggacggatatagcactatcttaagcaagccagcaacatcacatcaacactagctccaacattcaggttccctagggagatttgattgtagtttgattattagagtatgacagagtaatctgatggtacacaattgacagcagttattaaatcagtttgattggaggtaaatcaaacagagatatcaaaggcatgtgcttgcagccaattaaccaaacatgatttcagacatgaaaagagaaagaaatcaaaaggaatgggctgatatgcctaaatgaaactcaatagtggagctgtgctaagttaaacccaaaggccccttcctttttatttacaagctaaactaactaggcacacatattcaaataaagcaaaagagagatcaacggccggtggatattctactttttctcgattatcacagaaatactatggggtttaaatttatttattttccactgtgaagtttttgatgcacacactctatctactacttatcttagaaagcttataaacacagtagcctggcacacattcaatcaatgattgaatataaaatataatttatcaaaaataaaacacttgaccaaggtgcatattgtaacccataaactctctactacattgcatgtgacctacataaatgatgaggatacattgtgaacaaaaccgtagatatcattaccggccgcataaaatttcaaggggattgaaacatcaaaacaagaaaacctagttgcccaactgacaccaatagcaaattttagaagaaatcagctcaattcagttggctctccaactagaattataaataatcaagtgctctactttcaagaataatagcatatatcatacatagacttgtctgcagagtatgccatgtcaaatttaaactgaaattaccttaaagtgcatgcacgcaatggactaaaaagtcatgagatccaaacagagtataaggtattttaattttgtgcaacatgatttatcctccctaattcaggaacgtgatttaatttgaagggtccaaaatgccgtctcttggtaagaggctagaatttacaagggccttctgcttctttatcgacgtaaatgtaatccttcaataagcaacattcccagtgaacagaaaaactaaggtagaatgtgcaaactatttatgctcattgtcatatctaagttttcatggaaaagaaacaaaacagaaataagcaatgtcctcgttattttcattgccatttacaggcggtagaggtcattattatttacatgcagtagtggcgggggcataagttcacatcaattatcagatggcgtaataagaaccatctttgcacgttctagacagaatgtaaataaatctgtgggcagcagacaaaaaactaaaagagacgaagaatttaatcatcttccctgcacgtcatggccaaaataaatcttaaagctgttgcacacagcttgaaaacaaactaacaaacttgcttttttttttctcatcggatcaaggaaggtccgcgtcggacgaatacagcccgagctgatgggagtcgtggtcacagaggggtatatataataacaaatcaggatatacaaaaccgaaattccgtacctgcttgaccgactcggcgatctccggcccgatgccgtcgcctgggaagagcgtggcgcggacggtctccccggacgccgtcgagaacggcgccgcggcggctctgcccgccatccgcggcaggacgctcccctggagcagcctccgtagcgccatgcccccccttcctccctcttcctgctgctaccctgcgcaccaccacaaacacacgtcaaccctagactcccaacacccgcggaacgaacggggcgcggactagtccaaccccaaccccaacacaaaaatcatcaaccaaatcacgctcgctcgatcgaacgcgcgggggggggggg

SEQ ID NO: 70336 - DNA, 1212 bp, Oryza sativa
agccatcgaggcaagttacctcttgtcaagagaactcgccgaaaagaagaccaaaaaggtggtgatgccccgaaagttgtatattggattgttgtcccttttttacaatgatctgaggtttatatttatacccagagtgcaaacttagtccattatgtacatggttcaaacttgcctaaagataaaatacaaacaagtccatacggcggactcttgccatatgtctaacttaaaccgacataaatatcctaattaataaatgcaattgccttaatcgagctcaatctctaattggcagtgacagttatcccaatctaggcacatatcgagcccaagtcatatcgtatcggccacttgccatatcggctaagtcatgctctgttccaaccgatacaatacccagctgttgacggacaacacgatggattgggagatctgcataactccagtgtaggtccaaggctagcctcgattgtgtcaagggcgtgccagctgatttgatcctgcaatcagcaagaaagataaaagcagagttagtcaaccgatagcatatcgttggcggtctcagccgatgtagttagactaaatcggctatggattgaatagataaaggaacaaaagaccctaaacatgcctcatcggctataatactgtctataatgtttaataaagaagcttaggacaatattatgaaaatagccgatggaacaatattcagagtagggtatatatatagataaagataaagtactaggtaatactctagtacaaacttatataaacaaatcaatctatataaacatatcaaatcgcgattagttagtaattcagatagcacaaccgatactgatctgacttgatacaattatatagggtgatcagtctatataagtggcaaatatacataaaaccagtaaaataacatgtatattaggtaagattggctgaaactccgatactatctgtaacatcctgaaaattcccaacaataaaaatcactaaaatttcgaactttttaaaacttttacatcatgctggttgttatgattcctattgcttgccaaaccataaatgatcactaagaaagtaaagaaaagaactacatttaagcaatagatatgatttacgagaatatatttaatcctacaaataattatgcacaagatattaaaatcaaataaaataaaagttattattaacctattttatcaa

SEQ ID NO: 70337 - DNA, 6085 bp, Oryza sativa
ccttctaataatctcattggccccatgtatcccttctccatccatcatgtaatcagaacgatacgggtctgactgctccggaagctgatttggacgctttgtatgtccctgttccatacgatttagtggatcgttaggttctgcttggatgagtcccgtgcgactcgcaatattaggatgctcttcgtgcgcctgcattacaacatcaacacgaaccaatgcactattagagacagcagtgtagcatatcagttcaatggagagaatatttagcatcaacttcatgataatttctccaattgagaatatgcttcactcaatcaagccaggaatcatgaaacaaaacatagctgtagtcaaactgttttttaacatcaaatggggcatttgccctaacctttctagcaacactttcatcactcatagagtcacagtacatcgctttgctgaacaccattctacctcctctaaaaagaagtgatatggtagccattgaattgagtcaattcaattgaggacacgggagtggaagcgtacctcccggacttggaggatcggcggtggcgacgaggtgccgatcggcaccacggggacggcgccctccaccgcggcggacgacaggaggtagtgccggagccgcgcggtgtcgacggcgagctcggcggcgcagatggggcaggcgcagcgcgccagcccgacgggcacgctgagcagcgccccgcaggcgccgcaggggagccgcgcgccgcggacgtcggcggcgccgcggggcaggggcagcgccttcctccgtggcggcggcggcggcatgagctccgggggcagcgactgcggcatggcgcagtcggggcagatgaactccgtcagtcccggctccacctccagcgtctccccgcaccccgcgcaccgcacctccagcggctccggcgagcctccctccgccgccgccgacgccgcagcgcgccctggcgccattggcgcaggtgggaagaggtttcgaggttgttttttttttttctgcggcgaatgaggagaagtggggagggagagtggggggaaggagaagcgttgcgggatgctgatctctagcgacggtcagcctttagctagtctgcctagtaggagtaggtttaacgcttttttttactcaccagcgagtgaattttatgaatatagtaaaaagaatggatcaatcgatcccaaatacaaatttgttcatcggtactgctatacacacgaactagctgttcaaactcatgtacagctaaaaacatgttaccatagatcaatcaaaaagtatatgttcacatgtactgtttacaacagttgatcaaattcagtcgtacataagtctaatgatcaaattcagtcgcacgtgactctgataattagttcgtatgtacaacaatttcctttgttaatattctatgctatttcgagtgataccacaaattagcgatccaacgtttcgatatacaggcaaagggacgctttctccgctcatttccacaagaccaagataatgtttccgattgagtaaaatgcatgagcggtgcttaaacttgagcagaggtgttacgtaggatcgtaaactgaaaatttgcacaataaggttcatgatcttgttttaatgaaacatggtcggtccaaaaaacgtttaaccatatctgaccgcatacgtagcattccacgtaggcagcattttacatctggcccccttcacatctcgagaggggatgcaaagggatcaaaggatttgagagattttcggtgactactgtagcaacaagaggtaagaacagaattaccgccacgtcgagatgcagaaggggttggatgcaaaatgctacctacgtgaagcgccacatagttggtcaactctagtcaaacgcgctttggaccagctatggttcattaaaacaagatcctaaacctcaatgtgtaattttcaagtttacgcacataagtaacacattcgctcaagtttaaggatcggccatgtaatttactctttccgatttttcgctactcatttgcatatgtgatagaatatttcctaacagaatgaatctgaacagagaagatagatactcctttcatcttaaaatgtaagaatctagtactggattagacattttatagcattacgaatccggatagagatatttaccagattcatcgtggtatgaaatgtctaatccggtattaggtttctaattttggaacaaagagagtaataaacaaaacgtgaagagatgaagctattctggccatctgggtcaagagccaagagatgagtttcactatcgatcggagtcagcgtagcagcgggaaataccactgctggcagtgcatttcagcatctctccaaaagaccagggacagggaaacagcattagacgcaggtttatatattacatggccaaaattctacgcggcgaggcagatcaatcgcttgtagacaccacttcctcctcctcaacctcataatcttcgtcatcgtcgtcgtcatcgtcgtcgtggtgtctcgcagattgacgcctttcaacatgctgtttgtctgattcgtcctgcaaaacgttacaaaacaagatcgctgcttagtcgcttcaacgaacaagctacaaaagatggttggaaagcatgatcaaatgtatgtgcagcagcaagattaagtgggtcaactcacaaacccacttatagactaatcaaatggattgaccagcgggttacgcacttatttgatctataagtgatttggcgggtcaatccacttacacccttagctggtaagcatgacctctagtagattttcctttgcttttgggaaaaaaagggaattcatcatctacctgatgttttgactggtcctgttgaacatctcctccagctgccgaagacccaggggcatgctgcagagtcaccagatcaatctcttgggtctagtttggaaaaggaattaagtgaaaccatttacttactccctccgtttcacaatgtaagtcattctagcatttcccacattcatattgatgttaatgaatctagatagatataaatgctagaatgacttacattgtgaaacggaggaagtagtttttatgtgtacctcatgatcaacacctaacaatggcgcaccacgcacactttgctccagggatttaaacttctcctcccaggattgatttaaaccttgcagagcatgattgatcatctgttggacctcctcctgcgagaacttctgctgaccccttttaccagggatggactttgctatctccgcgattttggccttgtcgatggtgccagtgagtccatagtacctcccacggttccggccccccacctgctgtatccatgcagcatcgggatctgcaggtttatcaccagcctcctccattcgcttcttgaaaccctcctggaaaattcagtgaattgcaaacacgattcagcagccattggatacactcatctcaactagtttgcatggttgcatgatgcgtttctacaataactgcatagcactctttagtaactctaccatcaatccagtttcgcttttctcacatgacataattctctctgtgccacctattaacacttatgtggtctgtgttgtaatattctcaatgttcgtgacacatggctgtcccaccgattgctctatgacgctatgcaattcaatcagaaccagggtaatgtgttataattctgagtttttttagatgaaaattaaaatgactaaaccaatggaatttgtctttatgtcttaccataagctgccgttgcatggcaaagctccgagaacctgatgtgtgatgagcacgacctccaacaaaccgattcttcctatacttcagagacatctgcaagacttcttctttggcccaatattcacacaatctctcccaccaattcggatgcatccatgcaggggggaagggtttccacagtaaagggtcctcgtcctcatttaccttttctgtctgattgtcctttggctcttctgtagcatcttcctcctctgactctgcatgactattggagctacgagaacctgaagcttttttggctttttgtactgcagccaattctgctctaacccttcgcttctcttcgcacaggaggccagtaaactgttttactgctctgcgctgaaatatcttcaggcactcggcctcacggccaggggcccacttgtacctttgctacagcaagtgaatataagatcagaagcctgtcaaatatatatgacagtgcacatgtattaatttccttacaagaaattcattcaaaatagcagccctcgtctctgcaggataatgtttccagcggtaaaccaattcctcattagctggaacatcaccatgctcaccaaccggcaaataggttgatccagggtacttctgcttcaaaagagcagtgatggtagaggacaccttgggacaaagtgggttgacatcccagttactgtcagagaaagtttatttgtcaagtacatggtaaagaatgcatcaagaaacactaccgacaatttatcaacgcacatattgccttcaaataaaatgcacatactcgatattatttggtgtcaagacaggcctgtcatattccctgcgtggttcaatcagtcctctaggacggcgtcccctgcccctacctgatgatttacgactatattttcttaatacgggatgatagctatatgcgtcctgctgaacaagtgaatgcgtatcagcttatgcattcagactcccagtcacactaaatatatagaattcatgcataaattaaaccatcagatcctcaaacttgatcctacaatcttgctcttgggcaagttgcatctaatggaagctctgagcctcatacctgttgcgcatgcgtaacctgctctggtgactgtggctgcacctgctcaccacttttatcaagctggtgtgtacccctgacctctggagggcacagttgattgtagcggtgcggggattgctcggcttgaggcatctcacgatttgaagatgctggtaaaacagatgcatcagcattgcctgactcacttgagcatgcttgaggcatttggcactgaggtgatggactgggacacaaattggcaatgagtcggtcaatgtctggaggatcagaattatattggtttggagaagcagctggctgctggactggatcatcatttattggttgttctggttgtttcgtcaagcgcttgctacgcctaagatagagtccttcatttggagaactcggaaagcccttatttttcctcttattctcaccagcattcttgctgctcctttttctcttcgggcatccaatcgtcttaccagcttgtgcttttttcagttcactagcttgattgaggggctctgctttttcccgctccatagtacttgagacattttttgcccgctgttcacgacttgaaatgtcaacaagaggttgctgcccttgtgcgtggtccccacgaactgaattactcggagggcaagcttgtgcctgtggtgtgctttcctgaataggacgctctggttgtagtttttcaatatatatagattcaacacctgcctgcaatctagccttccttgaactagaccttgcagtggttttatcaagtgtctcattgcatgattcccccctatgaattgaatggttaacaggctcctttcgtgccaatgtgtgttggactgctgctggggagtcgtttctgaaagaactgaatgtctcctctcttggaactgaacgaatggagcattgtgctggtatctgctctgaacgaattggatggtgtctttctatttgtgactgctgcaccaaaataaataaataaatcaaaagattagatccatacatagtagagtaagaaaagaacattgaaggggagctcgtgatcaaatagattttgcagaaatacaatgagtacatcattgtaactgattttagtacattaagacttcgacttgcatagtctccgttcagctattggctatatcactgacactgattttgcttgttattaagattggaatgacccacatctagactgattgtctatggttgttcgatttac

SEQ ID NO: 70338 - DNA, 982 bp, Oryza sativa
aaaactgaattgacaatcttttggtacgtgatcagttccttcacaaaagaaacaagtgatcctgctcgttggacacctgtcgggtggatggccttcctcaccatgaacgcatgcagaggcacacgagctggcaacatgaccgatttctccacaacgagagcatgccttaagttctattttattctggttaaaaccttggggagacttcgcaccttcatcatctgaggagacttgatctgaatcttcactatcagacactctacctccattagctaaaagatgctctgtcaactgtggtgcacctcggaaggtatttcttctctgacgtcttgtcattcctggtgtaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggtatggcatgaggggccttctgggatgttggcggtgcgctgacttgtggtgtgaatgcttggactgcctccaactgcacttgagggttgcatctgactcgggttcaaaatcggcatccgatgctgctgtagtatctctataagcaatttgttctggttaatcaggtgttggaccactgccgcacaactggtgtctggtgcttcattcactcgggagcttgaggtaccaatgtcctgacttctgaccttattgcctttctcattgtcagccatctttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgac

SEQ ID NO: 70339 - DNA, 5273 bp, Oryza sativa
tgttcacggccatggctcgatcaattcctctctctctctctcgctcgctctttcttgatctatgcttgtcaatgatcttggcactgcgtttgaatgtcagtagctagcagatcaaccctccagttatataacataagatactagctaattaattgttctttttttttctttagaatgacagctactaatttggaatgttcacgaactttcctacgtgaagagtattgtacgtcgatccgtataaaaaaaaatgaaccgtgaaaatcttataattattgctggtgatgcacatgcatgttatctctctctctcttaaaagaatccatggatgaaactgtaggcgaattttctcccgttgaccatttcatatcataaaacatgttggccacaaggatcaatttgacaaatcttaatggttctacatctatcgttccttcgtttttagcagtgacactatggagtatggacagagcaacatgatcaccaaaacacctagtttcattattaacatgtaggagtataaaacatatggaaatatacagcaatgttatactattatttgaaactaattttgaagataaatctggccacgacagtgtaaaaaaaattgaattgaagtacgaaaaaaaatatgaatgagcaagatttaaagttggcctcatcttttcgcttaattatatttatacttataagctaaaatttgaattttcatctttaaatttaaagctgattttgagttttttaatcaaagtgtattttttatcctttgtttttagatcgctaagaacacatatataaaagttttgttcacaaattatttttcatttgcaatcatgtcgttggcttatttcacgaataagccaaaatggcagggtaatttccttgccacgaataatgactatggttcataagttgacctgctaaccatcacaacgtaatcccaacgttggtctaatggccgggcacatgacaacccttagtttggtggaaccgattgtacgggtatgttttttttcttctgtgccgggcaattaatataccctatccgtcaataaatatttgatgttttaattatattattcgattagatttttgaaacgttgatcataaataattttacaaatgttttagatgattagagcaagtataatagtgagttataagcattctataaccttatgtggaggagagaggtaaacaaaaaagaagggtgttgactctcatgcaagagctagcttaacacaagctccaagacaaatacattaaatatataagtgagagatagagataggagaagaaaatcataactaatcttatagctaatctataatatgtgttgactttaggatgggctaatagtagaaagtaggctatatcaggccattcccaacccaatgactaggatggtgttcatagcattaaataagttgccacctaggataaaaaatgatgtggcaagtgaataaatgagaaaagagaaggaaaccatgtcttgcatgagacatagtttctacacaatatccaagacatcatgtaagataagtagcattaaatttaagtatggaatagtgatgtttgcattggaagagtagtgcttagtactggtttcttgatgatgtggtgtttatagaaaccatgtctagtgtcttgggttaggaatggccttattatctttctcttaaagagatagtacatgtatatttcattaataccttgaaaagtaatatcatgtacttttctacatgaagagtattgtacgtcgatccgtattaaaaaaatgaaccgttaaaatcttataattattgctggtgatacccatgcctgttatctctctcataagaatccatgaaaaatactgttggcgagaactttctcccgttgaccatatcatcataaaacatattggccacaacccacaaggattaatggtttacatctatcgttacttcgtttttagcatatatgctacttccagtcgtgaataagtgatactccctctgtttcaggttataagacattttgacttcacttaaagtcaaactgttttaaatttaggcaaaatttgctacaggacactcaaaaattatgtaattagctgagagacaccgcaaaaaagtgacattgcccatagacactataaaaattatataattagctgtaggacaccggacgcattattttattatttttggactgaaagtggtgagttttttttcaaaatgaccggagtgcccctgcccctcgccatctatcccagacttgggtccccggttgaaccaaacccggtaggattcgtcacctggtgttggcgagcggatgagcaccctgggcacgacattggcgaggcgagtgggtcctgctgccgcgacatcgactagtaacaggtggctgccgtccacgtcgcggagccccacatgtaagcccctctctccttctctctttccagatgggggcagcagagcggtgactcgtcgtgcctgccttggcccctgctcacgaccgtgcagcatcgtcgcagccgaggcgtcgcatcggcccgtgccttgccgtgccagagccggcgctctccctcttcctcaggcttgcttgaagaaatagcaaagagagagagaatgagggagagaaaataaaagaggagaaattccttttccacaatcatcagataattgagttgaatcaaacactgcaatagtgcaattccttcaaatccaccacaaattcagagaggaattaaatcacaaactcaaccaaaggaacaaacaaatcaattgtgcaatcactagcaaagctaggcgcagccatggggatgcccacgacaagctttagttcttgtcggcagtggcaagcttgcacttgaccttctggaacaccaccgccggcggcgcaagctgcagcgcttgagcaggcacggcgcggcgagcttgcacttcgtgtagtgcgcctggtatctgacctcaccggagactgtcacctccaccttgaactcccttgtcgcgttctggcgccacctccaccacgtcgtgccggccccagcccctgcgtacgattctgtagcgtcgcctcagccgaggcaccacaccagcccacgcctcgccgcgccgtcgccggagctctgctctccctcgggctcgcttgaagaaggagcggagagagtaagagagaaaagaacaaggaagaattaaaaaaattagaagggtagatccgtacttacacagctgtttctctctccaattcgtccggatataataaaataatccggtgagtgtccaacagctaattaccagttttttacggtgccctgtagcaactacccgttattgcggtgtctcccagctaattacaagatttttttggatgttctatagcaaattttgccttaaatttaaccatatttatagaaaaaaatagtaagatttttaacccaatataaatttattatgtaaatatacggtagggctattcgcgctctacaacgtggaatattagttcgagcaccgcacaacgccctctccttccggttttcccgttttttaccacctcacctttcctcgcatcccacttttctcggttcgttttcaatttttaccacactatctttcgtgtttcttttttctcttttctatctcatcggtgcttcatcaatgggtccgataaatattaaccatccatatttttttgttttctgttttttttccttctttgtagttttcatgttttcgcgttttagtaaaatatttaccgtctattttttctttccaagttttctgtttttctactatatccgcacattttaaaagtaacgaatttactctgtggagttttttatttactcccagcctcccacatctgctcattcaaaagtaacaaatttacttgcatgaatacctccacatcgtatgacgctatacctagatagtcgtaaaagaattactaccaccttacaatgctagtaattcttttaccaatattattaatattgtttagatttcgtggtatgtgagtaaaacaattactaccttcctctcgatataccccataatctcgtagacaccgtgtattaatatattcgtagcaaccgtgtattaatatatttactgatgtgttcaatacacagcataagagtaaaaactgagatttcgtggtctgcgaataaaacaattaccaccttcctctcgatatagccatgatctcatagccaccatgtagtaatatgtttactgatgtgttcaatataagtataagagtaaaaactgataagagtattgttgatctgtatcacaatatagtcttatgaatgaaaaaattacaggctcaatcacacacaagcaataaaattactcacggtgaatcaaactagaaaagaaaaaaaatgatttagccaaaaatccatctggtggctttgctcgatcttgctgtaaggatgaagagcacggtctgtgtcttgtgactagtagtggagagggcaaacgggtggcaagcagtagtcgacgatggaatcatggaaaaatgtagtcgacgatggaatcatggaaagatgtagtcgacgctggaatcatggaaagatgtagcaatgtggtatagagatgagctcgatgttgcgcagtagcatccacccatcatccagcaagcacgaaaaaaaatgcaaaaacattctcgttcgtgtcaatagagatgacgagcaaaagaaaaatagcaaacaacctccatcaccagcggactccaccctatcctttgcggccagccacatggagcacgatgtacaaatgtaggacctgtgcagcccatcaattgagataaggtaatattggagattgtacattaatttgatttgcaaaaaaaaaaattggggcttcatgcatgaagttaaaggagagtatgcagatgcaaatcagagtgtcatttccttacttgcttactctatcaatgtcgtcgacgtggagcaaccgctggttgttgctattggtataggtgaacacctccttgctggttaaggtgatgcccagtgtccggcagcgaggcccgaagtagtgccttcgtctcatccgctgctagccaccgctcgtcggccaccgccatcaaccaccacggtgtcgtcgttctcctccatggtgtgtcaccgatctctgggttgggatggtggatcgattcatatacgaaaaaaaagggaaaaaaatgaagtggggggcaagagtggttggttgggtatgggaaaaatagaatatataccggaagcaaagaagttatttttatcgtagtaaatcatttactccgat

SEQ ID NO: 70340 - DNA, 1172 bp, Oryza sativa
atgcaaatcagagtgtcatttccttacttgcttactctatcaatgtcgtcgacgtggagcaaccgctggttgttgctattggtataggtgaacacctccttgctggttaaggtgatgcccagtgtccggcagcgaggcccgaagtagtgccttcgtctcatccgctgctagccaccgctcgtcggccaccgccatcaaccaccacggtgtcgtcgttctcctccatggtgtgtcaccgatctctgggttgggatggtggatcgattcatatacgaaaaaaaagggaaaaaaatgaagtggggggcaagagtggttggttgggtatgggaaaaatagaatatataccggaagcaaagaagttatttttatcgtagtaaatcatttactccgataatagtgggagcacgatgcgggacgtcgggtgggatcggaagcaagggagttgtttttattatcgaagtaattaaatcgtttactcgaataaaagtggactctagaggtccccgcgcgataggagtaaatcgtttactccgacaacggtaagagtggattgacgggatgtggggtggggtgggcttgggctgatgcatgtttggcgcttgaaatattaggagcgcgctcctaatagtagttctagtaaatatattcagttattgatttgatggcactaatttatagtattataaatattattatatttgtctataaacttagtcaaatttgaaatagtttaagtttaaccaaagtcaaaacgtgttgtaacctgaaacaaagggagtggtatatatgaagtatggacagagcaacatgatcaccaaaacacctagctagtttctttattaacaagagtataaaacatatatatgaaaaatatagcaaatttataatattatttgaaactaattttgaagataaatctggcaacgatagtttaaaaaaattgaattgaaatgtgaaaagaaatatgaatgggaaagatttaaacaaatattgactgcagacatttaaaaacacatcacttatctgcaactagctagatggagtattttccatgccacgaataatgactatgatgatgttgctgccttctgctgttcaccggctaaccatcacaacataatcccaccattgttctaaccgccgggcacatgcatgacaaccgggtaccgagc

SEQ ID NO: 70341 - DNA, 1844 bp, Oryza sativa
ccctcggtcaccatgccgagacaatataaatcacttagatcgaagtatatattaatagtgagattatagatgttcatagcatagccgattaggtagatctagcatgtataggctaatactccgataccactccatattaagatattaaggcaagtaaaatatatcaaacaaaagcctaatatacctaaatgcaacaagatcttaacatagagggcagatctagcatgtcaattaagcatatacgatataaaactaaatcaggtaagatcggctgaaatcccaatactattctaatcaacaaccaaaagcaggctagggattgagattctaatcacgacttataaggtcaaactcaactgatgcagttataagtatgaaaagaagaataatatcgagacaatcaagccgttggatgtttcatagagtagtggatatcctgtataatctaagccaacatagatatttaacctaatcggctgccttccaataatagatgttagctggttggaggttagataacgatattgtcgaagattatacataatatatgataactcgacgaattacataaacaagattagagtatcatgaagatggaagcactaatcccgagaatacaagccaccataacaagttttacctctagttgaagatcgaaaccgatgcagctcaacccgaaagcaagaacttgtcgaaacaaaacgaaagtaaaagggtggcgatgggccgagattgtattgaacgtgtgttgttgtattacatggggctcggggtctatttatactcgaaaatatgtccgtgtcggacacgactcttatctctaacaaactctaagatatcataagtctttacggcagacttttgcccaaacatatctctaaggaaattacatgaaatatcctaattaatagatacaattgccttttgaggactcaatccgtgcatggcaatcctcatgaagcacattaactcaacccgacaacgtgtaacgagtcactttgtcggaatcggcttaatcgaccgaccttgtccgactcgaactctgtcgatcttgatcgtagccgattcggacttttagcctattcttgctctgtttccggaacgatctctatcttggattccgcctcgatttaactccatctccgatacttgaattaccaaatttggttgttaacagatagatggttactttcttctttgtgaagaatcctagtactaaagcactcaataataatactaagcgacgaacccgcaacgatgggaatgtatctcacttaagcaagtaaattaaataccaaaagagaaatcacgaatacttagggtgtgtttgaggagattggggagatacgcaaaacgaggtgagccattagctcatgattaattgagtattaactattttaaatttcaaaaatagattaatatgatttttaaagcaactttcctatagaattttttttgcaaaaaatgcaccgtttagtagtttgaaaagcgtgcacgcggaaaacaagaatcaatctcccctatctccccagaacgaacagagccttactttattaaagaagcatccgttgaggtaaaagagagaagagagtgacgatagctctggcactcctctagaccttctcctcactctttacctatttcctccacactactaaagtgatgtctaagatatgaacttaagttgtactccattttgttgtgcattttggaaatgagtgagctccttcttttatagcctccaatgacggttgtggaggtcggagcaccacaattgtcattgggaggtgatccagagcctacacgtggaaggtggtgatggatggaggcaaggtctgatcagt

SEQ ID NO: 70342 - DNA, 582 bp, Oryza sativa
ggtgtcacaagtcatattactacataaatgaacttggcagctgattgcatggtttctacgcccaaaccctttttttctggaacatctaataatgtttgtccccactattcatgaaagagttactggaatacttttgatactttatgcatcactttctttcatgtcaccttttcaattggttgtttcgacatatgtaatatttttagtagtttcggcatacttcgtatgtttaatggctcatttatgtgcttaatttcacatgtaagcctgtccttttacaggttttcatcttattcagcgatggttcaatttttgtgctctgccccattgttccatttggaaggtaagtattgcatttatttctgccctcccccacccctcttttctctctattgggaagaaggcttacaacaatttgacagcatgatggtcctaatttgttaaaacaaaaaaaatactgtactaattttgtttatgggaaataaattatggtccctgcagtttcacactttcactttgtagtcttgtatttatgaaatgcgaccttaatgatatgatcatatggtgccctttctttatctg

SEQ ID NO: 70343 - DNA, 4698 bp, Oryza sativa
taattagtgaatttaaaatgtaatatgttctactgtcttgtggccaacacatatggttatggactattttagtaattaatgctataaggactaccttcatagtgtatagagtcagcccatatggcttcatatattgcacaatagccacttttgtaatacatcgtggatgcccttataagattgcaatgtttacaaatttgcaatgccatcactttccatcatcgttttcatatttgttcatgtcgttctccaaatgtgaaatgtttgcattgtcctatgctccttgctctaagctcgatctaatatttccctagcacctcttctcttagtcatctcgcacctgacttctcacacgccacctccaccaaggaggactgcctgccatcccactctctttactactatacgctgaatcccaccgttgttattgttccattctgaatcccaccgctaccacactgtctccttaaccaattattgcttgttcattggactagaacatcaagactgtataaaagttagtcgatatagcggaaagacgactaaccctcctgattgcttcagtcattgatcacccaagacatgccagatgacgacataggaacacacgatatttgttaacaagcttcagttgaagcctacatccccggggctctgattatgggcgctcctccccaaccaatatagctcctagccgctacgagtccatggccacgccgccatcctctccctgcgtgtctatgctacattgtagtcgccatggttacattgtggtgcccccctctctatttaagagagatgacgggttacagagtccgactctaactccaccccctaacacctattacaacttcaagtccaactgtaaccaaataggactagtatattcgatacctaatctaacaaagacattttgctatgtcatgttatatgatggttatagctgcaacaaattctagacacctttttcacattgttccaaccagtcgtgtagcagatcaacaagattaaagcagtgcgttggcatgaatcaacgtgtggcggtgggaattgacacctattataacttcaagtccaactgtaaccaaataggactagtatattcaacacctaatctaacaaactccaccttggcaaatatacgccacccagaagtagtagaatcaccatgccgatccatctgtcctccaaacttgggttgtctcctttgcagcttcaccgtaagccgcccgacgagactgcgccagacccgttgccttgaagagactctgctatctctgtaacttcttcctctggactccaccttctctcatatcaccacagtcgtcttgccaagcgaaattgaattccttcctagctgttccatcatagactccccgaagaccatgttcaactccatctactgtcttaaatttgacttgatctaatccatggccagataaccgatgtcatcaccaaatagataaatcaagctcaccagacatgaagagaacactttcttccttgccgtcttatgaatcgagctaataaatccaacatccacgccttcccacatccatagactgaatccatgatatttttgagaaaatcaccgttgccttgaatcacgcgaagaaattaccaccatagcgcttgctctttccccttcagtgacacagattctatatatccccataatacaaaccccacagatcctggatatatcatgtactgccaaacaaaccgttgactccatcaacgatttcacccgctgttgcccgggtcttttcttcagttctggcacaactccatatatctcaactcctcatcaagtcccagatatatcatgtcttcaccagataattacatatgcgtcttgaccagcctgttgccgccaatctactcgcccttcacacttgcaaactatccatctgtagaacctttttgtccttcttctgaatctgttcacaagtttctgcaacgaaccacccgtccgttgaacccggtctaaccgtccaaactccgcagtctaaccagtccgtcagtctgaccaccttgctggcccggccgaatcacattagaactatgcacattgttctctcgagtagtaacatcctcagaccataacactgttgcgttgatcctcacatggcttcaccacgctagctgccttgtgcccacgagccgctctgcgaaatcccctccttgcgccaaccactgtgtcctagactccaccgaagtctgtttgtacacgttgatctccacgcactgctggaccgcccatgacacctttgcacaatcaattcctagtggttgcattgccacatcaatcaacccatgcagtgtagtatgcatgcacacgtactgacaaccaaccatgtcaattaacgtgaccatgcacaacccttttcctcggtctgaacacttgactcctcgatttgggcttgcaccggcccactgctcaacacacaccacatgttttttcttttgaacagagccgaaaaatggttgctcttcctttgaccagatccacgcatgcgctagtttctcgataaactgccgtcgcccagcgccaccagcccgacgaatccgccgatgcctcctgcttccttcacgccgccgccgacctggtcagcgccgtcggcctgccttctgctggaatccatagccgccgctcccaacagaagccccgctgcctctccctgcttgaaggtcgccgacgcgcgcgcccttcctagttgccgctgcccccagccgccgggaacccctattacgtttgttgctctgaagcttgagtcttgtgatttcttgttaaaactatcggtattagtcctctcaattcaaaggagtgccaccccaatacgactcggtttgtatcatagattgattcatatggactccaccaatccaagtcgtgttcaactccttgttttactgttgtcggactcaacgccgcctcacgtctaacaagccgaaccacatctccctgcttcatctttgcacccgtacccgttctgctcttggataaccattgtgtgtgtatgtgccgtgcctccgtgcacagcgtccgtgcccctgcacgcaccgcagtcgcagccctcgtgttcaccgtccacgacctcgtcgtctcggccctccacgtccgccgtgccgcgccacgctcgtcggctttgcccttccgtcagtggcctccctgccaccgcggatccgcgttcgccgcgtgcgtcgggcgcgccgtccatggtgctacccctccgatctctccgatcgccttcggccacacccggtctcgtcttccggtcacgttccgccatcgccggtctgatcgcgagcgaggtcgtcgcctccgcgacgtcctcattgtcgccatcgatctcatcgccacgactgacgatctcctgtcgatgcgcgatccccacctcgtgtttcctcctccacatgtcttcttgatccaatactgaaaccttctgctctgataccacttgttataaaagttagttgatatagcggaaagacgactaaccctcccgatcgcttcactcattgatcacccaagacatgccagatgacgacacaggaacacacgatatttgttaacgaggttcagtcgaagcctacatccccggggctctgattatgagcgctcctccccaaccaatatagctcgtagccgctacaagtccatggccacgccgtcatcctctccctgcgtgtctatgctacattgtagtcgccatggttacattgaggtgcccccctctctatttaagagagatgacgggttacagagtccgactctaactccaccccctaacacctattacaacttcaagtccaactgtaaccaaataggactagtatattcgacacctaatctaacaaagacattttgccatgtcatgttatatgatggttatagctgcaacaaattctaacacctttttcacattgttccaaccagtcgtgtagcagatcaacaagattaaagcagtgcgttggcatgaatcaacgtgtggcggtgggaattgacatgcagtagtagccgttgacagtggtgggaatcaacatgcatgccgtagttagaatcaacctcggatagcataggttggcctgatcagtgtcaggtgaaagcagtgaaaatcaacgttgtcaactggtgggaattgacgataaaaggttggaatcaagggtaggaggtggaaatcataaaggaggtggatatggcggcataggccaaggggagaggaatagagcttagcacaaaggtgagggaaatatattgagtcaataaaaggcaatgaagatattttgcattcgtaagaacgagaaaaactccaatgcaggaaaacatggaaagaaggtgacaaaatgttaaatttctaaacgctgaagtatttagatggtatcattgtgtactgaatgaagcttttttttctatatttctaaaaacatattatttccatatcgccaatccaattgccctcaaaaaaagagatatataaagtttgtcttgaaaaactttgaaattatggcatttcttggttaactaagtttgagatgagatcacaagtgacagaaatattatattacaataaagggaaatgacgtcatttgtgcctattgtatattcgtttttaatatttcctttttaaaaaaacctgaccatcaatctaaattactcctcaaaacataaagtgtgtaattcaattggttagcttt

SEQ ID NO: 70344 - DNA, 3041 bp, Oryza sativa
ttccccctccccctcccacccccatcccaacctagtaccctaacccgtagggtcctctgccggagtctagggtgtcgccggcgccggagaagaagaggaggtcgccggagttggaggataaggcctggagcacgaatcgcaaagttcatccagtgattcaaaatctgcaagatttagagatagattttctgtcaatatatcgttagcctttccgtaaagaaaatcaatccgggcaatttatgagcagctaacttagcttacttattaaaacaacgaattcgagaggatcggagtcatcagcttcgaacttttttgttcactgctagttgtgcgtccatatatcgtgggggcggcatccacatacgcaaagattattgatcagcagaaggaaacaaagatcatgtttcttccacatcatgttacctatcatcgatcaaatagccgtgtccacatctgtcatacatgctggccggtactccatgttagccaaatccattctctctaccaacctcagatccttgagagggtgtcaaatatcctggcaaaatgctggttgaacagtttaaaaccgctgtggaaaaaacaggttaaagttgaactatagtgcatgaataattaatggtctcttcggattatagccaaaataaaccttaccaaattttggtattgccaaatttttggcaatttgacaatattgccaaagttttagtaggatttcttacttatttatcagagtttagtaagaaactaaatagatgcacatattttcacaattttaccaaaaattggtatggtttgaaatgatatctatctgaacaggtcctaagttttaattattttaaagagataatagctactttagtccctaaagtttctctgtaggatcagtttagtccctaaccttttaaatggtctaaataaatccttaacctttgtcataaaacctagaatagtctttgggtccaccaaaaccatcatatggatatgccatgtcatcattcatgcaaaatctataataaattgtccaatttacccttacgtatatcatagaaaaataaatataagggtgaattagacataaccataggaaaaaatacttccttttttcaccattttgaggtatatttttgctcttgcatataccatatattttttttaactttttccttttgttttttattttcctatgcgtaagggtaaattggacaaatcatatagattttgcataggaaggtgacatggcatgtccatgtggcgattttggtgggaccaaggactatattagcccacatgacaaatttaaaggacttgtttggacaatataaaatattaagaactaaaatgacccaggagcgaaactttagtgaccatattagctattctccctattttaaacatgaaaaatagatttatttgatattttaaagcaaagacaattttcaacgaaacataccatttgataggtaagtttaataatttggaaaaacgtgctaacaagtcgagataaaatctttctgactttctcttactcctcttcagccatacgctcaagctttaactgaagtccatagaaagcaagcggcagcgtgcaatgcgtgtccagtgcagcggcgcatgcgcgtgagcgcgtcaatgtcgttaagaaacagttacatgtacctgtcagtggcacaattgggagctcaatagcagctgagattttcagcgaggcaaaagacatacagaagtagaagagatggtgagccaatcaaagcacaaaccaacgcgtagtagctgacggatttgaattgtccgcacatgagctctcccagccactaaatcggggagcccaaaggaaaaaaattctctcaattattgctgcgtgatccactgcattattgtccgatcactcaaacagtggtccatcgaagctttcggctgctcgatcgatcagttgccattgccgtttgccaatctcacctgcatgctgtatccattccgactgaactggggtctgaactgaactgttcagatcagagagaagaatataaaaaaacattcagtgacactagtgttaatgcttgtacattttaccagtgcggatgaggtcccgaattgtcgataggttacagctgctgcacacagatgcatggaccaacttcactggcaagtgtagcgacttccttgactgctcaggaagaagggaatcacatagaccaatctgtaacaaaaaaaaaatgaaatattttaatcaagagaatagtgttgttgtaggaaaaattgccacgagtccttttcggagtaccaaaaatccctggattggcttgttccacagccacaaaatatgctaactaaggtaccatcagcatcattgttgtgcgaactgaacgtactcctcttgctacaaatatagaccaaacacttgggactctaaaaagtacacaccaccaatgttgattgtttcatcctacatattaagctcagagcatcctcacattgggcagcgttacacaagtaccaacaatattagaaacctaccaaatatgccattgaaacacactatgggttgccaactccaataccaccttctataagcccaaaaaatttgttgaagaatgcatccaccaagtttagtgctagataccttgaagcgtatcaaactatacatagccatgaagctcctgttaccgaattcggaggtgcctcggatctattgggagaaagctcagcatctctgtgggttcctgtccatgaagctcatttccagagccagatgtgtggcaagttctgtcaaacaatcttatagttttctggtttgcaaaagtaaccctttggtagttcagctcgtttactttgtgataatctcatttgctggtttccttgctctgaagaatctcaagccccagggtaagccaggtccaaaggatttggacctattgttcacctctgtgtctacacttactgtctcgagcatggcaacagtagagatggaagacttatctgacaggcaactctgggttctgatccttctgatgctaatgggaggagaggtgttcacatca

SEQ ID NO: 70345 - DNA, 4007 bp, Oryza sativa
  unsure (1)..(4007): unsure at all n locations
ctttttataaaccttttcaactttgtttatttctttcaattattatttgtgctctgaaaattccattaaaatttgagggctccttttagaccaaggagaatttaacaaaaattctccgggtcacatttgaattttttttgtacgtattttagtgtttgccaatttcttttcgaattttaattaattctattattccttttagaagatgatttttattttcgggatgaatttatcaggacgtgacagcggcctgggccgagcaggccgggagggaagaggggggggaaaggcagcccgggagagagagggaggagggagtgggccgagggaaaggggagcccaagagaaggagggagagaaggagagggagagaaaaagagggaggaaagggagatttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgactttgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttgcacattcagccctgacgtattctttttagatttctcttatcaatcacctttcgacctacttctttgttcgataataaacacctttgctggtatcttctatcaatcacctcttaaactttgtcaaccaagtactcttcactccgagagttgtggatgcttctggtgacgatgaggtcctttggcttgctgcctttccgtgaaaccttgaagtgtttcgccaaaagctatactaactgtcgttgcctttgatccgaaaaggacgcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagtaataatataggggttaagttttgcagaaaagcagcatttataagtcacttagttgcccaaagctattttataaaggcgatcctagagctacacagtgttattaacagncccgtgaccctcacgaacctccttaaccaaggcntacgatattcagaccgaactggcaacccaccctgggtcccagctcgtcccaagccaacccatgccaaccattccatattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacgggcgaaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttataaaaaccacctaatgttgtcctattaatcagcgaagcatctacctaaattcatactagtggaaccaggaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacaacacataaaaagaaagcacagggttctttaggttataacaaacattaggagacttgaacgggtcgattcagagttcgtatgaccaagatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgataaacggactccactagacaccacccgggttgcacacgtggaaaccacgcgggtaccgagcgggcacactaacgcggacactacacgggcaccacccggacgcgtgaacaactaccgacaccggaacacgggtaccggggtcgacgaccggacaacgggtacggggcgacaccgaaaggacaagggcggggaagcgagaagaggaaac

SEQ ID NO: 70346 - DNA, 568 bp, Oryza sativa
gaattcgagctcggtaccctttttgggtattacatcagacgtttgaccagatgtcggaaggggttttgcagtttagaaccttttgcctcaggaatgtacgtttgcttatgtttgtatgaactttcatacttgttgttttgttgtgtgaatgatcaatatgtattctggtggatataattaccttgtgtctgcaagaaatatatgatttaacactgtgcccatgtgggttaatggcttagtgctgaacagcatcacaagcatttttggtggccaaattttgccgttgatttctgcatatgctggagtggatatattacttttgatgattataacagttggaaaattatgcgctacgcctacgctacggtcggacctttgatcgaatttgaccgggaaacctattttcacttatgggtgggtcggagtttggacatttttcccaaagcaggccacccgagccaacgccaggtcttaaaagagagggcaagccacccggtagggtttcagattgtgcagcgttttgggatttgggaattttggtgatcatcggacatgtctaagcgaccgc

SEQ ID NO: 70347 - DNA, 53472 bp, Oryza sativa
  unsure (1)..(53472): unsure at all n locations
agagagaggaagagtgagaagagtgaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaagcccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgccaatggctatgcaaataagggcagcaatgggaaagtgcaactccaaatgatccctcactgatcaaaatgtcacatatctaatgctactaccatcgatgttgtgttctgactaatattagtgctggcatccttttttatttgtttatattttatctgaataagagatgacttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtgaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgtcaacgattgagaaacccctaagttgctgatatgctgcaatttataaatgccaaccttatggtcaatttttttaaaaaagaaaatttataggaaatgaacacttcccctatgtaaggttcgtatgtgtggcaatttggttatgcagccctctaaagttatggctgttaaagaaacagtttgctcatctatgctttcagtcttcaagtatgaaaaaataaaatgagaaaaatcataataatatgcttgtttatcacctgatacatcaaatcttcggtacccagttacatggcagagaatttccccaatacaacattttgcactcaaatactttctggctaactggaacttcctttagaagcaccaaagagaagacaagaatacattgcaaaattacattacagcaaattgcatgaatatgctgacctaccacacatgtttattccaatactatgattctataatcctaatttctagtcattcccgagataactctcagctcagctcctcgttgctgagggcatgataggggccatttccttcaacacaaacataattatccgcgttaacaaaatctctccttgttcgattttcttttttgtttccactatgttctgtagtccatagttactttcatgtttgagcatgtggctcgttaggtctaatagtgggaggagttttaccatcatcgaattttcggatgccagatgatgctgcaccctggcattttggatgaacagcagcctcctcctcatcaggtagctttccctcaacatcagtggcctcagcaacttgcccccttctgccatcgtcgctgttggaatcgctgcatcaacatgtcagcattagtgaacagaaagaacagctgtgatagtgtaatttggaagatggatttttttacatagtggaatttattcctgccttatttttcagtcgctcattataaagtttgcaggacgaataaccgctaattacaaaattacagcttgattaaaaacatataattaatgttccaatgattaacgtcaaacttcagaatgccttgtgtcttgcaactaataaagctagagtattgagttttttcatggagaaggacaacagaaagtaaaacaggtgagtaccctgagtaaataaccagcccaattgcaactgcaccgaatgccacatagtacatccagtcgacctggaaagcgaaagcgcattcaattgctggttacatgtaagacaataaactgcagtatgcttgatgcagaattgcagattgagggcccgatgatcagaccttttcatggtaggcaaacaaacggatgagaatagcccacatgtctgaggttagcaatgaaaggtttagcattgttgaaccactgatctgcacaagttaatatagatatgagaaacttaaagagcaaaaaccatgtgcttaatgtggcagtgccatttcgtagtacaacaatatcccttttgtcgggttttccttttttccatttttaaggagatgggcaaggaacagtaagtgaacttgggatgtaagaactgagaagtcatgaataaggaaattagtaggtacacacttgcacaaaggaaacattgtttgctgatataccttcagtaaaattggaactagagagtaaaacatgaacattgcgactgcaaacccaataaacggtaccacctgagaagtggcaagaaagtaatattaggtgtgtttggtgtcacaaaaacagataaagccaatgtcacaatgaggggatttttagaaggaaaataaaagagggaggacttacagcaccaacactccattgtatagattttatctcattgcgttcaaatatgcttctgcataagcaaataaagaaaaaaaaagctcacaaactttttgaatgaataaaaacacgttgcgggaggtaaaaaggctacagtacaattttaacaaactagcaacaaactcttctggaaacaagagaattctaaagaactgcctaaagcacattggttcgcctacttaatccccttaagtatgggtattcacccctcaaaggttttaaaactggttgaaataaccacttggaatggttttgtagtgattttactgtgtacaagatgacgtggcaggcacaatagggcatattactcaagccaacccaaccgctctttttctctctccaatcagcaggcccaagaatcacttataagcactaatgtgcttcttttccaaacgtcccaagaattaaaaaatatttagctgaatacatcaccatgtcacagtgtccacgtaagccaaccacttataaaaccactaccggcagttatttgaactggttttcatatttttgagggtagaatacttagtttcatacttgaggggttaagcaggacaaccacaacattttagggggttaactttgatatttgcttaaaaattctatgataataagcttatgaaacaaaaaatgtttaaacatggttaaaacaaaggatcattttacatctgacaagcactgatgatagctccaaatagtcccagcatccccatcaactcaactcgatcaccgactttcacaaggaactcctgaaatgcaaaagataaatatattgagggatttggtctcttagtgaagctagttttacaccttacaccacaaagcttgcacttattaagcccgaaggatgagaaacatatggaaacaggtgatacgtgagagtcattttcaccatttctttggattagtcttttttgacaataaagaagtgaaatatgaatagcttttggcacagactattaacaaagtttttttaatatgtattaaaaataatatctcaaaataatgtgtttcctgtgcagttgagatcaatgctttacctcactaacgttactgatggcataaagagtagcaccagcaattacaagtatatcacctttaactgggcttgtaccccctgcatagaacaacatgaccatgaacatttcagttgtacttcatttaggatttaactggtcataaagatgacttccaaaattccacgcaaaacttaaattattctccacatattcgtcaagcatgactggagtactgtatttttttaaaaaaaaatccattaatctagcaacatattaaactgtggaatagtctttactccttacttcagaaaacagactagttatttttgctaatgtgaactcaaggttcattttgttaccataattataaatggtctgcaatacaaaaggttttattgcacttttttgtggtaagtgaagaagaaatgaaacaacaaagacatatataaatactaatcaccgaactattacctgccctatcacctgcatggacatcagaaaatacaactagcacaagtcctgagacacaaatcgccacaccactatattttctgaatctgtagttggtcttcaaaaacatccatgtaaggaatatcacagcaggaatagcccagcaatcaagaagcataacgcttgtcagagatgtgtactggtaagccttgacaactagaaaagaatagagggagttagtataacattgtaacaccatctgtctattcagtagacaggaaggactgtcttgttatttcagcatagatgaccaggaacttttggtcaacacgctgctgaattatccaacaaataaccaacaaagtattgcacatacctagataatttgcctctacatcgaccaaggctagtactaagtagtagtaccatttcatctgcaagagttagttcatgcataaatcagttccacagtagaatacaaattgaaatactacagcatcagtaggaaattatataaagttatggatattacgttccacaaaatatatgtaattgcttatttaaaattttgagaacagtttatgtacaaatagatgtatttttcaaaaggaagcaaactgttgttacaagtgaatagagcagtaacactaaggcactaggcacgtgtgcttttgaagttataaacgctaatttaactaaataacaataaccccctccgttttaaaatgtttttaaatgcatgatgctgttggcttttgaacattacgtttaaccaattttcttattcaaaactttagtaccttatcttatcttatccttcttatatagtgaaagcagcaagctttcttgcacgaggatgtgccacatcatcagaaatattttagccgtcggataaagagttcggataaataatggtcattggattgaaagagtgcatgtattaaaaaaaatcacaaatgggctaaacatatggaaatttacggaggtttttggtatctattgccctagctaagtatagatactttgtaaacaaattaacttatatcaaaaccttattaagagctaaggtaaattaatagaccatatataaaagttcttaaacaggatcaaaagtcgcgctttggctagtaaatatgaaaaaaaatataagtagtatcttcaatgacaaaacaagtcacaacaaaataaataatatttacatagtttattttttccaataagacgagtgatcaaacataaaatccaaaatccaacagcatcatatattttaaaacagaggtactgctgaaccaaaataagtagtatctaaaatgacaaaacaagtcacaacaaaataaatgatatttacatagtttattttttccaataagacgaatggtcaaacatcatatccaaatgccaacagcatcatatattttaaaacagaggtactgctgaaccaaatgaacttgaattcttgatgcccaaacatagatatgcctctggttcactatatacggcactcacgatgggtagctttttggtaaggccattgaccaagtttcactcaaacattttgccaacccaacatttctttaattgccatactccaaagattcggcgattaaacctaaaaattgtgaaattgatatgaaaatgcaaagattgctgaacctgcaaagacttccttctgtatagcagtatgctcccgtacacgaccccaagcagcacgtagttgagcagcgactgtgacgttggcacattgatacctgcaagtgtaaacaagtagcaccaccgttacattgagaattgtgttaattaatttctctgggcgataacacggcaagaaagcttgcgaacggcacgcaagatcagcctgtacattgactgattgacagcagaagagagcagttccaacaagcaagtgattaaggaaaactacaaccaccaaaatagcagaaaaagggagaagaaacattgcgtgatcgaataaaaatttaaagaaatggccaaggaaatgactgctcaatctccacaaaaatccaccaaaaaaaaacagagagagaagaaattgaactgcagtgaagtagtctgaaaaggatcagaagaagaacacacgcctctagaaaaagaaagaagcagagaatcggaaaagaaaaggaaaacaatagagcagatagaagaagatgaatcgcggaaagaatcagagcaaagaaagaaacagcgattggggggcaaggcaacggggcggacctcggcgggagagctcggaggaggcgaagccggtggcggtgacgaggagggagacgagttggcccagccccagcccgaccagggtcttccgggaccgccaccacccgccgccaaccgaccgcgccattgctccgccgccgccgccgccgccgccgcgagcagagcaggcgaggaagaggagggagagtgggggcgtggactcgtctggttcggttacaatttgtagccagcggtgaattgcagtaacatccctattgttttccgatatttttcactctgattcaggggttgttgtgtaactttgttttttttttaagtaaattgcatcggcggtacaccaacttatcaggtgggtgtaatctagtacataaacttgtaaaacgctcgttttggtgcacgaacttgtttggtgcgtgcgaacaagattaaaatcgcattgcaaggttaatcttattaattctgttgttgatttaaactctatgtaaacattagtctaagaaggataaacatataataaggcataatgattgcataaaaaataaaaatatgagtaatgatgcaagggacaaacaaagaaagataaagtggattctaagtttacaaatataacatttctactatgtacatgcaagtcatctactaatttgtaatttataatgttgaacatagaaaaatcggacttgtcgcgccattttagtcttagtttgcacgtaccaaacaaattcatgtatcaaaacgagcattttataaattcatacactaaatcgcacacacctgataagtttatgtaccgctaatacaatttactctctttttttctagtaaagtttttgttccatactgtgaaagatgatgttgttttgtcatgagtcaaatttctctaagaatgcgtttgtttctccggttggaggaagctactccctgtttttcgttagcacgattttttaaatattaaaagttttctatatagaagttgttttaaaaattaaataaatctatatttcaagtttgtaatagacaatactcaattaatacatactaatggattatctcgttttacatgctataaaaattttcagccaaaatgctttctctgaaatgcggcctaagtgtgaccaactttataaaagagttgaatcaacacgtataatattaaattaatttcattaaacttcatcataaattatatcttcatattttatttattggtattgttgatgataattattttttctatgaacttgatgaaagttagaaaattttgacttgcaacaaaactaaaacatcttatgatatgagagagaaagtactcgcaaaccttcatgaactccttaaaaatattaaaacataaagatataactaagtactcataaaaatttactcaaaataaaagcgcacaacaaataattaacaagaaataagtattgaaatggccatttggatatactccatatcaaaggtacatgaatacaaggagagaaaaatatccaaaataattttttgcatgatgctgaacaatactttaaatttcctatagattaaggtcccctttaatccctttgatttgtagaaaaaatataggaaatttggaagatttcaatcttatacaacaaaatttctatgaagacctttgaaacaaatgattaaatcctttcatttactttggaatggacatcccgatagagattttggagaaaatttatgaaaggcttcaacctcttgaaaaaatttctttgatccgattcctatgtttttagtgtgttatgcacttatatttctatcaaaatcctttttttttctatccttcctttttttttcaatgctatctttcaaaggagccctaataagtcatgtatgaattttatacgattcaaagaagcccaatcctttatttcatatgattatttatgaaaattcctatagtatatatttctatataaaacctcttcacagttcaaaaggaggtctacctcttgatttcactagggcacattataattttatagttagtttcttaaaacaaatagtttgatatcacaatatctgaagcagaaaactcaagtgttccgacaaagcctaaattggcaataatagtgatgtacttcacaaatttcatgattcatatacaaatctgctaatttgtttgtatgcctgagttcatttggcgttaccaactcgctgatacactctcctatggattgttgctaccgtgtgttgacgaaaaaaatcaaacacaccggcatgggagatctgcttagctcctgtgcaagtccaaatcttgatgagatgcgggcatgccagtcagtttgatcctgcaactgacaagatatgcaaacaacagataaaacggccgattggctgataagccgatggagtagttccagccgataactgataatagccgatgccgataccagccgatagcgatagggtttaagcaatcggctgatataaaggcaatcggctgatgatgatgtaatgaaataacaatataatccagtagaaaccaatcggctagaaacaagatataataagcactgatctgaaggttaaagcatacatcggctagaggtccgatgtcattaaatccacaggattagataaacaatgaaacctttgttgcgatcggctaagtccaacttatatgtaatctctataagccgatgcaacatccagataacttatcggctagcactccgataaaacatcagcatgaacctatcggcttaacaagacttatattatcaacaacaatctagtaggtcgaacctaaccgatgcagcacgagattgtatatgataatctaatactcgatgagccgatagatctgtctaatatgatggatataacaaatctatttataacagcattgtgattgtagagatatatcggctaagatagaagatcggacctaactgagacagtcccaactaaaccgatgcgtctctaaacacaatgcaactagagatagaattgaaatattaggtaggcaaatatatcaaccaaaccagagcgatccaagagatcgaatcgatgcagccttgaataacaccaacgtagccgataaattcaccagggccggcggaacgtaggacttaccccttcgccagagatcgaaagccgatgcagcccagcgtcaggtgccaaattccgccggttgataaagtaaaaatctcaggaaagagggtggcgatgcgccgagaatagttacattgatcgagagattgataaattacatagaccctgggtgtacatatttatacacatgggttgatacaagtccttgtcggacaagaaagaaactatcctaaagataaaaggaaaacataaagtccttatcggacactaaacatactttcctaaagataaaaggaaactaacaaactattcctaattaatagataacttgccatgccgcatccttcttgaactcggtctcttctagataagcttccttgaatagatcaatttccttaaccaaatcctccaagaatccgactgctggcgacttaataactctcgtcggctgattccgagatgctaaagccgatactgactctaagccgatgatgactctgggcttaccaaatttcgtcgttaacaccatgccatttttctttttgttgtgcatatatacaactaatttctatagtgaacctcactaaggctgtgtttggcagctcctcttcccaacccatctccctcgttttctgcgcgcacgcttttcaaactgctaaacgctgcgttttttgttaaagatttatatactaaagtttcttaaaaaaatcaaattaatccatatttggaaaaaaaattagcaaatatttaattaatcacccgctaatcgctgctccatttttcgtgcgggcacttagtgttgggaaccaggggttccgaacacaccctaaattcgtttatggtttctatggttttgactttgtcaggtaaagtcatacacacacagaaactacattaagtcacattgttataacttatgttgcaatgtaacccccatagcctgagtttctgttcctttggtatgtgtaactaagttctaactcataccaatgtcgcttctcttaatacatatttcctccgtccctaaaagagtattattgacgggctatacctgacaacggtattttttttaaatataggggacgttaataccaggatatacgcgagatagcggtaaagtagatgggagacagtgatttttatacttgttcaggcccctgaggtgggtaatatccttaatccaaattatatgaatggctcttaaatgtatctcacatcaattacaatgggggagaaagctagctaatctagcctaccaactagtattcgtcgagaactaatccgatgacttaagagtcagtgactagctattggcttcatcctagcttgtattcgatgtggtttgtggctatggatcatgattcgatgccctcttcctgagggctatatatttatacgtgtaggcaatttcttgtccaagtagaaatcgaacagttcatgtaggatacgagcatatatgacattgccttccctaggccgaaagcacttcctcctgcactcctgatggtggttgtgggtggttaccgacaaacaaacatcataagcaatcgtcatcaggtgctattaaaggaggagagcttcttcacttgcaacacacatttcaaggagtaattctctcatttcatacgttatattctctctattagtagtggagtttggcttataaatagtcttcagtcctatggtcttctctgagattccggtacgtttttagtactttacttttcttgtaagataatagttgcaataattgaattatcttctttattatattgtgttcatagttcattaattatgtgctctatgaatatattatacttcatttatatgcttcacacgactaagctagtcaatctatgctacagtaatggtttaatgatcttaatggattgcactagttctaacttatccatgcgaagggtgggagtctcgggggaattagtgacattatttattaatataagcatggtgattaggttaggtaaatgttgttggatgtgggtatgccttatgaaaagtgaggtaggtggcaagtagtgacagctctgtccgtcttttgtattcctccatgtccgggtattacgtaagagttcatacaatgacataactatattggcataccagcactgagtggtctctcgatagtacctgggtgcctagaactaagtcctagccttaagtatgtgtgtgctaaatgtaaactaaacattacaaatatagacatacatatgaatcttagctttctatagttcttctccattgcctagtgtatcattattaaagatgaatctcctgtgtgtcatgctatcccattatcatttatgaattaacccatgtcaaaccatggtgaaataattatagtctgattaaggaatatatgaactctatctttacaccgttgttttccctacggaaatataaatacgatatccttggaatactcttgggtaaaatgctacagcagtatccgtgcgctcgtgtatttacgtgtgaccataagaaataccaacaaggacattttcaaaaaactaataatttactagatgataccgcaactcttattttattatttccaatccaatgaaaaagagaaaccatgttaaatgatgattttgcctcacgggccagcacatgttattcggcttgtttggtcgaaccaggctttctccccgtctcccctcaaaaaccctagagccgcagtgacaactatattttacaacttgtccaaattctacctcaaaaaccctagagccgcagtaataactacattttgcaacttgtccaaattctaaaccagatcaaaaattttgttttcttccccaaattttcaaactacatatgatgcaactcccaatataccgttgacgctccaagtattgttattatacatcatttctacacattacacattagtacagttgagcgctaggtcagaagcttgtggcctaaggggtattcttgtctttttgaaaactttacctctatattattttagaccaaatagagaggtaaaatttgtctctaagaatggttgtaatatcttgcaacaaattatcagtttttggaagtgttattattcaatagcgacacattaagtgtcatatagcaaaatttaccttattaatgcggagaaaaagaggaggagagaatactactggttgagtggctaaaaagatctactgcatcactctaaactacgttgttttgtggacagattttaggctaaaaccacgctagtatatggaaatgcatttgtccattatttatctaagatacataaattgattgccctacttgatttatgtatgtagttgacttcgctttggatgggttctgtaacggtggtacctaaatacagctgtcaactaaccatgtgactacgtagcaggatgcaagcgggcctacctgcgagtctacttatagatcaaataagtggtaacccgtgggttttcgcgtcgtggtccggcttgctgcaagatataaatatgttaactcataaacttatttatagatcaaattaataggtaactcacgggtcaatccgcgacttaccactaattttacctatatacaggttcacgggttagcctacttacatttcttctatgttggctcgagcttgaaatgctctcgagcctcggctttgttgacaaccttatacctaagtatgtatataagtgagttggagcatctccaagacagataacaaaaattataaacaatggattaggaaaaaaaaagtaggcccaaaaacctttctcatcttcaagagaggcaaaaggaaatttagatccaaaattagtttatggggcacgtaggcaaacatggtgggaccggtagttatcatttttctttcgttggtgtgatctttttctttttctgttttcttgtacacagccgatcaattttcccctcaatttcaccaattggaagtgaagcgccggttggaaatatgatcataaatcggtatattttaatccaaaatattaagataataaacataacttgcacagtgtgaaatgatctagtgataaaactaaaactaaacataaccatgagtatgcttaaggtaaaataagtatcaactataagacaacgcaataacattgcgactaacatatttaaccgaatgaaaggtagcagaaggatgttataccctgtgaaagtctctctgctggattatgaggcagaattgtctccgttggtgttgtcgatcggtgcgccacctcctgctcctggcgcaccacctcctgctgcaccggaaacgccaccaccagtagacatcgcgatgcagtgcctccgttggtgttatcgatcggcgcgccacctcctgctcctggcgcaccacttcctgccacaccggaaacgccaccaccagtagacatcgtgatgcagaacatagacgaagaaaacgagcggagcaatcgtgcggaagcactccccaaaaacacagaggaagatgaaccaagcggtggaaagaatgcacggaggaggattcgcttccgttaccgcagtaacgacgcaatcaatgagtattgaatcgcctgcccgtgcccgttacagaggtaatctcgtggagttgaattctgaaccgatgcaaaaggagagagagacgagacgccacaccacggctcggcgcgcgcgcggggctttccgatccccatctcaaccggtcaatatggagcctccaataactccctatttaagttgagttactccacttttaattcccaaggtggtattattatctttaatatttattatgggcccttgagatttaatagaaataaatcgggcctaacccatttattctaacagcgcctattacatgctatagatttacgagcatatttaagtacagtatggtttttttgaaaaaatatatcagtttcttataatagtattttaaattaactttcaactttgtagtatttaattcatttatttgtgcccacaaaatgtattaattaaaaagtcagatgatcagataaaaagactacacaccgagtcaattcaggttgaagaattagtgcttaaggactacctttaaccgcctttgagcttttgaaatatgacccttttttgctggaaagcacagtgagcatgacacgagagatgctcggcgaagggagaacaaaacctttgttcaaaaccattttcggtaggattccatagtagaggattttctctaatctcttactcttcttacaagaagacgggttttaaaaagaagaggctattcgcttatacgatacctttttttcttacaaaactttcatttggtatgccgtgactaaatatagattttattttcttttagaaacacagacattcacaacgtgttacgctcatcactgtgaacatgtgcatgtacatgtaccctaccctcaagagtaacttcggaagactgagttggtaacttgagattgataaagtctgatatatatctcgctgtggatgaatatctagttgatcaaatgattgtgaactttgtttgtgttatggagtataagatttttattaaaagttcatgtagcagttctctttttttaaaaaaaaatgcgacatacatattgtcctttcttcttgtcctaaaatagaaactccattagtgtttgtgaatactccggatgccagttatacctgatcgatgttgattaaagttttgaccgtttcattataagcacaaaataccgtaactgtagaatattagtattttagttttctttatgagaaaattaagctgtcctaaacacttagaactttcaaacaccatcgatcaaagcttgttaattgagtcaagataaataaatcatcaagaaagcaaagtattagggcaatccaacccaaaaaatagagtaaattgcatcgccggtgtatcaacttggcatgtgggtgcaaaatagtgcaagaacttgagaaatgagcaatctagtgtaacaacttggtagataggtgtaatttagtataaaaattttataagtgatcacataaatgcaccaacttgcaaggtaggtacgattttgatacaataattaagaagttatgtggcaacttaattatttgaagcttatttatatttttatcatagtaactagtaactgaatttcaattaaactgaatgtagaaattattatatttggttgatatttgagaaggtgaagaaaacaaaaaattcttaaaaggtaattgtgtcgacggtgggtacccgtagaccggatatagagggtattggggtacactggtacgaggatctacgtagtacgacatcaaggaaacaagagacaaagattatactggttcaggccccttagcaggtaatagccctaatccagttgatgtgggattatattgagagaaccacagattacaaagggaataatagaactcggtggtaccgacgagatcgtagtcgagttgattcgactagatcacccggcgacttggctcctgtagtctccggcttcgtaggctgtggtcgttgtgtaggctatgagattcgatcccctaagttccctcggggggttccttttatatcgctggtcaggcggtctccaggtaggaactcggagacatcagaccctgtacgatatagtaacgacccagtcctacacgggtaggaacctttccattggtagactccgtgatggatttccttagcgtgtccagataacgtccgtatatgcaccgctatatcgtatttccgtatagcatacatccaagggtagagggtataccttatccgtaaccctgacaaattggatgtaaattatatgtgcagtataatttttaaagattaaattcaatattataaggtaatatccgtaggattactatgtaatggcgtattgacatcgtgaaaaaaaatcacctagcgtatgcttagccaaattaatgcaccaaaattctaaattatcaagttcttatactagaacgcacctatttgtcaagttgttgcactcggacgttcaattctcaacttcttatactatatcgcacccacttgtaaagttggtgtaccatgagtgcaatttactccaaaaaatattataattttcatacttgccatatcatatagatattatgcatgagaactatttgcccaatgggtggtttattcaaaataaattctcgtccaatcaccttcttctctctccttttacccacctatcctttattttcatttttcgtttacgtgtagagcagtttttttcctaagaattagtttcctcatatttttccctctctcttcattaactctcttgccatctttgctctttacttatgtggcagtgtaattagggtgaataagtatagtttcttatacaatacaagattatttagagatcgtatctttacaacagtaagatgacaaaagctctaaccattacctcaaaaaatattcttttgattctattctttccattttttcccctcatgcagccatgctttcatattatagaggctaagagttattgttacccgcaacaatgatgttttatctattctctttctctctattttatgtcaacaagcatttttaattaggaaagctaagacattgttataaataatcattgtacatgtccttaatgctatagaaattagctaaggtggagggttaagagtgcccttaacagttacgtgtccccgagaaatagaaagttagaaacgatcacgttgttcttctatcaagttctgttcatttttctctttaggaaaaagaaactgagtgctgtaactttgtttttgggtagaaatgatgcggtcggggaatcaacggctgccgtgagcgaatagcctcaaaacattgtcgtccgtccgccgcggcgggccctacgcgctgaactccctaaaggcatcgcgtccggcgagtagcggcgctgaccagatcagccgagtgcctgcctaatgtggctgtctatgtggccgaattttgattattgtgtctctgactctatcgttttttatttttcgggtggtgagtgtgttcgctagcaggagttaccaactccccccccccccccctctcctttttctccttttccgtgtgcacgcttttcaaactacttattttttaaaaaaaatacttccttcgtttcatattataagactttctagcattacacacattcatatatatgctaatgaatctagacatatatgtgtgcctagattcattaacatctatatgaatacgagcaatgctagaaaatcttataacctgaaacagaggtagtagctaatacttaattaatcacgcgttaatggactactccgtttttcgtacgtgggtgatgggttcccaacacccaccaccgaacacagccaaaataacacgctgttaacgacgaaatttggtaagcccaaagtcatcatcggcttagagtcagtatcggcttcagagttatggaattagccgatgggagtcatcaaatcgccagcaaccgtgttcttgatggagtcggatcaactaaagggaatttatccagaagagtccgagttcaagaaggatgtggcatgtcagtttatctattaattaggaatagtttattagtttcctttatctttaggaaggtgtgtttagtgtccgatagggactttatgttttccttttatctttaggaaagtttctttcttgtccgacaaggacttgtatcaacccacaggtataaatatgtacactcgtggtctatgtaatttatcttcacgatcaatacaattcggcgcatcgccaccttttatcttttctactttattttatcgtccgacgggacttggcacctgacatggggctgcatcggtgttcgatctctggctaaggggtaagtccaatgatccgccggcccaggcaattgtatcatttacgttgacgtcgttcaaggctgcatcagtacattcgacctcttggattgctctggtttggatgatatatttgcctacctatttatcatatgtctctgttaatctagtcttagcatatcaatttagctttatcggctgcttctcgttttaggatttctgccggtatcgactaaatcgcgttgctagattagattagcttagacatctaccactctgaaaactcagtcaacggcttgattatctagatattatgtttcttttcatatttagtgctgcatcagttaagtttgatctactaagtcgtgcttagaaccataatctctagcctgcttcttgattgccaataagggtttcatcggggtttcagccggtgagttatctcgacgttgcatcggctcataaggattacatatacatataagttggatttagccgatgacaataaaggtttcactgtttaatctaatcttgtggattttatgacatcggacatccagccgatttgtgctttaaccttcggatcgatgcttatttatcatatcattatttgccgattggtttatactggattatattgttattttattacatcatcatcatcatccgattgcctttatatcattatctacattggacatatagccgattgcttgaaccctatcgctatcggctggtattggcatcggctattatcggttatcggcttgaactactccatcggcttgtcagccaatcggctgttttgatatactatttgcatatcttgtcagttgcaggatcaaactaactagcacgtccgcatctcatcaagatttgggcctacacaggagctaagcaaatctcccaggccggtgtgttcgatttttttcgtcaacacacgccgttgctcaaactggcttcagtcgacagaggagccgtcggatgaaattagggctactaaaatagctcgaggctacctcaaaatcaacattggtagctaaacgtaagaatgtcataagagattcaagcaggatgacgatagcgatgtatgatactccctccgtttcatcttataagatattttgactttggttaaagtcaaattgtttgaagtttgactaagtttatagtaaaatataatactccctccatctacttttgatagtcatatttccaaatctgaaaattttatttttgataggcatatttcaatccaacaacttatcatcttaatgactttcttggatttaatgcatgactcttcgttcttccacacatgattggctacatgggcattgagaaatgtaaatattaatgaatcgcttatttacgaggaatgactagtagcatatttaaatggatgataagtagaattacttatccttggtctatgtgccaagataaaatatgactatcaaaagtagatggagggagtaatatttacattaccaaattagttttattaaattaataattaattatatttttataataagtttatcttgggttgacaatattacacttggttaaacttaaagtagtttgactttgaccaaagtcaaaacatcttataacctgaaaaggagggagtatttactaacgaaatttagtcgaaacctacatctgcaaggtactaattatgagtgctcctcccggatcctgaataattataatgtatcagagttataaacgaccctcggtcggacgacgttggcaaccgctacctttcgcctatactaaattaccatgcggttataacaggtatgcctctctatttaagggagggtctaggggcctatttgagagagcttaagattctgagaagcagctggttggaagccagcttctaagaatctggaaaagctgggtttctcagcttcatctcaaaatgtttctcgacagttgtcgatggtttccttgaaaatgttcaaatcagctactcatcacaaatcccgttttgaaaagcagtgagaacgatctcatccttactttcaggatcatgttgcgtgcctccgagaaacactaggggtatgtttagttcacgttaaaattagtaaactaaaagtttaattgaaattgaaacaatgtgacggaaaagttgaaatttatgtatatagaaaagttttgatgtgatgaaaattaaaagtttgaagaaaaattttggaactgaactcggccctgatgtagtccttcaatgactcgttttttcgttgttgaatgagaacctgacctgacgagacgtaaatgccttggaagttggcaatgaaccgctcccgaacctcgcccccggaacgaaatggattcccgcggaagccccgaaagccagctccctgcagagtcggcgagtgccacaggaaggcagtttgcccaagttgagtacacgtgatttgcgaccgaggatgtggtttaacgaagagaatagggaggttaaatagacttacgttttttttggtttcagctggtccactagtcggccgatccaagaccaagctagagaaaaagcccatacttggcccatgactccttgcaccatagtcgcaatcacccacccctcggactcgactcccggagttggcccgccgccgccgccgccgccgcctcgcctgcgtcgatctccatcccgcgaccggagctccacctgtgccggcgtctgctgcttccaccgcatcctcgctagcctgccccgccggtgagcatccatccatccgttccgcacaaaaatcctccttctcatctctttctgctcgattttgagttagccctagcagcttgtcttccaggagtagatctggaagctgcttctctcgttgccttatgccttagctctagtactaatacccagtttagtttgttcccaagaaaatttggtctaggtccacccatgccaatttaggcttcactgcttgcagatacatatagtattgatcgttggttgcaaatcacatgctccagcgagaggaagcaacgatggcagttgcattagcttcatttcgcgcttttactctttgtcctatttttgaacggttttcctcctattttttcagtgaaactggacaagaatggagaacatgcagtatgctgaagaactagtcaaggaatttcttgtgttcagaggcttcacgagtactctgcaatcgtacgagtcggaattgtctaccgagatcgggaggaactttcaagtagacaagatcctagatttggttttctcggtgtatataccaaagtaccaattggataggttgcaaggtctgtttaccttttttaagcagtgcttcacttcacctgcggatgcggagcttttctcggctctcattaaattggagctgtcggtgttacggtattatgttgtcaatgcattgaaatctggaagacaagacaaagtagttgaattcttcggtgctaatggcaattatctgctgcagaagcgtgaagactggcaagcatggtttggtgcgtattcttagttccttttgctatattccatcaagtgtcaacctcattcttatcttcttgttcttaattgtgatacacagctatgccatatatcacgagcccaagcttggatccacaattccgtgtatatttctccaaagaatggtcggacactttgattctttcattccgaaattttttgagcgggatatttaatggtcttcatatccttgaacaacatgttatttgttttattcttctattcttcctcaagttggtagtaaacatgtttgctttctataatatgcaagaactccctaaatgggatacaacataagtgcataacacctttatccacattctagttgatcatcaagtaaattgtattgtatgtttgttaatgtgattgttacctatatttgggttaacaaacatattatgttttgctcaacaatgttttctccttaatttttccacgaattccagctcttctcaaaattagcactgaaaagaataccattaaatgcctaaagaacgacataaagcaactgaataacaaattatcagagctacaagcattgttagagatgaaggagactgaaatatctcagttgagaaggtaaatctatgctctttatacattacactgcagcataactaatctgtttgcacatgcatgcgtagcttttgtggagattggatgaaactaggaaaattatgttcactaattaatctaacagtaccttcatttcttattacgttcagtatccagttaatgtaaagcatgaagtaaaatatgatttctaacctccacccacatacatacacagcctcacactcggaaactagaaactgctgtgtttcatttgttttcatgccctcgcttgccttaccaagttagtttcgcagtggctgaacagttcaaactcgatattcaagcgtcaagcatttagattcagagcacttcaaactcatttcttggatttcacataaatgtcaacattacgctaccttctgcccaaaggaatttatgtctcaattgataaatacaggaatagtactggtgttgatttgggcaacatgaatgttcccaacactagtgcagctgactcttctcttgaaggacaagatatgccaggagttttcgaagaatcctcagcttcgagaagcgctgcacagggttttgattcacagtcttcgagctcagtgaaatcttctacaagagatgagaaattgcacaaatcttttcaaataagcaatgcaggttacgtcttagttctatattctttcaatggcacatataagtctctttaccattggttatgcaaaatgagcaatgttctgttgttatttcacttacaccaaaacttactcccattttcataatcctttctgatgcccttatggtttggattgttttttttgcattatccaaaaatattgccacactttaatattcttcagtactttggatgcctttattcatatttacaatactaaatttattcttacatgtggcaacactgaagcatcacatgtttctttgttgcagagaacgagcagattttggtgacagaggatgactttccagaagtgaaagtggattttcaggtaacaataatcaattcctagtagtatatcatcctttttaattccctatatgactaatcaaacctgctaacaggaaacatttttaggccataacagttcaattagctgctgtcgattttctgcatctggatcaaatgttgcaagttcttccgttgatggtacagtgaggtaattgtgccatctccattttcctttggttgcctaactgatgtttctagattttgatccattggttttacaattcttaaaaagaatctggacatatgattcctcaacaccatcatccaaaaatgccactatatactgtgggtctgaagtcagtgctctttcttgggaatgcagatctgaccgcttggtatgtgatgtctatattggattttttttgttatatcattttttacagcatttgacctttgaaaaaacatatttaagacatttcattttatcacccatttctcttgacaatagctgctcataggcacagctaatggtggcattaaagcttggaatgctgatgcaaagagagttgtttgcgacctcagtacatcaaaagactttcccaggttacaactgttactttcttgcttatcacttaagtttatgctaatggagcttcttgatctcttgcagtgtgttagatttgaagtgtagccctgtagaacctgtgtttgtctctgcagctgcatctagacggtactttttgaatccttattttcataagaaatccatttccagttatttcaaattgatagcttccttttcctacaatagcagggaccactgcatttctgttttgtgacaaaagctttggttatattttcattgtacatgccatttaactttataaaagcttttatcatgttgtatcttctagatttcctacaccactgtatgattaaaatctaggtggcatttgcttattttgagctttgaattactttcaggcctggatcaactatatttgacagaacaggatttgcttccttgactgtatggcatatgaaaacatggaaacctctggtacttctattgcttatccccttgtcttaaacctatgtgtggattcggctagtaagctcttcctccatgataatatctttttcttctattatgaagacagttctaccacttggggaggacccacctgctattacttcagtttgcttcaatcataatggaaaaatcttggcagcttctgcaacagatgggatgattcacatgtttggtatccttttttattttaattattttattaatagtcattcagcatcatacgtatatattaagttatttgcttttgatctggaatatggtatcactacctggtgcattgtttgtatgagatcccatatcaatagtttacttaactgcacaaagacatgtctgctggtcttcagatcactggatggcctgcccatgattcccctgtcagctctgttcttttcgggcctgctgaaactagtatatttagtttgggctcagatggaaaggtatgtagccccttttagtaatcacgttgattctaacattgtatagcactgtggtacgttcttatgaaggactggactctttggttataaaaacaattttcttattttttcaatacttaatcagtgtaagaaaattaactgctctagcgtttgttaaggttaatgttgacgtcacaagtccatgaattcattttttacttgtacaattatttcttttgttatttttcatagtcccattattttatctaatgttaactatatggttcttagatatttgagtggagcctgcacaatcaaggccagattctttggtcaagagattgcagtaggtaagaatatgtggcacttggtataaatcattgctgattctcaaatggcaactaatgctaataaggtttactcattaggggctattagaattggtacaaatatttttcaaacttgatatgattcagggagttgtgggggttgagattttataaattaaacgtgtttactgtagccactctagaatcctggcaagatctctatgctaatctattcattctctctgttctcttgagcaaccaattattgcattattgcttggcacatggacatcacaccatttctttaaatttgtgtggaggaaacccagtagtcccagaagtatttgtggacatattttggtttaattgcttgaaactctcatatactggtgatgaatttagatatagtttagatacagcgtgtggataattaagattgtcccttttttatagtaatcttgagatctccacttgaatacaaagattctaatatctgatatgatggtaaatttcttgatactggatgaaaatttggaagtttatcacattgtatgttttatcagttaagagagttgtatttgtctacgcaatatacattattatttggaaagaaacattgtttacacatcagattgagctgcattttatcaatcctgattggagatgctgtatttaacggactgcaaacacagtatattttgcaaagtgaacttatcagaccatttcctcatttttcctaattgcatttctatcaccaggttttgcagtccagagagctttagcaaacgcatgcatgagatatcattggattctgatggcaagaggctgttggttacatcgggtcttgtccgggctcctatatatcaggtctccacaatcacccaaacttccaggttcattttgcagaagtgataccaatgcaaatcatctataatttttcctcaggtacaaggccatgaaagtgggctgaggacacttgctcatagtgcatctattacaagtgtggattggcacccgacgctaccaatgtacattactgggtctgcagacaactctgtccgggtcacatccattgtatgaatcaatctgtgagtgtgacaggcagattgctctcgaggccttgttgatttctcgatgcaaccacatacgccattccatgaggtgaccagtggtgcgccaaatgattatccattttcctaaataggcctggcctctgggtttcaaatccccaatacgtgcttcttttcctaccatataccgactcagttgtcatgtccagattagtggcctttggttcaggatacatttttgcgttgaaggtgtcctgcgatggtgagcttctataacctttttgctgtagaactgcatgagttatgcaatctttacaacagggtttgggaattaaaatcgtagcagcaggtttcgtcctaaagcaaaacagttttgtaatccttgtaacggcagctggtgatgaacagtatcagtgtgtgtggtgtcagccatttgtttattgcaacaacattgtagcctagcatttgaaccaaacaagtacagggcccaagtattactacatttgttgcatcgacatgagcattgtttgtgtggttgggaccaaattgacctctaaaaaggtgtcctgttcttccctgctgcttttattgtgtgtaaaactatatatctcaacattgtgagtttatatacatgaatgcgtgtagtctccatgtgggccaatggttatctctaacatgcggagatatcctgtctgaataaatcagaaccacaggttgctgctctatcctttgttccttttggcctgttaagattgaaactgaggtggatagtcaaacattacgagaagcaatactactcataagacgttttgactccagtaaaagttaaactactctaagtttgactaattttatagaaaaaaatagtaatatttttaaccaaagacaaatatattatgaaaatttattcaattatagatttaatgaaattatgctggtgttgtaaatattactacttttttttctacagagttagtcaaatttagagtagtttgactttgactaaagttaaaacgtcttgtaacctgaaacggagggagtatttcggtggattgaaattctgcaattggacccataacctgcactattgaagttagctacccaaaattccttacattatggagggagtaatgtcgaggcccttttctgtattggctctacggtcctttcggtgttttcagcctatgcaacttatatactccatccatttgaccaagcttgtttaaaaaagtagtaacatttttaacccaagacaaatatattatgaaatatattcaattatagatttaataaacttacttggtgaagtcaaacgacttcaagtttgatcaagtttgtagataaatgtagtaatatttgcaacactaaataagttcattaaatctataattgaatatatttcataatatatttgtcttgagttaaaaatattactactttttttaacaagcttggtcaaattagagtagtttgactttgaccaaagtccaaaacaacttctaatctgaaacggagggagtagaatatcaaggcaccgtgttaatttcaattcggagtttcggggtgtggcaccatgttaaactagttgatgcccgcgctttactgcgggatatgtggatgaatgtatattatacattataaaaaatgatagacgtatatatgtttagataatgtgaagatggtgatttaacattgcttgcgtgataagttcaaacaaaattttttcgtcaaaaaaagttcaaactaaattacaaatgatatatcatgttggcatgaaatctagaatactctgtataataattgctagtgagtgatgatatggcacacttgcatgttaaactttaaaagttagtgggtatcagctatatataaagtatagttgtctttggtataagagcaggtacaataagatccttttgccggtgacaacggctccacgttggttttgattgtgcgctggaggagagagaacgcgtcagcgagcgactaattagtcaccgagctatatgcgtgttccgagaaattgtgggcccaagcatatgagagttgcgggagccgggaggataggatgatcgatgcagcatcacgatcatgcggaataaaataaatatatgatgcatcatgattatagcccatttattgtactatatttgcctcttaagtttgatgaagatgatgtggaagaaattggagtaagcaatgggctacactattaaacttcctctaagtatgattaaccatgttaaatgtgtttgcacacgagacacgactaaccatgtaacgagtaatcttttgacctgtgccacgtcatctcaatctttggcccccctgctctcgcaagctcatgccatggccgccgtcgctgccaccgcgccggcgacctccgtgaccgccgctaccttctcgccatccctcccattgctctctcgctaccaactcccccgcgcccaccgggccgcgtccaccgtggcgttcgccgcgcgccgcttccgcggcgtaaaccctagcagcgaccgcccccgcgggaggcgcgcctccgtcccggccgctcccaccacctccgccgcccgcgacgacggcggcggcggcggcggcatcgatgccctcgaggcggagctctggcgcctccatcgccgggcggagctgcgccttcaccgcctcgccgccgaggccgacgaggcctaccgcgacctccgctactccgcccgcgtcgtcggcggggaccgcgtcgtcctcaccttccgccgctcgtccctgcgcttcgccgccgccgcgctcctctggtcgctcgcgctctccgccgcggcgtgggcgctgctggggtgggccgtccgcgcctggcagcggcggggcctggggtggcgcggaggggaaggcgcggccgtagtgcggaggagggaccgcagcctgggtggcaaggaggtggtggtcgctgtgtcgtcgtccccggtggcggctccagtcagccgtgtgcctgagccggcaagagaggtcaagaggagggaaccaaaggcaaggcttccggaatggtggccggaattgagagaggaggtggtggtggatcaggggccagggatggaaaagtgggcgagattagcgaatagattggtccgaggtgaatgcctgttttatattagctagtctttcattggatgcaccttggttgaaaattaaatacgcgtaacatatgggaaactgagaacaaatccataattcatttgtggtggtaacatttgggatactgagggtggtgttaacatctttttatttgttatgatcatcactcatgctaagttactaatagatgataacaatgcaaaaactgcaaaaaggttttgttttggatcccattcaattcatcattattaggagcatagtctttgaattttcagaaatatgagaatggatcaggtcatgagagcttgttagtaataacttttccaattgctatgcttcagtaccgattcaagaccaaatcgtggtataatcttcaaaagtcaatctttattgttttatggcatcgagcctaaccaattctaagatttctatcaaaatggaaatgtgaattcttctgctattgtattgtcatatgtgaagtttggcaatagtttgtttttagctactagcttattttttggcattttatagaatataagaacactcatcgttagtatgatgatccaaatagaaaatattcatccttaagatttgttatgatcatttgaataatctcctacaatacctctttcccctgtcttttgaacaaatatggttttatgtggtaggttatacaaaatagtaaatacctaataatcttaccttttttgttggcaggtaatttataccatctttcaccatattcatgagaaacttgctgcttcatttctcagacctttcaatatttccttgtgccagcaatcattgataatagaatcacggggaaggattacaaatatgatgatgcaattcaagttagtattcattttacctgtagtccatagaggatatagtgttatgatatttcatttctgtataatttctatgcttgcaattgagaggcattggcatcctcttcatactatgttctatggattagaaccagactattttaggtcatccatcttatcctgactcttgcgtggatgttgtttgtcatggcagcatgtagttccacttaagcacctattcagccaacaaaatgaattatcttgcttggggcactaacagaaatttgtggacttacctcgtttctgagatcagtgacatatctgaaccatcggaatatgatggctattaatgcaatttattcttgttttgttccctactgttatagaactttcgagctttggagaaagcatcacaaccctgatctgttgtatgaatttatggaatgatacaaatgttaggcattaacatgtcaataaatgaaccctgaatattctagtaatatggtttataggcatgatcttaagatccttggctattctgttctaaatgttgttaaacggatgatttaagatatttttggcagaacactccaaagttatccaatcttaggtgcaccagagatgttatttgaatattgctacagtttatctaatgatagggctttccactcttgcctaattatatctttcttttgaatgtagctaaggcaattatgcaagatatcaggtgtaaaggtctcttttgacacagagaatgctcgtgattctttctatagggcggcaataaactttgttctggatgattgcagcaggtgtatttttgtttttgcttcaacctttgttgctattacctccttttgttttactattgattttattatcatctccattgatctgcactgtgctgataatttctgcttaataaagagcagcacaagacattggagcagcacaaatcagtggggagaatccaaggaattttcttgctggtcttgctagcaatattggattggataaattccgtgctgccacacttgtttgtgcatcagttgctgctcgcacacgttctttgttcttgcaatgctgggtacggatttacctcgattttcaaacctgattgtgtttttacccatctcatggtcatgctgatgttatgtgttcaccgcatgcaggcactagagatgcaaggaaaacggtcagaggctctagatgagctctcaaagatttgtagaattcataacatgttccctccagaggaaaattctgtatgtatttggtttttgttttcaacttggttttgagcattactatttttctgcttacattttcagacacgtataacccttagttgtataacttgtcttgatgcctttacaagttttctgttgtcccaatgcctttacatgatagggtcaaaattttatgttgtgaatttgtttacattctgacagcatattgatatatatccaaactccaatgtagccaagtattaacaccaaggccaactttcctttttggaagagtagacatagaaagccaagcgatttactacagttgttttctgagtctggtgtatgttttagcatgttccatccctgtgcataataccagtagttttttttagtgaatgctttagaaatttaattcaacctgggtactacacagttatctttgttcttactggttatttgtctctagcatgaagcttagccttttttttgtgctagtttcatgatcagttgtgtcataatgttatttccctcagtcatatctgtctacctgagcataactgagcttattttatagagtaaatttcacaaaaccacagggttctataatttttttttaataaaaccccagctgttgaggcatgagtataacaaaacccctatttctgtcagctgtaaacatgggccgtacctctcagcttcacctttttcttcctcatccctttctcacgttcctttctagcagatcggatctgagcaaacagcaggtggtggtcagcgcatcgctcctcttccttcctccccctccctctcttctgccacctgccactatgcacacttgcccttctccatcactgcaaacatcagcagcaagaaattagccccgacagcaactggtatacagagctagcagctcgtgcaatatgaactcccaaaaaggcaatttatggaatttctccaggaaaaccaacaagaagcgaatcattgagcaatcaaccattatatatgaattagctatcacatttttaggggaattaaatcaactgttgtcatttgcaaggaaaaaaaaatcagttacaaagacaccctcttcctaatcttcagagcagtgaggcaagcaatggagtcattccttgatgcacagcgacagcgaggaggacgagagcagtaaggaagtcatcggcggcgctggcagtagtgctttcttggaatggaggtagagctcacggggcaaattcaccagatagtagtccaacatgagaattgatgggagaggcttgagcttgggcaatctgcagatgccatgtcgttgatgaagctgtccagctcccaatttcctgccgtgcaaccaccctgtgttcgacctcacttcacatgacaccttagctctcaccatgctgccacaggtaggaatggggaagaaagtgggggctttggggctaatgaacagggaccaccaccacctgttagttgacgggaattggtggaagtgggttctgtgttacaatttgccccccagtctgttgtattgtgaaataaaatgtataacctgtggttttgtgatatgtgtgcctcaaaacctgtgatttgtgaaatttactttcagaaagatatatatgcttctgagattgtcattgctattatatgaacagattctaactgaatttttttgagtgaatgagaccattttttgtgctgtatgcatatgcatgcaaataaccttaatataacaaaaaaaacaggttttatatttttcgcaattttcaatgttatttctgcatattatcctcttaatggaaacatatttatgcaactttttgtttctttgtcccctacaggcggaaatggaaatggttgctggtggacttaagaagaatttacaagttgcggaaagggttcatctcttatctctatataggagcatctgtactgctggtaatatcagaactgctgcagaagctcttggcctggtaagtaatagccatgacccatgatttattttggagtagaacaatatatctgctatattatagctcaataaagtgaaaattctacacctgagtgtaaagtgtgctgttgtttgtctgtttagggcaaattaaagctccctgatacaactaattgttatgggtggggagtgggccttcaacgggatgatgaggtctagcctcgccaccctggagccgggttgaggaacagagaagggggaggctagcgatagggtttaatttctttcttgattgattccaattgactgccatgccactccttgtatagagctggctcctaacaaacctccgaacaaccttatctaataaagcctaacaaactaaccaaatgcgtgaggatacataagataagcgacatttatacattaataagcagatgacgtcaggatacataacgccaatacttcaaggaaaaagtttactttgggtcccttaactcttttgaaagtatacctatcaccctcaacttcaaaacttttcttccccgcaataacaaaaaataataataataaaaaaactgtttaagttttgtcctcaattcttaaaccagatcaaacaaacccaccttttaacacacctggttttcaactatgtggcatctgaatacaacaaacatgctcaatcagcaaccgaaagtgaaatggacaataaatgcctataatttccacaccccatttctcctttcccaagttccaacttccaaggcagcaatgcttatgcctgtggacacttccccggtctagggcaaggctccttccagtgggctttgtgggcttctgtgagggaaacggatcctcttgactttggtagcaaactcatagtgtgcagttgggcttcaaatatttgtccactgcatccaacatccatcctgaattgctgcatttttagcttacctaaatatacatccattgtagcaagcaagccaaaagactcattactaagatgacctttgctgttgcttgctacttaatgctatgtacgggaaccaactgcgatactttatactgcaagcagaagtgcagtattgaagtactactaaaatggtaatataacaccatccagtacaaaacaaaggttcatttccataaagtgaaacatccccaaaatgaatatgttttttttaagaaaatgaatatgccattttgagtagttgttttgtacattgctaaaaatataggtacatgctatgctcaagaatttgtgacctcgtttcatgattgatgaataagctacacaattattttgttttaaccggtgccaaaactgagcaatgatttctgttctctctgcaccattgctatgaactttgtcttttccctccatgctgtcatgtgctgtgctgttgggccgaactgggctacacttaggcaagccaagaaagcagcaactcaggacggatgttggatgcagtggacagtgtatttacataagctaaccgcatgccttgactttgctaccgaagtcacgatgttcttccgtttatggtcggttggctaggatgccatatggctaccaccatggcataattgacagaactggagcttattgaccttatgatgttatccaatctgactggatttttttttcttttcgggaagagagactgggtttgatatttggaggatgtagtaaatggtttccaaattggaggtgaaaattagaatatgggatgatctgggctgctaaaagtgaatttattcctattaaaatagtaattatttgaagagaaaattgttactttgccatataagagagtggcatgctcacattttccacagttcattgtcattgctaaaataacacaaaatgtccggtgaaaatttgctctttaacaccatggaatgaaaattttgcaccaatcatctcccctcactcatccattctggccatggctgtggcctagctagccactaccttgtgcgtcaactccagatgctgtcctgtgcaccctagcctccagagcataaactcattcgtcatattcctggtttagcatccaatgtggcaaaggagcaaattcacacttactttgtggcatattagttatatttaagtaactttgtggcaaatgcaagtatgctactcaactatttggctgaagagttcctagggtagttaaagggtatatgaagtatgtagatctgcacatatgttttccagatatatagggtgtgctcaacaatctttggatgaactaaaccagcatagattgatccaattacatatcaagaacaaatagtagcaagagagtgttaaggaatatagagtcctttacatgtatagtactatagtttatctctttacatatttgggcctctttttagttctatatgttgccttagggctattattacaagctatattcataacaaggtatcagagcatctgatccgtgctgcccccaggagattgatctcttgggggtggccccattttcgttttttcctctcgtcgtcgatggctcttcccattattggccgctcatccttgccgccaggtctctgacatcgccgctgtgcttctccaccgtgtatggctgtcgtgcgtcgctgctgtctctgcgtcactttctcatcaaaccagcgtcgctgcttcctccgctggttcctggttttgttgcttccattcctagtttgctgctttgagcagatcgattaggatgtgtagggctgttgtcttctctggttagggtgcacctttttgatctgctgctcctcgccttttggtttgcactgctttacatgtctgtcatctctgctagatcgatcaggataatgaaaaagaaaatccaccttccacgtattttgtcaggctctattcctcgttgcctgatgatttttgatggttccaatttcttttgtttctgctgtgtccacatactcaaatctttttatctttgaattttcttccgttgtgtcctcattctattttctgtttgagttcatatttgccctgtgcgtccacatactcctgtcatctgctgtcttcctccagtgttagccaattttattgtttggttaatctccttgtcgttttttatgcaacaagatcatctaggtctttttgtagctttagtggatcatttttctttgtcatcttgctgctcttcgccgcttttgcttgctgctcttgaccaaggatacttttcattgccattgtcacgactttatcttcggcttcattcgacaggtcttcaaggattcacgcttcgacgacattttacagagttggatgtattagctttatattgtctaagttttagtacttagtgtaatctctttcaattgcaatgctattgcatacgctttgcatttaagggaggatgttaagaaatagagtcctttacatgtatagtttatctctatacatattttggcctcttgtagccctatatatttgcctccttagggctattattcaatacacaagctattcataacagagagtttgcaggagtcaggaggaacagcatctccttatttttttttataggttaatgggcagtcaagctagagttatcaacaatcatgaacttacgctacatatgctctttaattggctcaccagagtcctacctttgctcacaagaatcctattcctgttgttttacttgaacacgtttctctattttctagaagggctatttatctggttgttttttcatgcagagcttaccagatcaatgagaatgcagatgctgctggaggactcattctgtccatatttttctagttccaacttctaattgcgacaactctattcggagtctcgaagccaccaaaaaagattggtagtgggagattttggcatcctcagccatcaggtctccagaagatgctgattcaggagcgaagcaaaccacaggaacagttccaggcggaacatgttgtccccaagaaagaatgataccgacacatcatttgttctccgtggcatccgattttgatacaacattagcttacacatttgacagtttcacaggatgtaagatgttgcattgagcagcttctttttgtaagattttgcagtgcagaagcacaaaggtgcttggtcgtggtacgagatgtttctttaaactcgcagatagtacttgccaagttgccattgtccttcaaggttgaaaattgcgatccattttacagtacggcctgaggggactttctgtccctgtcggtgtcctctctccaggcgataaaggaggtccctctccgtccggcccctttcctttatcaattccggtggttccggttgccggcaatggggaagggggtatagttcttcccgtaccctaattgttttctcttcttctttggtgcttttgtgtagttcatcagcatcgtgtttctcttgtcccagttcttttccatggattctggccaaatccatccatggagtggtctttgggttttgccatgaacgctccccgactggaagtaaagcaagtttgcttcacaaacggttgcgccgggcattttgttcatctccggcgaggcaaccttggatgcaagcctaggagagaagctgagagtttttattgttttacaatggaagcctcaaccttcaagtggaggtctcttttgggtatgcttccttgcactttcatctgtagctactcatagtttcttcatcaccgtcctcgtcatgatcaagcttgcaagttgcaacctagtggaaaagagaaggacttggttgttttttctagtttctttagaagtccatagcaattttcatgagcttatgtcaatttgacaatcttcaaggggcctttatgcaaaactgcttgtacttgcagttgactctccactagggataactcatgtgatatgtacttagttatctataatcaataaaatacatgagttttcaaaacaaaatttacactatggcctgccatgcccacttttgggcgaggtcggaatgtgacgtttgcatgggtgtacttaggggtgaatagcgagctggctcggttcggctcgtttgaaagctcgagctagctcgttaggctcacgagccaaaccatctaggcggccaggcctctcctcttctcagcgggtgcggcgcaggggtggatgcgggcggcgagcgagcggcagttcagcgccgccgcaacctcctccgtcaggcctcaggactctagcacggcggcgagctcggcgccgacgtgctgccgcgcgtcgccgacgggccacacgctccaccctacagccatctcggcggcgatgaggctgtgcaccttggtgagctccgcttcgagctgctcctcctcccagtagcgtgaggcagcggcggcggaggatgaggaggagcttgtcgacggcgccggcgccggcgccgttgccgatcagattcacgccgaaagcaacctcctgagtgcaagccattgcagcaagctacagagagcaaagtgatcgacgagctaagagttcaagaagagtgagctcgctcgatggcttgcttgctgtctagcttgcagtggtggtgagtgcactggatcactgagatggctgcgtatttataggggatatccggcatggttgcggcggccagcgccgtcaaatcttggacgggtagatatgtgctagattgtgggtgaagcgtacgtatccaaaggccagaaagtttgttctgtgcatcaacttgcctgaagcaaccgcagtgaatctagcttgagtagcagtaaagatttggcaatctttatatacgatttctgggtccaatcccggacctctcattgggccacgtggcacatgcgctgtgctccgttcgtattatcggctggagaagcatgccacgtattcgcacactcccgcaaccgtccgatgacaaatcaatggtgaaaaatatatccaacagacctaaatataaattgcacgagagtttatttttttaaaaaaatgcacgacctcatctagaacagtcgggagcagaggaaaaactcctagaaaaaaaaagcaaaaaaaaaaagagcgagaaaaatccagcgaaaacaacagattgtatattcccctcgcctgatctccatgccgggacgatgacctcgagctcgatgtaccaccggaagaaggccccgcccagccttaatccgctgcattgacccagagcttgccggcccgcatggtgccttgtcgtgcgtcggccccggagctcaccggccagcgccgcctcggagcgaggagtaggggcggcgggggtccacgccatcgccatatccatggggaacagctcggctcgacaccatccttctcgtcgccagcctcaaccgcctctgcgacagatagatcgctcacatcgcctcctcgacaacctcctcgccggctcgccgcttccgccaccaccgtgacctcacatgatcttacctagtcgcccagatcaaggcgtcgccgggagagggtagaagcggggcgccggggagatagaggggatagacggcgctgctggcagagacgacaaccgagttggtgatggcaggctggccggcggtgagcacgacgggattggcgagggtgtcgggccttcagctactcctactaacccgccgttgttgatcgccggttcgccgccacctctgctgcctccgacatgcatgcagagctggccatctccgctgcctccctcacgcagaaaagactgagtgttcgttaggtggagataggagagattgtctctcgttttccgcgcgcacgcttttcaaactactaaacggtgtgttttttgcaaaaaatttcaataggaaagttgctttaaaaaatcatattaatctatttttgaaatttaaaatagttaatactcaattaatcatgacctaatggcttacctcgttttgcgtatcttcccaatctcctcaatccccttctcttcaaacactccctaagtgaactgatagattgaaggggaaaggcagagatggataatgaaggatggagcagcaggtcaccgctcccaaaggccacctgcactgcacgtggcatcatactctaggaatttttcattttcacccctaacattatttttattctatacttcactaagtactaaatatttttaaggacgcccctatattagtactcacatattgatgtccaggaccttgaaagtttcaactttccaaaaccgatctcatgtacaaagagtaaagagtaaacttttatgtctctgtatattgagttgaccataggagtcatttacctaaaataatattcaatacataaatttcgaaattttctaataatttgacaaattttgtaaatcctactaattcaaaagacacatctttcaaagtacttggtaaaggcatacagagaagcttaaacaagtaaattgcccattcacaaatcatatcttgaaatattgaagtataattatattactctaattgttaacaatattgctctcacaattgtacctatgattagctaatcaaccgatgatcgttatattttaagatgacggaatatcatatataagaccagagatgtgagtaggtcacatgggtagattagcacaagaaatttctcatagagagacttgaaaaaaaaaacttagttttcagtcctctaaccgtatagtcataccaattgttaataggtgtcaattactctgtttaatggaagagaaaagggttgaattttttttttgaaaaaagcattctaaagtactacatttggaactctaaacatgaataacattaattatgttaaatatatgtcatagcggtaagttagtacgctaaccgacgcacctattttctagaaataggtaagcatggatttggaaaaggatagggaggggagattttaggatgctcagtataaaatattgactacgttttaaattagaaagaaaatgttaggattgaattaagaaacatgacagctgacatgaactttgtattgtgggataaacaattttcaaacatgttacctcatcatacaagacactttgaggctccttatagaagggttttgtactgcgaatgatctaagagatgatagagctatataattttctatcatctaaatgggctattacttaccataaaagattagcatcattttaactggatggaatggcttggcatacaaagagactcttgtgtagtgtgttcttcattgcacatcggtagttagaatagaaatcagtgaatcttaatcatcgattgttgatctaatggccatataatttgaggtgatgtgacacattgtgggatgagattaagttaatgggaatgaactatgtaagtatataaaatacatatggaggcgccccccccctcggcgccaacccacatgtggctcttagcatgtgcaccacgtggccctctcgcgatcatgacgatttttgctaagtaataagcagataagcatatattggaagagaaaacgagaaagtgatagatatacaaatgataacattttcaaccatcaaaataatggatttaatactctaaaagtaaaataaataaatagaatgaaaaggttatataggctgaaataaaaaaaatatgggaaggaggaaaggaacaaaataatttccattttcccataaagtatgaccaattaaaaaagcatgtcaattgttagggttattatataaatctctaatttatgaaagtcccaagcaatttgtttacttcatttttttagcttgattttattaataacaatcaaatcgaccatcagccaacataaattaatatcgccctttgttttgctttatctgctatgtaatttaaatgtttacaaacataatgtttttctcggacttgctgacataaaatttaaaaactgctaaaagatttttcttaagatataactcttttacaaataaacaatattaaattcactatacacgctatatggatagtgcgccaacggcgcaaacgctttctagttaattctgattggtagattgggctcctgtccttacgttcagaaaacagttatctctccatcctattttaagtgggtttctatgtttaacatttgactgcccgttttatttaaaatattttaatgattagtatttttattattattagatggtaaaacatgaatagtactctatgcgtaacttttttataaattttcgaaataagttggacggttaaacgttgtacatggaaactaataactgcatttaaaatggaatggagggagtactccttatccaaaaaaaaaataaattatgcataatagtttgtgctcatgtgagtgtcctaaaattaagggtcctcatgagtgttcgtctcatgagcctggtagttggaggaactgtatgttggtccggcgacggtcattgtgtggattgattttgtatgtaactcgagtagaatcaacggtgaaaaccttgccgagccaatggccaacttaaagatgaatgcccaaaggcggcgtttccctctttgcaggcgttttttatggcccctgtcctctcgaaccaaatcttttatgatgaaatcttgctacaatatacggacgaatgatgggggtgtttcacgttgcatcctccgtgggggctccgcttaagacaatcttcctcgtgcaatggtggccgttggtggtctcttgtgccggctgcaaagctctttaggcctatgacaaggttatctcctacttggttccacttgtttcacgatggatgactagacatcttcgtttgatattggtagctggagttggacctgctttactgttggggtgcaacgaagttgagcaacaatgacacatgtagtattttcttgatgtgttggtactggctatgtggaggaagtggcacttggctttgtctgatgtccgccagggaaaactggagttgcttgatcattttagtagttggtacctatgacgtgtttgatatgaggtaggggttgctgtgtcattaaggtgacaagctcaacaacgataacatatatatgtgtgtgtttgtgaagccaaaactgatgtgtcgtttttttgacaagctgtgcataacaataccctgtgtcgttgggctccgtatccttgtttagttgatgagagccactacagtgctctatactaataatattattacactaccagtagaaacgaccttaaacatcgatttataaggacatatcataactttacaacctctatgattaagggtaatttataaaattatttttttcctttcgttaatccgacgtggccggtgactcacagcataaccacgctaatgctgacgccctcggcacatggagccaccggagaccggaccattcgccagccaacacagttgatgaccaagaaacgtcacccggtgtcaatgccatcggcgcctaaagccagcggaccagcctgttgtcgtttcgctggccgtagctagcgaacttgcacaaagtacacgataatgacgacaagtttgggatgtcgacggtaaccatgggatcgacgaccatacacacgcatcgacacattgaaatgatttggaaattgtatccatgttcttttgcattgaacgatttcaatcataccatggttaatgaacacacatatatggcctactagaaatgccactactacgaaaatcatctttcgtgacggtcattttaggttttcactgacgaaatttgaagccgccataaagtaaaggccagtgaagatataagattttcgctggcggttagatttttgcaagcggacacacgatattcgctagcggtttcggtccgcttgcgaaaatcgatttttgtaagcggacaaatgatttttttctagcggttgacgtctgcttgcgaaaactcattttccctggcggttgcttaaagataagcgttagtgaaaatcaacccagcccgccaaaaaccccctaccccaaattcaaaattaatacataatattggcatcaatccaaatacagagaatcaacattggcatcatcaacaacacataaacagattaacaacacataatctgatttacacccacaaagtcatcagcagataatcacatctagttaagctcttcactgaaaccatccatgcatgcagcagcagtgttctctctctctaggattcatgcctcaggatgcctcggcggcggcgaccgccctggcctgcacaagcccgtctccgccgcggacaggagcaggagcaccgcggagggccggtcgaaccgcacggcggaggcgggcacgcgacggcgggtggtggtggtgcggcccagaagacgaggttggaggcggcggtggaggcgccctccctgcggcggcggcagatccgccctccccgcggcccaacggtgatggatccgccctccccatggcacggcggcggcggatccgccctcctcacccgcgtccgagctcgtggccacccgtggcggattcggcggctgagggagaggccgagagggaggaaggaggaggagacggacgtaccggtggtggtggatggcgcggcccgaaagacgaggttggaggcgcccttcccgcggcccggcagcggcggatctgccctccccgcggctcgacggtggcagatccgccctccccgcccacgcccgagctcctccgcccgcgctcgtgctcgtggtcacctgtggcggattcggtgactgagggagagggaggaaggaggagacggggcgcgccggcgactgagagggaggaggaagatgaagaggacttagctgcgcaaaaaaaaaaaaaagaagacagagggagagggaggaagaaaaggagaggactagctaggttgcgagtttggacggttttaatatggggaatttagttttcctggcggtcctcttatcggccgcctttgaaaataaccgccaacgaaaatcctattttcgcaagcggttgtttaagtgagccgctagcgaaaataggtatatttttgctagcggtcctcttaatctggccgccagtaaaaatctattttcgctggcggttcgtagcctcccacccctcgtaatatttatgctagcggtttccacgtataaccactagagaaaaaaaaatagggtgatgtcatgaaaaatcaattttctagaagtgtgctagcatgttgatatctaggattttcaagaactcatcgcaatacatacaggacaaaccggaattttcagtgttcattagtcattaatgcatgcttcattgtcaaggcgccatggttgttggcaaggttctgccggagtttgcattcatagttgtttctacggtacgaggcctcgaaggatcatctgcgtcgacgacggatgggtaggtggcagtgcggcaccacaagcgaagatgctgcgagatgcatcgcttgtgtcaatggcgcgaaatggcagcgaactatcgcgtttgtcgactgcggaagtacgaacgacgacatcctagaacagtggatgagaacatcataactaggggatacgtgtatcacggaaatacaaagccaatacgctgatctgcaaaattacgagtgtgaccgtccacgcttatatttctatggacgattatgctctctcatatttatactactattattgattaaggtggtggtataattaaatccggtcccttaaataaaaacagatcaacggtttggatttatttatcctactaatagagagcaccttaccagggcttttagttgatagttaactggtgttgtaggatgtggtgtgtgatgcgttgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctttaattcctagatttttctgggatttatttgagataaggaagtatttttaataaatggaattgcatttaaggaataatttaaattgaaaaaggtcttaaaaagtctcttttggctttgggccgaaagtcggcccaaaacctctcttctctctcctcggcccagccggcccagtccgccgcgcgcgagcgcgcgtccgcccgctgacaggtggggcccacctgtcagtcgtcgtctaccttcggccgccgccgcccgaaaccctagtttcgcgccgccgccgtttcctttccaaatccggccgttcctttccttctccggccgatttgttagaggggaaatgatctccgggatctcctctaccttttctcctttggaatcttcggttaaatcgttttggaaagctttggaatcgagttcgactcggatcggtttccctctctccaagccgaaggtttccttcgccgttgccgtcgccgtgggccttcgccgccgcctccgagcccctttaaaaggacccccggtgtctcctctacccgtcgccaccctcgccttcgcctctcgtcgccggaagagctctagcgccgtgtgccctagcttttgccgtcgccgccgccgctccagccgtgtgccgccgtcgtttcagccgtcgccgtcgctcgggaagaccgccgtcgtgctcgccaagtcgccgccgtcctcgtccgccccttcgctgccgtcggagaccgccggagcatcgtcgccgtcgtcgagccgaagagcgccgccgtttcaacctcgtcgctgtcaccgtccgttggtcctccgccgtcgctttggtcgccggtgagttcgccgtgccgtccgctacccgttggtgccttccgtccgcgtcgctgtgccgtcgttcgccggcgagcatgcaagcccgagccgccgagccgccgccgccggtgatgacgtcatcgctgacgtcatcggggccgttcgctgtgagccggtcgtagaccgatcgatctcggccgtccatcttggatcggttaaatctcggccgtccgttcgcgtgaaccgccgcccatgcgccggtccacccaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtccctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactggttgaactttatttatattggttcaactagatattagatataattgcttagccctgcttagaaacattagcacatttatgggataactaatgatttactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggatggtgcgctgcagtggattgtgttatgcgaggggtattgtcacaactcctttccgagataccgtggtggtattgaggcacatggtaacatgatgtgggttgtgtcttgtgggtacagtggtacacctctggccagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaaatggttgggcctatacaacagggtatgttgtatagcgttggattaatattgtttaattattacttaactgttttgttaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttactgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccaggcgtgacatgcgtgctatcaagctgaccatgtttttttatctgagatgtttggcgagattcttcaggtcgagaggttattttctttttcttttttccttatagcccgtatgggtatttacttatgtttattgaaataaaattgacatttcttttagtacactaagatatttgttacttactccctctgtaaaaaaaactcaacctatcccctcttagttaataaatatggataaccttatgtccagattcgttgtaataggagagattacatcccctcctagattaagtttctatttttagagacggagggaatatatgctaaaaccccaatttttctctaaattttgaaccatggtacttgtggtactatggaatttactcaaagtcaaaaaatacaaagccttcaaagttatggaataaaaaaggatatgtatgttccctagatatttccaaaaaaaaaatatctcccatatttctagacgtaattacatatttttaataaatattaattgattaaatctttacgtggtcaattcaaaaatagttgaaggaaactatatgcccatgcatcgagacatgtggcctactagctagctagcccagtgggtggactctcttgaagtctctccgtgtcagtacttccccagaaagatgttcttgaggtgatacttttctctttgccagatcccctctcctctccattggttgccggggcaaggaagtgggcttgtcgagcttgtttcgtagtcgggtaaatctcgttgtgggtctttccttttccttctcttgctcaaataaaaagagatagtggcatctaccttctttgtcctggagttcttcggccatgaatggacctactgaagcttactttagcatatgccacatggctggtgaccatcgggtgagttacgtatgccttactactcttctgcatacgcaactcgaagttctccagtttctattgcaaagatgttgtgccagccgttcaactttcttccagcaaccactcacacaagagcgccgatctgcaaggggcaactttgatttattggtttgaccatggtagcttcaacctccatagcggagaggccccaactgggattgctcctgctctatgttttgaagcttgccatactatcatcttcaccatcgccgtcaacacaagcaggatcgctggtccggtggaagaagcagacagagaatccgattgatttttcccattctttttaagtcattttctgcaaaattcccaatgtatgctcaataatttgaccgtttctgaggagcctttctgcaaactggatgttctttccgttgctgtgctttctcatgtaccatgcatctaaactttatattaaataaagtgcatgagtcttaaaaaaaaggaaaagcagaagctaagcccagtgctgggcttgtccgcgaaggatgacggcgcggggcgtgcccaactgggcaacttgcagccgccgcgcgcatgatgccattgcactgcacgcagcacactacacacacatgagcgagcacgcgcgtagtgcacgaacatgtacaggaacacagagttagttgaggcgtagtacgtttgcaaatacatggcttcaagacatgaacaacggctgaaaagcagaacaggtaaataaatgtactctatagtaatgcactaagtatccccgaaaaaaaaagaataataatgcactaagtaaatgtaatgacaatgataattatctctggaagatgatggatcagttaattataaataatgcccccgcaaaaaaaatataaataatgcatgcagatcgttcgagctagacaggtagagtgtgtaagagcaggtttaataatatcgtcaacttgcttgctataaaacatcatctatatatagtctgttagtataggctatttatataagaatggtcgttattatcatttatggtaacagcaaatatactttttaattgatatgggtcccactaattactgcattctttactattgttttaagcatgaaccaatcttcatcaggcttatttctctttcttcattgtattgcgtgctgcagccggcgataattctatcgtcgactcgtgttctctctcaaccattccctccgctagcacagcactgagggtgacgtggtcacgctatcgccggtcaggttgacctattagacatatatatatatatatatatgtgtatatatatatatgtgtananggacaccccgaccggcgatagcgtgaccacgtcaccctcagagctgtgctcgcgcagggagagatagagagagagctcgagacgacgatagatatatagccg

SEQ ID NO: 70348 - DNA, 629 bp, Oryza sativa
ttattggattaagttggatcatgcatgcatgcaatctcgttggacacaatcatttctatatatgtaactttagtaattataaaaacgagaaatcatcatgtactccctctaacgagggcatcactcctcttatacgcacgctacttctcaagttatttcgcaaggtccaatcactagagctcacgcccgatagtaatttacagatgagctcgtttataagtacttctttatgtgctcttgagaatagattgctacctaatgatttaattatgattaggaactatggatataaccatggagcacttggagagaggctaagaaatggacaaggtcatcatgtacgtttaagtcaagatggagatccaactcatatcaagttcgagtccacttcaggttctaggagcagttcacactaaattctttgcccaggttgtatttggactccaattttgacgttctacatatgtatggaaagctaacaagaccaccttttcaatggatctggtcccacgtcaaacttccttttgagtcaacgggaatcttcaaaacaagaaggcgtttagaatatgtccgggtgttgcgtcaccgtctttgggcccgttgggccgtgtatcgtgttggtgtctaat

SEQ ID NO: 70349 - DNA, 6409 bp, Oryza sativa
gaaactaaaagaaggctgagttcagcgtatataaccaaggtgcttgcctctattcctagttgaaggacaggaagaaaatagaattctcaagtccaatgccaagaatttttaagtggctcaacaatacatggaaagtggaacccccattgctggatccattgacaatctcagaacatatacagcttacgcacaataccattcaaagaccccctgcaacttgcatattcttgctcaagtcacttgcaagaacttatatgatacccactgtcccaaaataaagctatttccagagtttaaatttgtcccaaaatgtagctatttctacacctaccctcttatctcaaccaatcgcaaccatctcttatttaattcctccacctattttctcctctcaaccaatcacagcattcagttccacctacttccttaattcctgtgaaaaaatagatgcttatattttgggacatgtggagtattattgagccaatgcggcattccagtagagcaagaccagcgctctaagcttctggagaaaattgcaatattgggactgcaaacattggggcttcgctgttgacactccgagtggatgataaatgggcccatccgtgtctatgaaatatgggtccagtgtcattatagcaaagcttatgtttgcagtgtcataattgcgaatcccccaagcttctgactgcttaaatcacagacagatcaaaatgtacgcacctccggccgatggcgcagggaagacgccgtgagcgtgacgccagctgggggcggcgccacgacggagaccgtgggggcggcaggggaagcgaagtagaggcggaggcgcccgccgtcgacgacgagctcggcggcgcagaccgggcaggcgaagcgcacgagccccgccggcacactcagcagagcgcagcagccaccgcacggcatgcgcgcgggcgcgggaacctgcacggggaccggcacgggagcgtgcaacaccgcggcgggaggaggcccccgtccggggatgggcagagcccgccgcgggcgcggcggcggcggaggcatgagctcgggcgggagcgcctggtgggtcccgcagtccgggcaggcgaactcggtgaggcccggctccacctccagcgtctccccgcaccccgcgcaccgcacctccacgaactccggctggccccccgccgcctccgccatggcttcggggagcagcggctagggtttccttcggtgcgccctcggggaacagagtagtagttggagtgaggtgtgagtgcgagatactactactgccaacccctagtacccgtagcaaagccggaatcggccgtcgggaaaagaaacggctccgtgtcatgtcgcgccgtgtgggtcggaaatttactttttgcttagggtgtgtttagtcacttgaaaaaagttaaaagtttgggaaaagttggaagtttatgtgtgtagaaaagttttagatgtgatgtgataatggaaagttgaaaatttggaatagttgggagtgaactaaacacggccttagagggaaaataccttcgcgccaactttttcccgcccggcatcttccatttcattttatcgcttttgtttacacggaaaaaatgttgtagatgttggtgctcatataacgcatatatactcacccctataaacatatacagtcatacacttacaccctacgtcaaaaaaaattatagggatgtatctgaacaagcatatcgttataagcatcttcgaatagtgagcatatatcatttgagattgttaatcccattatatattagaggttgtttggttttgagaattttcaacccttgagaatgagaaaatagataaataaggttgtattaccccaacccttccaattttccaagagatttgagtcaatagaaaatttcatatgttttcttctctatccaactcgtatgaaagaaaaaaaaatctttgattttcctatgtttcatttccacaaaacgaatggcacttatgaaaattaattcttaggaattcaaatctttttttccttcaaactaagcaaagtcctaaataattggcatgtaacagcagcaggtaaaaaaatagtgaacataatcgtacttcagtcttgtgttgggaaagaaaaaggagaaaaatgaattgcataaacaaaaacgatataagggcactcccaacctatagtgtccataagcagtgtttatggtgccatgtcaataagacatcacaatagaaactacactctacaacccatggtttcttaaaatgggtcattaataaatacatcatctctcttatctaccaatcatatttattcttcatctattatgaagacactattctctcccaatgtaaaacttgatagtgtctagtgcataggttctcgtgttgaagccgtgtcttgcatgagaccccgtttcttcctctcttcactctctctcttaattaatatagtgccacataagctaaaagtcctacatgacaatgtagttaatgccatagacaccatactaggtggagggttgggactgccctaatggatgcaatatcctcaaattactttccatgtataataatttgaagatgtcttataatttgatcttaagatattgttaaattgccattgcatatatgtatagtctgtttggtaaagctccaactcttaaatttagttttaggagttgggtctagagtggaattgagcctaaacccagctccacatctctagtttattttatgagagcgctccacccaactacacttatattttagatggagttgaaattgtttggctgagctccaactctagaagaggtggagctgaaactatgccaaacaagccctataaacgtgaacataacttatccacgcaaaagaggaatactcaatacaaacaccaattcaataaaatatactctgtaaatgatactgcaaactatgtacaaattttaaaagagtttagtatttaaaagactatcacatattcatatataaacgttaacaacatggcttataaataaattgtaaaacctaaaattaaattttaaattttgattcataagcataataaggaaagaaaagatgaatatttgtaaacaagaataatgtatagtactcacgcattaggccagtgagacagcggcgacagccaacagttgtcgggactgtcactccacccgtcacgctcatccgatcgtacagtcccttttcccgagagcggaagagggaaaacggaaaagaaaaaaacgcgcgaagagaaaaaagggggaaaaaaaaccaaaaccctagcgatcgcttcccccgatccatggcgccgccgccggggatcctcgaggtgcggtgcgccgggtgcggcgagaccctggaggtggagcacggcctgacggagttcgcctgccccgactgcggcatggcccaggcgctcccgccggagctcatgccgccgcgcccccgccgcgcgctcccgctccccgggcgcgcgagcgtcgtcccctccgccgtgcccgcccccgccaccgccaccgccgccgcccctcccacgcgcgtctcgtgcgggggatgcgcggccgtcctcagcgtgccgcacggcccggggcggttttcgtgcccgctctgcggcgccgagatcgcgcctccccctcccctcgcggccgtcgtctcagtcgttgccccgccggcagcgatcccgattacctccaatcggccggcgatgacctccgaggtactatccagaatcatttcctcccaggatttccctcgcaatgcatcgttgattattggtttcattaagtgtttatttatactagctcaaatgtgagcaatgtggtgatggtatctgttggccttttgctacaaacttgtgacatgtgaggtgaaactactttctataggttgctagtagcataaccatgcttgtattgtacattgaggactatgacctgtgtactaagcagtgagattaaatttgattaggaattctgaataagcatgcgtgactttactatcagatcacttggttttagcaaggagtcgctattgtagcattcctgttttaatctcaacaacccgcattttctcatgtttggctaaaaacgctagggatcagcatggccaatatatgggtaccccttgaccagttatagttcaactaaatatattgcatgtattagaaagctgtattttagttgacctaaagtagctcaatgagtacccccatggatgatccatgctcatccctaaagaataacaagtttaaaagttaccagcataaatggtcatttctcatttcgttcgaactgaatgtgtgcatttaaagaaagagtttacctatgcgcaatcatgattggtgcaattaaccagcattgttttttcaagtatccacgaattggaaaaaagtgatgtatttgattcagtcaactttggagaaaagtttaaacacttcaacatttgaataacaacatccctttgcccctttgacctttctattacttccaaagcacctgtggtaccactagtttaatgatcaaccatctataaataaataagtaaagattgcagccactatattctctaactgtcttgagctagaaattagcatgtttgttggatctgcacagttgattgtggtgcatcgaaattataactatggaaattgatcaaatatatattagagctgttacaagtcatgtaagaaatacaattatattggaagtttggaacaaacatgtggtatcattgatcaaagttgacagaattggctgcacttcccatggtgacactttatttagaccaatagtagtatttcatcacagtgtttcatggtgtttttcttctttcaggtgctgaatggaaattcaaatcagccaactcttgctggacaggttcagaagtccattattccagagcaatactacaagcattcttttagagaggagtcattcagttcattcagagttgactctaggacacaaattcctgatgtagggaggttacaaaacgagtgtgttaatccttcagctgatcgagaggagtcacgcacagaaccacctaacgggactatgaccaagcctggcaagaagaaaactacatctgcttctggtccaaaatctcatccagctggaaagttgcaggaagagcatattagtaaggccatccatgcatcaagggctcagggaatgccttcaaactctgtaggaggaggatttcacaatggcatgattgcagtgcacaacaagcagaaaactgggcatatagctgcccctagtgctatcgagcatgagcagataaacactctccatcaagtttgtgacaagcagcagcctggcgaaaattccagtgatttggttcatgtggagcaggtacaggtggcatgcaaagcagtacaaaccataaaaaaggtaccaagtatacaaaaggaaatcaaaagaggcaaggtaagagtccgttgaattattcaactgagttgcctcatcttaggcgtagtcagcgcttaacaaagggttcgccagaccctattgatattgagcctatccataggatatatgcttccccaaaccaaaatcaatcagaaactccaccaattgagagggcgatagatgatacttaccatatttcaccaaaccagcaccggtatcctcaatcagtctctaataagttggacaatgctgatgcaactactcctgctttgaatcatagtatgcaacaaaaggagagaattccccagtgctacagccagatgtactctccagaaagtaggtgggtacttccaaatcgtagttctaattcatgtcatgagcatgagatgcctaatgaaagctttgatgggattgtccaactcgatagtagtgatgatgaagtgcattcaattccattagagaaccaaaatcaggatatggatggccaactagaacaacaagcttgtgctggcaagaacctttcagagcatggcaggcaaaagaatggcttcattggttcttcaggtgatgccaaacatcatgggggcttgtcctctggaatgggaacacgccaccagatgaatttggctgcttcatgcagccgccttgctgttttattgccagttgcggatgctactccattgcccaccatcagctcaccttcttcatttgaaagtctgtctgtcccactctccggcatgctcaattgtttctgttgagtcctttctaacatgttcttccgcacctgtgcagagctaccagttaactgtagcagtccaacaacaccgcaccagcaccaccaaccatcccccatctattctcaggttcctccctttatctattcttgctgaacctttttatttttctttgggtgatgctgaactttattttcagtttgaggtctgaacgccagtgtgcttgaaaagtggaaagagcagacaaccaagtttctt

SEQ ID NO: 70350 - DNA, 8069 bp, Oryza sativa
tccgatgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacggaacggcgacgggaatggcggccggcggcaaaggaaggcggccggacttggcgcgtccgttcccggcgattgggggcgccattcaagggggaattaagggggaaagagagaggagggaaaggggattaattccccctaatcaatttgggaatcccatgcttgaatcgagcggatttagaggaggaagcgagctagggttcacgggagagggagagaggacggccgggcgggaggaaggggacgacgcccggcctggcgcgtgggacccaccggtcaggcggcggcgtcagcgcgcgcacgcgcgctgcacgggcgggggcgcggctagggttgggccgggtggccggcccaggaggagaggaggggaaggcggcctgggccgagcaggccgggagggaagaggggggggggaaaggcagcccgggagagagagggaggagggagtgggccgagggaaaggggagcccaagagaaggagggagagaaggagagggagagaaaaagagggaggaaagggagacttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacagacacagattctttcacccaaccatacagttccgtgctcatcttccaagaaaccaatagcttttcctcttctcatattcttcttgatctcttgaatatcaggatcattaatttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaataaccttttctgctaagagcgtctgctacaacattagcctttcccggatgataatgaattcccatgtcataatccttaattaattccaaccatctccgttgtctcatattcagatccggctgagtaaagatatactttaaactcttgtgatcggtgtacacttctgtacgagtaccgaaaagataatgacgccaaatctttaatgcatgaacgactgcagctaactcaatatcatgagtagggtagttcttctcatgcggacgtaactgacgagatgcataggcaaccaccttcccatcttgcatcagaacacaacctaacccaagtttggatgcatcgcaatatacttggaaacccttctttggatcaggcaaaatcaaaataggagctgatattaagcgacttttcaactcttgaaaactccgctcacattcttccgaccatttgtacttcacatctttctgaagcagtcgtgtcatgggcttagcaatcttagaaaaattctctataaacctccgataatatcctgcaaggcctaggaaactgcgaatctctgaaactgtctttggttgcttccaattggttacggattccacgttactaggatcaacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattctaacaacccatacctagtggtaaaagctgtctaaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaattaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcatacccggtaaatcatctgggaacacatcaggatactcccggactatatgaatctcttccaaagttatttgattcagtcttgaccttaaagactcagaagacaatgcatgaacggttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcaccttgagcttctgcagcagcaatatgattgacacgggcctttgatgctggtacagcagagttactctgggcagggacaaccttcacgcgttggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaagtaagacgcggcttctgattatttccctgttgtgtcttgaattgagcaatccgacgtttcttctgctccatgcgattgtacttgtcttcctgacgaatagccttatccactaatttctggaaatcagggtaatctccaaccataagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactacccccgatggtatatgcgtcttccggaaagcagcggtgaattcaagccaagtgataggttcagcagtagtcctgttaagacggaagtgatcccaccattcagaggcagggccatgcaactgatgtgatgcaaatgagaccttctcctgatcagtacactgaagtaaatccaacttcttctctatggcatgtagccaatcactagcttcaacaggattagtggtactagagaaaacaggcggcctcacacgaagaaattctgctaacttgttctgtggaggtgcatgattattcccttggttttgctgattctgaaattgttgcatcatcatgttcataagctgtgtctgctgagcaagaacttgggccagagtgggattctctccattgatgttattattggggttgttgggaccattcccattgctacgagtgttcaccatctggtatggataggataagaagagaaaacgggggaaactacttaggacagagaattactttaacttttattgatcttaactgagtttcattattacaaactgaagactcccacaccactaaactctccaacttcctaacactcaaaagcaaacaaacacatgcaattacatcccaccactgatgtaaatcacatgcgagacccacacacacaaacaaacttaaaacaagcaaactaacacaacgatctaagacaacgacttaacaagtcactctagttcttccgagcataggaggtcgattgaaggctcatcttcatcatcttgagttgctacccactcaatcttggaattgatgcgcttggattcttcttcttcatcactacttatgatgatgaccggaggatccgcttgagctggggcaacttctttctccaccacacgaacctttggcgccagttgatagcgagggacaaataaagctctcttccttgcggtaagacgaatcctggccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcgaccaactgatcactgtagcgatcacggagctctcctatggcgatccttgccacctcctgacatgcatggatgtagtttcttcctccagcttcaaacattactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccctcaacgccaaacaggtactcaggcttgtaacacggcatctaaagacaagtgaaaggagggagttaagacatctatccaattaatagcacaagtttttggattaatttgaataaaggtagaaaatcagaataaaaaggtaagtaaataaagtaaaccaagctttgcgaaataaattaaaacagttggaaacgaggtcacaatttttgtaattttgaataactggtttcaaaagaaatgaaagaaaattataaaatcaatatggtaaatttattttattgcagcaagattaaataaaacaatattgtaaaacttttgctgataaatgagccattagtacagtaatagatgtacagtactaataacactggaataaattttgaatgagaaccattaaaagagattatgaagtgcatgtgccattagtttggttaattaaaagagaaagggaggagaacagttctacttttccaatatttttagagggcttctatggataaccatttggcataacctagggtcaaaggggctctgataccaacttgtcacgcccggaatttctatccaaaattccaaacgcttagatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcttcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtaccattccaaaccaggagctaatcaaattattaccagtatatagcatcatttactatgatgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaggagttgtgacaataccccttatacaacacaatccactgcagcgcaccttcctggatcataatcacccccttataaacaaggcatggactccccagcgacccccgtgggcttatctccgccacttctcagtctggtgctccgcaatgaaccatgcgatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaaaccatcattaaataataatgaatcattagttatcccaaaagtgagctaatgtttctaagcagggctaagcaattatatctaatatcttgttgaaccaatatataaagctcaactagtcaagttataataacccaaggtatcaaggaataaggtaaacaagaacaaaaggggctataacaatgaataggttaattccacccaatgacattcgaaaataaatgcaatagttgaatagaaacaatagctttaaataggatcaacatgctcaaagggttgtttgggatctgtgtgacttgccttgctggccttggaattcttcaaactattctccgacgaaaacggactctccggaaacgacggaatctaagcagaaaagaataaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaaccggattaaaacacttaaatcggcttaaattgaattatgacgcaataatgaattatttttgaaaaggaaaaggggatttattgcgtcagcggctagggtttcggtggaccgggcgcacgggcggcggttcacgcgaacggacggccgagatctaaccgacccaagatggacggccgagatcgatcgggtccacggcggttcacggcggacggacccgatgacgccagcgatgacgtcaccgacggcggcggcggctcggcggagcgaacggctcgggcggcgcacgctcgccggcgaacggcggcgcgaggacacaaacggagggcaccgggacgaagcggacggcacggcgaactcaccggcgaccaaagcgacggcggagaagcaacggacggcgccggcgacgaggaggaaacggcggagaccttcgggtcgacgacggcgatgacactccggcggtcttcggcggcggcgaaagggcggacgaggacggcgacgcgacggcgatcacgacgacggtcttcccgagcggcggcgaagcacggctggagcggcggcgaagcacggctggagcggcggcggcgacagcggagctagggcgcacggcgctaggacgattccggcgacgagaggcaaaggcgagggtggcggcgggtagcggagagcacggggaagcttttaaaggggctcggagacgacggcggaggcccacggcgacggcaacggcgaaggaaacctcggcttggagag

SEQ ID NO: 70351 - DNA, 1155 bp, Oryza sativa
  unsure (1)..(1155): unsure at all n locations
ttttcataaacagacggagatttgtatagttgccgtccgaatgaccttctgatgggacggcccacaactacccccactttcgccgggagcaggtgcgacgtggaatcgtggctgtctgctgacgacatgaccggtatcagaccagtcacgtcggtcattcttgtccaccacgtgtcagcttaacaatctacatgctcgcccttcttcacacaacatcttacctgtaatggttaggatgaagcctggcatatatctgaccaggactaacgtgccatctttgggaggtaacacgctagctccagctggggacgagcgcctagaagccctcgtcctgacgggatggggcgaggcgtgcgtcagatcgcttgtcgccacctaacccgcgatctgaccggtctgtgactggtcacagaccggataaacgagtgcactgcactgcgttacatgcggcgtgacacgctcagccaaaccgcaataaatgtggttaggtgagccccactgngctcacctaacccatacccgcggagcaaaaacccacgaggggtcggggctccctcggccctcggggccgaggggggttgccgccccaccccctcggtgggactaaaaggagggcgaacgcataacccttgggcccgacattccttcgggggtaccaggccacgtgtgcgattgtgtctgcctcaaacctctagtcatgatactcctgatcccatgtcaccgacagtagcccccggcgttatgcaaggcggatcgccctctttaaggaaaacggtcgggcgtgacgccactcttaagacctggtgacaggtgggaccggtctccacaattgggcagaaacccaacggtcccaaaccacgcacatcggcaatggtaactcggctgtcaacaatgagcggtctcttcaagactgccccattacttgagtagcccccgaatctggccatggcgattcgtttcgtctgaagatatggtaacgtcgcttcggtcggcagcgtaattaacgcgcgcacgatatgatctatctcgattgccacaaccgcatatccacttcatgcgccgcaagcgggcgaatgggattagtggaagcgtgggcgcgagaaacgagggggcgaaatagtgggcgcgagaagcgaggagccgggcacagcgttg

SEQ ID NO: 70352 - DNA, 700 bp, Oryza sativa
agcaatacagagaacttgaagtctactcgctaggaatttcgtcgaagccatctcgacaaggatctcgtcggtaactttgggatcagttgttctctcttataatctatggatttccatatcaatctcatataaactggattatgactattaacttacgagtggtccaaaacagtataatccatgtcttcttatttgcttgatgtcgaatcgtgtagattttcgtaccaacgtaccccaatacccatactattcggtttacaggtatctctcatcgacaaagaggtatcgaagaaataaatattttcgatttatgaatcgagatagataagaacatccccagcagctcatctatatttggtcctgcaaatgtccatatggagtatcatccaaaaaaagaatatcccattatcctatattttaggaatatctttccaactaactttacatttgtattttaagggatatatttccaactaacttaattttaacggtgttatttatcacgataatattttgaaacgagtaaattttaacggatatatttttaattgatagttttttaattgatatatttgaattgagggaaacatttttttatatattcgtagcatcatcaataaaataaaatgtacataaaaacacagcaaaaaatattcctatttcctatttccttttactctattcctatttgctatttcct

SEQ ID NO: 70353 - DNA, 8579 bp, Oryza sativa
tgatcgaattggatggctcctacaatttttttctctcttttttgcgagagaccagcaagtcgcggcaaaagtgctgagatggagcatggccatcttgagatgaaggttgacactaacagtgatcggtgcctgtcgatctcctccattgccaactatataatactccctccatccctaaatattcgacaccgttgacttttttaaacatatttgatcgttcgtcttattcaaaaacttttatgaaatatgtaaaactatatgtatacataaaaagtatatttaacaataaatcaaatgataggaaaagaattaataattacttaaattaagatgaacgatcaaacatgtttaaaaaagttaatggcgccaaatatttaggaacggagggagtatcttcttcgccattattggaggaaccatcgagaattcgaattatagcctgttttgtaatcaaaagccatacataagaacaattcacatctgtgttcagaaatacgtcgaatcttcagtcgacgagcctttgcattccatcccttagggcctgtttggcacagctccagctccagctccacccctcctggagctggagctcagccaaacagtttcatctccactaaaactgggagtggagctgtctcacaaaatgaactagagttgtgaagttgggtttaggcagctccacaactctactccagacccaactcctgaagttaaatttaggagttggagctgtaccaaacaggcccttaatttgagtcgtggagtctgtatctatcattttggcaatgcaaaactaagatgatctcccagcaaggctgtgccaactactctttttctgtttgggattaaactttagtgatccaaaataacaatctgcagaaccaacaaagcaaaaccagccagtcacacaggcttgcagaaccaacaaaccgtgcttaaaaaagagataaaatatgtatcttaatcagaaaaatgctctaaatggcatataaaaataggctagaagaacaacggcaacttctccctgaaaattgacgaccctatgtgttcgtaatggcccatgtttagcaggccgccctgtaataagcccaacttttgctctccgttagaaaacgaaaaaaaaaaaggaattggcccaacttttcctctccgttaaaaccaaaaaacaaaataaagggaatttctagattaccatcgacattgctccgttaacttttggactattatatttgctttaaaattcatgctagcaagtatgagaacaaataaattggcaagtgcagctgctgtgattcaatctcacgcccttgagttcattgaagatctatgctgccatcgcgccatacaatttttgtgatagttttatcctagttatatacaagttacaatatacttacacttttgttacactatagttacatttgaatgttttgtatagaaaaaacttgtgacagtttcttagatagtccactaaataaataaatactactataaaccggtataacaatattaccaaataatcatgagggaaggtacgttattacaccttaatgatttgggattcgctgaacttgtttttgacagtggatggtacatttggtgggaaaggaggcaaatggtgaaatgattcagatgattgctacatcagctatatctattgttgctcttacactaaattataaaatggtaaggaaaaacatggatgcaaaccacatatgaaggatgtagatgcttcttttggtattgtttcgagtagaggaggagccggagcaatcatacaagacgcacaaggaaattttatagctggttcttgcatgtacttacctcatactatttgatgtagccatggtagaagactaaaggctacgtcctcagggaaggatacattcttacctagcaaattagcaaattggttgtcaaaatattattacccaaacatactacttgcaagtgggggaaacgatgtaacccgaatatttttggacaacgttttttaatgtgatattataaaagtctttgtcgagcgctataatagggaagctaattttctagcaaatatacttaaacatacgtctattttaaagtgttcttgattaggttgatgagcctcataattttttttgctaaacattctagctaacgatgtaactgtattttcatacaataaaacgcgccaagtggctttcctaaggaatatgaaaaagtactaccaaaaataggagtacaacagcaaagcttccaacaccgtccgattctcatagcgaagatcagaagcagcataaagccactatctcccaagcgagatttttctttaccagaagcggttaaaaaaatgcagaaacagtaaaaaaaaagaagggaaaaaaaacaataaaccggagcgggtgaaacaaacccgctttagttcaaagcgttccccctgttcatttcaacctcttttttcctctcccgtcgtcgtctcccccgtctccggttagggtttcggccgttcgccgccttcgcttccgcttccgcttccgccgccgccgttcgccagggggagcccttttaacctaaccgttcccgtttttctctccccgtcgaccccgacgggctacggttctacaccctccccggctcggttcgtgtctgttcgcccgcggggacgctgtttccggcgggcggaggcgcggccgcggcgtcgcggctcctcctcggaggcacggtgcgggcgacggccctcctcctctccttccccgaccctctctctctatctcactctctctgccctagccttctacgctgtgtggaggcgtcgtcgcgcgcgcgcgcccggacggcgagcatctggatttgagcctaattgaaggtattttgttcatcctcctatgcgatatgggcttggatttatttgtttctctctaattaacacttccaattcgttcgatttgcttaattttgttgcatgcgtggtgtggtgctaatggcagtttgtttgtttccaaaaataattttggggtacagctgaacccccatggcccagtttaggtctgcgcctgtggaaagcgaggcggagccaggcgccgatggccctgtggatgaagccaatgctgtggaagaggagaaatctggtaagggtgaggatggcattgaggaggctgccgataccgttgattccgtgaaggattcagcaaagcctgaaggcatggatgcaaaggaggaggcggtggagcaggagggtggggccgcagcggataaggcaaaggatattcctgtgactagtaacggtaagacggatgctggcggaaatgaggtggctgaaatgaaggttgaaaaattggagaatggtgatgggcatttgaaggcggacggcgatagcaatggtgataacaagggtgctgatggtgagaaacagcttatgttagcgtcagctggggaggacgtggaggacccggtgctgtccaagcttgcaagcaactccttcatgtttgattacagctgtggtggtgatgactcggggactgaggaggagcaggctgctttcatgaaggaacttgagcggttttacagggagaagcttatggaattcaagcccccgaagttctatggtgaagggttgaattgcctcaagttagtacaaggacctctttgtctgtatgttagaatttgttatgtgctatggacatgaactaattttatcttgattttaattttttttataggttgtggagacaagtgactgggttgggtggctatgatcaggtactcattttgatgccttattgaataatatctgaccatctgggttatagtgtcttttggattacttgcttgctattatgcattgcaatggacagcaaataaatagactacaaaactcaaaacaaaaaatacgaaaaaaatatttccaactcaaaacttgtatgaccacatgagatcatttggcctatatatgatcatgtgaaaatgatgcatttttccttattaaaaaaacttgcaaacaatacatccatgtctaccacgtatatatagccacagaagatcctctgaactgagggtggctgtagaacacacctgtcactcccaaaaggttccaagtccttttgtaagattaaatatttactttctgcacatattatgtatttatgagctgggaacattaagattataggactacaatatactgttttacttattttttccctttataaactagttcaagaaaacaaatccaatatatgtatcatacagggttggttatgtgagttttttttttggcacttcggcaatatgcttatccagttgttacttccttttgttatgttagaatggaaggcccatttggaattttgaaaatgattccaacagcaagctataagccaagcaaaacaacaacaaaaaaaaaaggatttaggcttttagcatgtaatgagtttttggtatgccagtttgttatcataacgtgcatatctgattccacacctgtatataaagtggaagatgtggattttaatttgcctacctatttttctttccatataccatcagatcctattaatttgatgcattgtgtgcaaagtgtctgccactattatttctgaatctaatctgttttcggaccttttctcctgaaatattcaactgacctgattaagtgagtcaagaaaatagagatcaaaatcgacacttctatttcctacagtacatacaccaatcatgatgacagttccatttgcacagtagtgagactgaccatatataagttcagttcttgttcaccaaattgatatctctaagctattattaatttctttgtgttactaaaatatttatatgccgcattgtgatttcgtgacattgttgtataatctttaggtaatgtgcactgcatgcttgcttactagttgcatcaacaggtgacatcgtgcaaactgtggcggcaagtgggagagtctttcaaacctccgaagtatgtatctgatttcttctgcattctgttcaggccatttggtgaatctcaattgaattgtgcaatgatggaagctcgaacttggttggcataagctcagatttgaatactctttatgttttatgcaggacatgcacaactgtttcatggaccttccgtaacttctatgagaaggtatgtagatttcagagcctggacaaccttgtctgcagttttagttctctagttgcagcactgttgtggttgaatcctgtattcccctctcacgtcatgagccaatgacaaccacagtagttaattgaagaaaaaaaatcaattcatttaacatattctaagattttgcatgattcttgtaaaaggagtcttgaaacaaaagtacacgcaatactttggaagttttgccaaactgtcaacataagattatgcccttaaatgcgatcccatctcgatgaccgtcacatagatgtggatcatatttgaggctattttctcttggtttatattacttggtagataagcacaggtgctggtttgcatgatttgtttttctctttgaattgcacaagcagaatgcagcaggaacactggttcttatctgggggaaactgcgtgtataataaaatttaaacaccaatgcattttgtcaagagtagtgttgtattttaaatcagcattggttttatttttgcccccttctgtctcaccgaccctctttattgtttttgttccatgcaggcactccttgaatatgagaaacacaaaatcgaaacgggcgagtttcaagttgctgcatctaatttaacagagaggattacttctgaaagtcaggtacagtagtatgacggctagcataagttttccatgatccctgtggaaatcagacataaatgggtcctgtttctaactattatttatgtcccaaaatataagaaattttgggcttagacacgggtagtaagaaagtaggtgaaattaaatggggaaagattgtgattggttgagaagagaatgtaggtagagaagttatattttggaataaattttgaaatgctagaagttatattttgggagtaatttaaaaggaactgatttcagatggaatgaagattcattctgcatttaaatttttgacttcctttattgcagatgtttgtttagttgtgttaaatacttcagcaggaaatatgttatttttttgagatgtgtaagtaaggatcttaaaaaggatgagcttataatcttgatacaggttggcatccatgcttctggttctggaagagctagaagagaatctgcaacccgagctatgcaaggctggcactctcagcgcttgcttggcaatggtgaaattgctgatccaataattaaagtacgtgttcgttcaagtcaaattgtcattagtgacttgcaatttgttgtatcagtaaccttttgtttttaccaggataaagggacggtgtctgtcttaaaaaaggataaaactcctaaaagcagcggtaccatttcttgatttttattttttaaacatcatcatgctattatttacttatgttgctttttttaggttctgccaagaggaaaaggacaccgaccttggaagatgacaggattgtaccatataaacctgacaagctacagtaagtcttgcagatgattctctttcctttgtcatcgagcatccacaggaatcatgtaatattactgtaggcaccagtctgttcttttgaatgtcacgatgatattataaggctcatccagttaactatttgggttttggcatgccaattgattttttcactcttccaccctcaatttgtatggatgtgaaactgtgaactgatttcaattatttctatttggcagaaatgactcaatggttcttgaccttggccctccagctgattgggtaaagataaacgttcggagaaccgtaagtatctcatttggatcatcatattttacctttttcatgcttttttggcctcttttagccacttgcccatattttccagttctagtagttctccacagaagttctgaaaaacaatgctagcgaaacgcatattatgtttgaaatctgtagaactatcgtggaagttagaaacagcatgtgttaaccagaaatcaggggaaacatatttttcatggtcattttgtaaaggaaaatatcttttttcttgcagaaagattgctatgaagtctatgcattggttcctggccttctgcgtgaggaggtaaataaattctccattcaattagcaagcatgcagttagacgcttttggttcagttatcatttaccaagcactcctctgtcataagttggcaacgtgtcctatgcacacaagttccggttgcactaactgtgcacaccaactgagagatgccctaaaagaatccaaaagaatttctgcgtatacttgtaatcttattccacctatctatgaatttcaagtttagactcatactgcaaaagttggaatgactttggtactttggttctagatattccttattcatatctaatacattgatgcaggtacatgttcagtcagatcctgctggccgtttgatagttactggagagcctgagcaactagacaatccttggggtgttactccattcaagaaggtctgtcaagtgttaaccttttgaatttatttgatgtttcattttataattgtattctttggcattgaaaacggtacacttacttcaggttattagtttgccctcccgcattgatcctcatcaaacttcggcagttgtcactctccatggacagctatttgtccgtgcaccattcgagcagtcaaagtaaatggtgctctacaagatgaagcgcaacatgcaagtatgcccttgttccctaaagatgcgctgcaaacttacgtgttctgaagttgtcgtctgtatgaaagtaatgaaaatgaaagcatgttagtgaactggtaaaattttaagatgggcgcagaggatgttagtgaactgtaaatcttgtgtagtcgtttagatagtttcttgtggttgaatgccattgaactgttgtaatctgtttgtttcctgagtcataaatggtagaactcaacattgttgttgctggacagtagtaagttgcaatgggtttatgatttgcattctttagtgttattttcgagttaaattaagcacatgttttgagactaggacacacctgaactaatccacttcctttcttgcagggttgcttttgtaggtgggggtttatgtgattgacttgggcctgttcatcctgatcttcgttgcaaactagttactttctgcttcattactcctgccatgttgtctattctgtattgattaattctagttaactagatggtctagttatgtatcttgtagttcgttaattgtgatatgtagcttaagttcagctctattagtttagaatgttaatagcctgatgctaaacatgttcatggtttctttcttccttttttttttctcaactaaagaaaaggtgataatttgtagcatgtagcttgtgaggttattcctaatactcagttctcatactactcagaacatgaagacaagatagattcttggatgtaactgttgccttgtgcattgctgttgtatctgtataact

SEQ ID NO: 70354 - DNA, 1327 bp, Oryza sativa
aattcatggcaaacaagccggcagttcctaaattacaagcaaggccgtactcgctacatgatattcaataaagcatacctaaatcacaagcatctagaatggaacatgcatgtgtgtcagcagcagccaacagtactggaagagattcttgcccagtcatgatcattgagatacaactgaaccgaacagggccacatgaaactattccatagtttcataaattgagtaaaatgtggtctaatatttagtttacttggggtatacttttgcttatcaagtaaaaaaaataacaaacttcgaggaagggcaaggagggtgaattaaaaaaaaacaaaatgttaatctagatttcactcttcttctcacctgattaagcatccattttaagccaacagcagcagtgcattcattcttagaagcactactattccaatccaaattgtacaccttatccagtgtctttgttatagatgaaatgttacttctcctttcttttgaagagaaaatttcaccattggagctaacattcatatggctgttaagaagagtttcaaaccagccacttccagaacgttgtgacgagataatcgcgaagaaccggacaggtgtacacttgcattcactcctaagaaaaaaaaatcatatcaaacattacacaatcaaagtatatagcatagcataaaccactgcagcacaactctcacctgctataagttatcggttgtgggtaatgcacaaagtgaacctctgaatgcaggattgcagacttattgcatagctgttctgcaacctcgatcttcactattctagacaagctatcacttcctagttgcttcatacacatcgtgcatataaatatcccgcagatcatagtcatagcgaaaacaaccattctcaatgcgaggggtgatttcttacaggacttcacaatcaatgcgtcctgcgaagaaggtccaatcaatacaagttaatcagtagaaacaaaacagagctactcagatctataggcacatcacaactaacacttgatttattttagctttctgctccagacctacaagttataatccatagatataatcaagagcgattacataatcatttttcaagcatatgaccttagaagcatctatgttggcatgacagggaaacaaacaggaaagatcagattttgaaaggtaactggtccttcattcataaactgaactaacccaggtgttacctccaaaagagggcaaatggcccatgtacctgcccaacatcatattccttaatcaataatggatcacaagccaaagaatcaaaaatcccctttttctgtgtactg

SEQ ID NO: 70355 - DNA, 12196 bp, Oryza sativa
aacgggaacgacctctctcagatgatgctatcaagctgctgtacgttacaaaaattaccccattcttgatcccaatggcctttgagtctagcttagaatatggtagcttatttaaagggtgcactgcatgaaaaaaaaacccaacatcaaacacatatcaaccataaatacttttgatcacttaaggtgaaaatttaattttatgagttaattggcttcataccctgtacacattttgcaccaacgtcatccaaatctcttcgagcatcatacttcaaatcagagccaatagatacccacctggaaaatacaaccataatacaactagaatcaaacaatgaagcatggaaacataactataagatattgttatgaattcatcagatcactaaatgttgtttcttggcaacaatcttacactgccttatgctttccctgttgccaattttcccatattaatccagcaattgtccggcccttaccaacaccagctccatcaccaatgaaaaaacctgctctatcaccagtagggagatgataaaggtgccgctgtcatacaacaacataaagatttacaagaggtgtgacatataaaacttcatagaagaatatagaatggcactaacctgacaagcataaactaatgtttcgatttgcaagcaagacaaggcctttgtctcatccaattcatccatgatgttcaagctgtaagttggctcaggaggctgtacagctgacaaagaagaagtttctactattggatctggatgaggcagaccaagagagagtttgggaggcctctggaaacaagtgaaaatatgggaaaaattctcaagaaattaaatatgaatcacagtaataaatatgtgtacgaatatttatgcatagtaaagaatcagctgttaaagtacatagaatccttacatagtcagtgaacgtttctccaacagtaccaccttcatcttcttcacgctcaacatcaattgcaacctgcttgacaaaaaagcccagcaagtgaaaggctgtaaacctggtaaactattataatacaatatataaggctgtaaacctggtaaactattataatacaatatatgaagcatgcatcaacaatgtcagagaaactgaatgtttatgggtgtaaaacattgtacagtttgaaattaatcagcagaaacttttaaatcctgctgtacacatccaaagagcagagaacaatgtatggacgaccaagcagatgaattcaaaaattgaaaccgaccagccaaagccaatcaccagaaatgaaaaaatattgccctaaccattaaaaatgaaaattaaggaaatcagattgtacataattatgtcatgtgaagccctcgttatcatctcaagcaaaacaattgtccaatttcatgcataataaaagtataaatggaactataccaaaattgccttcctagcgaatatatagcccattacaaacagaatttctcgttatgataaactatcggtccaaaattgcctcgattaacaccgttcaaaggtcaaagcgcattcatcaagccttaacgaataagatcgtatacactaaccaacaaaatggcagagcaagttagtgcacaacagcatacctcgttgatctcctcaggcggatcagtgatgggaagcaccatcgggatcaacgcgccaggcaccatctgcggcgcctgcgtcatgcctggcgtcggcacgggggggaacggggcgggcggaggcgcaggcaccaaaggcgcccgcgacgcgggtcccgaggccggcgggacgttgtccggcggcgccgcggcggcgttgttgttggaggaggccaggaagttgtgcagcttggcgaggtcgacggcgagctccacgccgcactgcgggcagcggaagcgggcgaggccgtggggcacgttgagcacggcctggcagttggcgcaggggagctggatcttcgtggggtccaccccctgcgcctgcgggggcggaagggccgcgccgcctccgcctcctctccgggacgtaggcggcggcggtgccgccggggcgggaggcgcgggggtcgcggcggcggaggaggaggaggagggcggcggcttgggcatcagctgcggggggaggcgctgcgccatgccgcacttggggcagatgaactcggtcatgcctgggccgacggcgaggacgccgcggcatccggcgcagcgcacctggatgggcgcggcggccggggagggggaggagccgccggccatcggcggcgaggcgaggcgaggcgaccgagggtttgtgagagaggaagaggggggcaggtcgggttcctttccttgctcgctatggagaagcaggagcaagaggggggaggaaaccgaaacggcagagccggaggagcgagtgggttggtcggttggtcttctggtccgagaattaaaagatttcctgctgccaattgtaaatttttactgctagcgtcaaataagaggggattttggtgcttgaattttagttacatttttacctctgttctttttgttgccggagttgtttttaagggttcttttttaatttttaatagttcaaactttgaccatatggtaaccattttgttttttcaaagagaggctccatttttgttctttcacaaaaatggaaaaggaaatggagagttgtttcaatttagataatacgacaattttatcacatgtacttctttcgtcaaaaaatacttaaccaaggggttcctagattaagcttttttttatttaacggagggagtacgtaacgaagccaatatttagcttagataaaagccaagagacttggagaagaacgaagccaagatttagcttagataaaagccaagagacttggagaagacctaacgcactaccgtattacttagttcatacctaggtctagttaattagatgaccctacataaaagattgttagaggacctctgtccatgtaagggtgtaagtggctaaaccatagagtcatttataagtcaaaataaatggataagtgtcttattttgatttataagtgtgtttcgtgggttagccacttacaccctttgtctaccccatctccgcaaattatacaacatccaggtgactacatatacagtttgaaattacgatataagaaaagggactgttgttttgaagatgctgacacggtgacaccaacacacacgaacacatattgttgttttcaaatttcaaacatgccatctgcaagattggaagtgaaatggaacacagtggaagaccaaccacattactctcccaattactctcctaacaactcaaagaaggaccaaagaaagctgctatcatgcgtgaccaaccaactaaatggaaaacgcagatgcagcatatctgagatccttgcgacgcctgcacgatcagcatgctaggatgtgagtaatacttccactgtgtactcgagcatccaccaaccaggttcaacctgaaaatggaacgtggtaaagacagtagtaaatgacatcctctagaaaccttgctagtttgagtttcatatttacactgaataattgagagcttgatattacattacccgtgaggcaatcatcgagtttgttggctagaagagttagggttgtacagcacagagtaatcaatatagggggactgcaaatcatcacgagagctcgatgcattttggccctttgatgtaaaaagataaatagcaattctgatttagatacaaatggcacagtttcaaacaacctaatatagtaatacctcaaatcagaagttataaggatatcacctgtggaaaacttggaggcgccgttgatgcacccatcaatccatcaggcaaaccaccatttgacatcattttctgcatggcgctcactgtattcctcatgttagccaaatcctcctgcagctttttctgactttcctccattaccatcatcttcttcctcagtgtggcagcctcattttcagcaatctcttttgcatccacagcttccttgaaggatgccttaagggctgccttttccttcaggccactagggctggccccaggttcatggttatgcatcctacccctcctcttttcacccatggctgtgacatcatcactgcgcttacgagccttgtcacgagaacatgactagacggagaaagaaatgtcagttcttttacacttcaaaaggtcaagtacaaaataagagtacgaatttatacacatgtgaaatatagtaatggacttaataatgcaagcttttgtgtaactaatagacttcatatagtatagttgcatcaggttatttttccctctgtcacgcaaataacacaggaatagtttatggttacctcttcgtcaagtatccgtgcaaagctcttcgatcctgtagagctgatataggttgattttgctcgagaagctttgcatctagcacttgcagcctgtatttggggaaaaagagaagggtgtaccaatcgtccaacatgatgcaaaatcaaaatatgactatattgttacaacatatgaaagagaaatgtgcagccttacctgtgcctcttcggtattccaaaatgcaacaaggaatcgccactgttcttttaggacacgaggatcacaatcagcaagacgttcctcttcagttatatgagaatcatagtgttttcgttttaagttacacctccaattcctccactttgttcttatgcatttcagtagcaaggactcggaagatggagcaacataaaatttaagctacaccgacaaacatggagtgggaaagaagctataggcaggacaaaaaacagtattagtaatcataattcataaatcataccttaataatatgccacattacatccttgttctcctttggtatacttttccattttttatatgtaagaggtgccaatattccatcacgcgctagtgtgcccagaaagttaccaaacatggcagcattttttccaataggaaaacctgaattgttcaaggatactggaagccgcacaccttcaggcaaggtccacactttgacacaaagggtagggccacgcctgtgtcctttctttctcttgctacctacttgaaacaaaagtataataactcacctgaacagcacttctttaaataaaatggcaaatgtgaaacatctggattcactcaaaattgtatcttgcttgaaaagggtagtcattttagcttctgtagaaattctacttgtgatcctatcttggtaatttgatccacaccctccacttagacaatgatttccaaaattcttttaacatgaagttttgaccaagtactttttctaaccttttgtactgttattctgttttaaaacagcaatattcctctcaccatcgtttttgacttacaacagactggagtggagtaccagtgtcatgaatagaaaaggtgtggttaacagatcattatggcgcccaaggataactaaaaatgtgtttaagaccctttcagataataaactggtgattatcccttgaaagttaaactggttaccctgttcttcatggttcaactatattttttttaaaaaaaaatctattggggaatcataagtgggagtaatagcactgaagtttatcagcaggtccactggtgatattgcaacatataacagtaacaacaaaggacagtaatacatctaaaaaaaagggacagtaatacacattaccaatattctggccagatggcttctgacaatcacgtgcttgctccgcatcaggaaaatcatgcacaaattcctcatcggaacattcctcggagactagatgattaagtaatgaattagatcttttctttgaaagggcccttctgacctctagagggaatacctgacagtaatgttgagcaaaacgctcaggatcagacatatcaggatttgaaggagttgtggctaaatcagggtcatctggttcactagatatttcccgaggcttctcatgaacagaggatgtgctagggcaaagaccagcaatgattctgtcaatgtctggagggtcagacatgctttgatgtggagaaaaagcacaatgctcgtgatgctcactttctacagattcggcgtctgtcgtagatactaaaacttcacaatttggagaaggagactgatgcagaataggctcctgttctattggttcactagacatagcaaccgccgacacctggcaattcggagaagaaacctgcaggtcaacagggtcattttcaactggttcattttctacaacagcaactgaatctttggccaaacgtttactacgcctaagatgaagacttgaatttgaagaagccatcagccccttcctgttcttctcccgggcttgactagaaggctgcttgcaattttcgacattaatatgcttcttctgagcctcatgattggggggcatgtgtttctgatttatatggctaagctgattcggagagactagcagatcctggttctttagggtcaaattagagtcaactccagttccagtttttggtttgccttttcttccaatatgcttactctgaggatcaaaatccacctgcattgcatgattattaatatcagaggtatgtcctgtgtgctgtataacatggctcagtggctctatctgtctcttgttaacattatttttaggatcaactacgtgtacaatgtcctgctcgctatgccttgcagaagaatcttttctgggtcgaaagcacatggcttctctatgagtcgtttgacttacatcctcgtgaatttcctgatctggatgctctatctgtgcatgttctgcatcattagcataagattgatttgtttgtgtctgctttgtgacctgatcggcggtcgatgtttttctcttccctgcactaacagtgttatgtctaactgagcatccagatttccaactgtcaccccttgcagttgttttatctataacctgaatgcatccctcttctccatgatttgcttggtcaacaggttccggttgcgcctcctctgcatgaatcgcaccatctagacaccctacctgagtgtgctctgcacgaattgcatgagcagtatgcttttgccgcttctgtgtgatctgattatcgtgttcaatacgcctcttatctacactcccaacagcttcgggggcaacagagcacataattctccggttgctatgagttgtagcagtctcatatatcagttcagcatggcttgcttctctataaacttcatggctaagaggcccctcctgtacctcctctgaatgaatgactctatgcaggcgtgctagttgtgccggctttcgctgagtaccgtagcttgaacgctgatcatgtacctgatgcctggccgcttttatcggcaacaacctattcttcacacttacaataccaggttcaactgaacatcggttcctctgctggatattacttgaaacaatctcatgagcttcctctccaccaaacacaccatcaggatactcttcttcatcctgctgtagatgaataagacgatcgggatgctgtatccgtgaccgttcaagaggaaatagtctatcatcagcttctgctcgggcaaatcctgaacgaactgcagaattagggcgcctttgccatgcctgcatcacagcagaaggagatgcaattaaaaccctagccaaggtaaagcaatggattgaaaacgtcggtactagctcggctagcttcgattgaactgagatttcgtcgatgttgagagatcgaacgctacaagccaaatggtgcatttgatttgaccagaacccaacccacccacctcccggccaccgaggatgggttgcgcgggggcgggggcgaccggcaccggcaccggcacggcggccgtcgcggcggaggacaggatgtagttccggagccgcgcggggtagacggcgagctcggcgccgcagagcgggcaggcgcagcgcgacagcccgacggggacgctcaggagctcgccgcaggagccgcagggcagccgcgccccgcgcgcgtccgcggcaccccgggggaggggcagcgccctccgccgcggcggcggcggggccggcatgagatccggcgggagcgactgcggcgtggcgcagtccgggcagacgaactccgtcagcccccgctccacctccagcgtctccccgcaccccgcgcaccccacctccaggatctcgtcgggttcctcgtcagctgctgccaccgccatcgccaccggcggcggcggcggcgccattgccttcagccctcagcgcagtagcgtcggagtgtggaggcgaacgtttgggccgtcgagacgtcaggtcgtcactaaaaggcaaacaaacatcacttggggtgtgtttagttcacaccaaacttcccccaactcccaactttccatcacatcacatcacatcacattcaaaactttcctacagacataaactcccaactttttttttcaaactaccaactttccctaaacttctccgcctatatggttctctaccctacacctacacccaaatctaggtaaattttggtactaatactaattttttctggtagggtaaagtaggctagcccatgtttggtttgataccaatattaaaccaaagtttagtatggtgaagaagtttctagaatgtgatcaaattgagtatgggcattaccaattgtttggtttcaattcaaactagcatgtttactattcaaagttaccaaaattttggtagagcgcattttggcttcaatccaaaacagcccttgaagcacagaaaattcgtcgcgtttttgccaattcaactcgtagtacaattagaaaacacaaggtataaccctatagagagtatgtttgggggagtttctagctgctgcaacttctcccataaccaaaagctcccttaaatagtctatgttttggtacagattctgagaagttgtagatatagaatccagaaaatgaactataagctcgaaggcagaagctgagaaacccaacttttctatattctcagaaactggctaccaattaactgcttctcagaatctcaagcttcactaaacacgcccaaaatcatttcacaggaagggaaatgcgaagtgaagtagttctagtcagtgtaaacaaaacagaagagagtatcctgttacagtagccaataaaacagaagagtacaagcactgggctccgggtttagagagccaacattacacatgaacggccaactaaacgtctaaacctcttcgtttcatacaccattccacgatcaagatggaatcaaccatgcatattggcattgtctgtggtgcgattatcatcgaaatcgtggactaggggaggcagaaggatcgtacagtgcagagtagtcaagatatggctgcaaaatctcatgagcgcttcgtgaattttggacctggaatggatgaggaggaagcatggattccggatcagaaacagtgggataagctgttacaatgatagatactttctggaggtgcaaaatggattatagctggatactccatttacctgtggaaagttttgcgtttgaccatccgataggtcaccagttgacgtcgtcttctgcatagcactaactgtactcttcatattcgccaaatcctcttgcagtttcttctgactttcttccattgccaccatcttcttcctcagcgtcgctgcctcgtcttcagcctttcttttagcctcctcagcttccttgaaggatgcctgcaagactgccttccgacgatgacccctcttcccacgcaggccaatggagcaggattcaagtccgactttgtgtgctgcagagtcacttcctgagcattcggcttgcttatgagattgttcacggactcgtgcctgcatggaaaataaaactcagatctcaaccagaaaattattagtataaattacttccttgtgtctcacaatgatatcagctttttccttcttcataggcttcccgtttctgtgtgtatgagtcaataggaacaaatccgcagcagtgggctcctcattgttaggccgcttctgcttctgttgcatgcggtaatacaattagcacgtcattggtgatagtgaaagcaaagcaacaggattttaattacctcctccctcaattatccgtgcaaagctctttgttcccctttgcagtatgcgtagcggttacatttgcccgacaagctttatttcgactactcacagcctgatcaaagataaagttaccaatcatttaacaagcctgccaaattgcaaacaagatggcaagaaaatagaatggtcggtgttaccttcgctttttccgtaccccaatatgcaactaaatattgccactgttccttgagaacgcgaggattttgatcagcaaggcattcctccaccgtttcatgagtatcataatgtttttgttttaagagagctttccaactcttccactttcttcctatacacttcatgatccagaattcagcagctggagcaatgtcaaatttgagctacatcaacaaacaaggggtgtcagagaagaaactaaaggcacagaaagcagcagtaaccatataaaactgcataccttgacaatatgatacatcacatccttgtttttctctggaacacgtctccaatcttgatgtgtcagaggtgccaatattccgtcacgtgctaatgcacccagaaaggtagataaggtgcctgcctctttcccaacaggctcccccgaagcgttcaatagcactggaatgcggacacccttaggcaaattccacaccttgagacagagtgtaagaccacgaccacgaccacacccttgattcctcttggtacctgcttgaaaggaaaaaaaaacaatgagacaatcagatgagcataacaagaacagctgtcaaatggtggtgttctttatagacagagtatgaataaggaaatgaacaggatttgataatgaaacaggggagtgtgaacagtttgtttcaaacaaatccaatttattatatgtttagtggtctacatgggaaaatgaatattttagtgtgacaagttcctctcggtacccacgagtctccattcttctgtggattcagcatggataaaatgcaaaaaaaataataaaaaaaaaaccctccaactatggtaatcatgggcagatagcttactgagttcaaaatgatatgtattatagcttaataagactcataatcgctgctcctaatttccaaagaaagaaaacacttctaatccccaagaattctttatagatatgtttaccctcagcagtgtaacggataagagtgaaggagaatagcttaatgagtttaaaaggatttgcatcattgcttaataagattcataatcccaatgaaattattttatctttataaggaggtttattctcatcagtgtaaaatagacaataataagagcaaggacaatggctcactgagttcaaaaggatatgtaccagggcttaataagattcgtcatccttagaaaaatattttatctttatatggaggcttattcgccctaatgtgaggcacaataataagagtgaagcgtaatagcctactgagttaaaaaggatatgggttgttgcttaataagattcataatcccaaagaaaatatctctttctaagaaaacttattctccatggtgcaacacataataataagagtgaaggacaatagaagtgtgaattaccaacattccagcgttcgtcgcaatcttcagaatcacttaatgcatgcacatcaccagaacttgcctgtgacatcgcacgctcaaatgatgaattactagatcttagcttcgcaagggcctttctaacttcctgcggaacgtagttacatgcaaaatgctcaggatcagacatgtcgatatcggaaggtggtggtgtagttaactggacgttgtcaaactcattagagactttttcaggggtcatatgcctaggggatgaactagggcatatgctgttaatgattctgtcgatatctggagagttagacaaactctgatctggagaaggcatatacagatcatcaggctcattttctgatggttcactgtctgtgatggcagctggcatgtggccagttgaagatgcagcttgcctctcaacaggatccctgtgtattgattcagtatccatgactgcagcagatacttggtcattttgagaaacctgctgctcaaaagact

SEQ ID NO: 70356 - DNA, 1409 bp, Oryza sativa
cagcggctttctttcctctgcgtttcttggattgcagcaaaatcgatcccccccccccccacccccccgtaccatttttggtggtggattgcagttcttgtgccatcgatttgggtgggattcgggcgccgcgtggaaggaaaggtttcttctggggtgcccagttgggctaaatttctgggtagctcccgccattgtcgaagctcttcagttcttttgcgtttcttgggccttgtatcagatccgtgcccttgcgatttcttgtaattggaggtgagagagagagagagagagagaggtcgatccatggaggtgcagggagaggtggatggatcgggggtgcccctggcggtgctcctgaagcgagagctgtgcaaccagaaggtggagaggccggacatgctgttcggcgaggcgagcaagagcaagaaaggggaggacttcacgttcctcttgcccaagtgcagccgccgtccaggtcaagcccaggctgacggggaggatgcaggaggcgccggcgacgacgacaccatctcggtgtttgcggtaatgcctcaatggcctgcgtgctcttttttcttttcccgttattactgtctctgagaccaatagtccagtttgttgttgttgttgttgttgctgcgtgtttgttgcgataatgccattgatttagacctataaactgaaaattcggttggaagtcagtgtttataatgcctaactaggatagttagttatcgcattatcttgttaagctttcttttttttttcctcctgcaaaataaaatgtttggtttttttttcccatcgtcaatctctgtgcctaacatggtgcgtttgtttgttgtttgtcccttgcatagagtagcatgattgatatgtcagcctgattttgcggtgtgtttgcatcaagtcacatgggggacatatgtcagctaatattttacttgccttaactgtctctgtgtcaattatttcggtggtcagaagaccagtggtttaggaatattcaaagggagttttaatgtcaatagatgatagatctttcaggcctccaacagttagcattatatattcggttctactaacttgtctatcaacttaacatggcatttttaaataaatcattgcagtgtaaatggtaatattcaggccacaatgcaatactgtgtgatagtgctgaactatgagtctcactattttgtttcgatttttaaacttgtgtgttataacaactgaagtggccactgatcttgaattatttatcctgtcttctcttcagatcttcgatggccacaatggatctgcggctgccatatacaccagggagaacctcttgaacaatgtgttggctgctattcccccaaatcttacaagtgaggagtggacaactgcattagggctgcagg

SEQ ID NO: 70357 - DNA, 18363 bp, Oryza sativa
gtgtgtgaaaccttcgatggaccggaggtggttggtccttgctaggggaatagatacttgggttgacaccaagagagatccaatattgcaaaaaaaaaaaaaattctaacatagctgctctattgcgtccatagatgttagtggacatataaatatgcctgctagtatgttaagcatgctccatttggaggtagtaactggtaaggtctcagcttttgtattcaaatttggaacctaacttgcataatttcttgaagcatcaatcgacgatatatgccaatcgctgaattcgccaatgtagctatccggcctttcttagctggagcacaaaacctaaccccagttcactcctgacgctttgcaggacacattagattccgtggacggtgaaaaggatccagcgggggaaggcgaggacgaccccgagaaccaggattatgatgacgatgagcattggagctgagccaaaacgtgagcttgtggtggcaccagattttcgtctcctcggagcacttcccggttgccagcgtgtaaatcatgtacagatttccagcatctgaaagcggttgtctcgatcgcttgctggtcgcttccccatacggcttcggagttaagactttttctcaccgtcgtgcgtcgccgtgggaggcaggcgcgtggtacgaaagaaagataccccccgttgcgctgcgcatcctcgctttcctgccggccacgctgcgtcacgcggaagctgtcgcgcgcggcgcggggcaacgcgacgcgcgactcgcacgccaccggcgcgcgcgtgcccacgcgttggcaccccccgtgagcaacgtgacgctaccaccgcctgcctgtctgcttcgcccgccgcggcttcctcccctctgcacgcggtgcggtgccgttgcctgtttttttttagtactccaactctagcttttcggcgtgaattatagtagtagtagtattttgaataggggtacgtatatattcttctgcgtatattcttgtgcgtaggtaggaaacggagtgctgagcaccagctgtacgctgagctcgtcaaccaattgtcaatctttacgaatggagtattttgcctaatatacccactaaactagagttgacccggtgaggccaaactgctagtctttggcaatacggttatttcgtgagacgcggctttgccaagtgttagatcgtattttcccgacaaatcatttctttgaacggtaatttacgtgacggactgacggtggtgtttattacagcacgggctgatcagttggtccaactgaaacctcatacccccatcacaacagctttgccaaattccgtaatgcatacgtatgacccgtcggtgtgtgcgatgcaactgtagggccagaaaagaaagaaagaaaagggagtagtagacttgccggtgaaaagccgcgcgcagaccaggcgatggagtccgcgagcgaccgaagcgggagcgaaaaaaaaaaggaaaagggaacgaaaaaaataagttaaacaagtagcagtgggggccccgcaccgcgccggccgccgagcgacaaaataaaattcagagactagcgaagtagcgaggcggatatccaccgatgcgggtgcgtgtggagtagagaaacctcgcggaggagggcgggtcccacctcccacgccgcagccgccgcagtcgtgtgtccgtccccatgcgtgcgtctccgtctccgtctccgtctcctggatggagatttgattggacaagtggtgtgtggtgggcgccgtaacggacggtgggccgcagtcacgcgctcggcgagcggggcgctttgcgacgacggcgacgtacggctcgcgcgcaacgcgacccgcgcccgacgcggacggtgggtggtgtgaaaccccgcggtctgcgcctctgacgtgacggccaccggtgctcgacgcgttagttcgacgccgcgaagaataaaaataggcttgcgattggccaggaaaccagaagctgagaattgcctcacgctgggtacgcttcggatactatgcgtgtcctgctcttttctaaccgctaaatgttgggggtttttttacgaaaattttctatataaaaattattttaaaatatcatataatctttttaaaaaattagaaaatttgaaactcgattaattatgtgcgaatattttttttacatgtttatacttaattttcatctccgttaggttcaagcgggaaagttactccttttcatataaaacccttacacgggacatactgcgagtaaatttagaattcttttttcaactatctaatcaatcacttcctctattgtaaagtccagagggatagttaaaaattaaaagttgttgtattaacggagggagtacatttttaagtggtttaaaccttttttacaaaccacgtcctacaggataagtttagtctggatttttcatattttgatccttttaaaaaacttatttcacagatagacccctaaaaaaacttatcacagaaatggtcctttttgggatgctagagtggctggcgccgtccccctgccgacgtggcggggcgatactgaggtggctagggggagcgcgccagagtggttggcgccccccctccccgaaattttttatttttcttttatttgtttgatatttttttcacgcttaggaacacacaaagaaccaatcatagaaaaattgaactcaaatggacgtaatatgtgacctatagaatttttcctctcctctttctctttctccgaactagtacagaggagagagatgtgcaacttttttatttttattttttttttgatattttttcacacttaggaactcgctagaactaaccatataaaaaataaactcaaacggatgaaatatgtggcctgtggaattttccaaagctctacgaaaaaacttctctcttcgaaaacacaattttgcaagtggaatttggaggttttaatatcttccgagtccgtatgagaaagttacacctattttaataaatgacacccgaatgacttttcggtagagctttggaaaattctacaagttacatattttgtccgtttgagtttattttttctatggttagttcctgtattatcctaagtgtgaaaaaaatatcaaaaaaataaaaaaaaagtgcatatctctgtactgtttaacttatggctatgatttcatgtggttatatttactaaaggagttatggtctaattttgatgaaagtaggctaagtggtatgctattttcagacttctagctaagtggtatattccgttcgagtttaattttttcgtggttggttgtatcgtgatcccaagtgcaaaaaaacatcgaaaaaataaaacaaaaacaaaaaggttgcaactctatatagaggaataggaatggaggcgaggggtgggaggagctgcgccaacatggctggcgtcctcctccctagggcggcgccctcctcctgacacgtcggttcgcgtgtgccacggtggcaggaggacgatgccagccactctagcgacctaaaaagaaccgtttcttcgataagttttcccagggatctatttacgaaataagtttttcaaatgaccaaaatgtgaaaaagtccattaagtccagctgcactatgtgtcacgtgaagtgctcgctccatcacataaagactataattatcgcattgataaaacaaaattattcagtagcttagggcctgtttactttgatgctaaaaaaaccttaccaaattttggtaaagttgccaaaaaaatggctatatttagtttgctgcaaaatttggtaactatataagaaatcttgctaaaattttggcaaagttgtcaaaattttggcaataccaaaatttggtaaggtttttttggcaacaaagtgaacatgcctttagttttttttaatggctaaataactgaatgattttgtgaccacattaaaggataccaacaaatatattattaaaattagattttaaatagattttcaataaaaaaatccatatgtagattttcttttgaaaaaaaaaatcaacccctaacttttttctaattcttgatattttggataaagttctctctccaattttgttgcgacagaccaacactagaatagcaattacgaaatttaaatactcctactaaaatcacactcgtttgaatgaaaggttccagaaaatcgattcgtgttgtcatggcatgctaattatatttagatcatagtgttataagatatagatatacaattttgctataggttttacgaaaaatcgtcggtgtcgtgtgataccggctatatccgcctctgtgtacgccgcctgcgcctcagcgtctggcagagaacagcgagagggaaaaaaaaagggttggcggtttccccattccaccgtccaaatccggcgcccgaagacttgtccggtccagctcgcagctccgctcgggtgcagcgtgcacgcgcaacaatacaataatcctccgcgaatctgccgtctacccgcggccgcctcagcccgccgccgtgccaagcaaggaagacgcggtgcagctacgtcgtcctcctgcggccgcccaccacatccatcgtccgtcccctgttgcccaaaaaaaacactttttttttccgcccacacctccctcccgtcacatcacgcgccgcgtcgtcgcccccctgcactgcgcaccgcaccgcgggccacgccacgccacgcggctcgcgccgcgaccgggacaccgtcggccccaccaccgcgcgcgcgctctcgcgctctcgcgctcgcgtttacgacgttacgtacgggggaggtggggataacaaaggcggcggccggtggcgttggccccaccacgcgaaattgcgacggttttgctgctttttttttttggtttgcttgtctgcatgtctcgttttgcgcgcgccgccgtcgtcgcggtggacggaattatgggaagcaatcagctgggtgcgcgacgcgacggcacagccgttgttggctcgctataccatcccttcaccgcgaaaatcggcgcgcgacaccaccattcgcttcgccgcctacctgacgcgaaaatacacggacctcaccccttgttgattccaccgatgggaaatggcaaaaagaagtaagaaaaaaaattggaaccaaacatacagattgagatcggatacggtcgtaagtgcgactgcaccttacgactgcatatatttttagccatttatttttcagatctcaaacattctaacgcatgcatgattatcaataatgcgaggacaaaatattataatttagaattaaatatgatattttctaatacaatgtatttggatagacagtctgtcattcttatattttaatacggaggtatagtacagcaccctgcgtcgtgccgttgtgcgtccaaaaggatcacaaggacaataggacggggcagcgcagcactcgaactaccaagcaagcaaggagcaagggaaagcaaccacacacacacgctaccaaatcagcaccgtcaaaggcaaggagaaaagaaaagagagagagagagggaagattaacgacgggacaaaccgcgggggcggcgcctctctctccgctccgctatggggtcaaacctcccctcccgctggccccgccgcacctccgcctccctataataccacctcctctccccactttcctccccccaaactccaacgcaccaccggcgccaaaccaaccacccaccatccaccggtcgaacacttggcgctctcgcccgccttagctcgctctgctcgtggtgctcgacccgaacaagaacggacatggctcccaggaacgccgccgaggccgtcgccgtcgccgtggcggagggcggaggagccggcatggagcccaggttccgcggcgtgaggaagcgcccgtggggcaggtacgcggcggagatccgcgacccggccaggaaggcgcgggtgtggctcggcaccttcgacaccgccgaggccgcggcgcgcgcctacgacagcgccgcgctccacttccgcgggcccaaggccaagaccaacttccccgtcgccttcgcgcacgcccaccaccacgccccgccgccgccgctgcccaaggcggcggcgctggccgtcgtcagcccgaccagcagcacggtcgagtcgtcctcccgggacacgcccgccgccgccccggtggcggccgcggccaaggcccaggtgcccgcctcgccttcgctcgatctgagcctcgggatgtcggccatggtggccgcccagccgttcctgttcctcgaccccagggtcgcggtgaccgtggccgtcgcggcaccggtgcctcgccggccggccgtcgtcagcgtcaagaaggaggtagctcgcctggacgagcagagcgacaccggctcgtcgtcatccgtggtggacgcctcgccggccgtcggcgtggggctcgacctgaacctgccgccgccgatcgaggaggcgtaggttgcagcgcccgatgacgacgacaagacccccccacaaatccctcgtagaaaagtctagagcgacgtgtaatagtaagaggttaatcgtccgtttaattgccaggattgatcaactaggtgtacatagatcgtgtcctttttgcacggggagataggtatgaggaaaaggctactactcccggtgttacagttcctttaaagaaagaaggaaaaaaacaagaaaagaaaaagaaaacattttgttgttcgatgtaacatattgatcatcaatctctgattaatgagaaatttacgttattttgttcttaaaaaccatttactgtggatgctttacccgtttattactagtatgtggcttcatccctgcaagttagcagcacaggcaactttgtttccagcacctaaccagatctgtgtcttgactcttgagggaaaaaggacttgagatttaccatcccagcttgtgcatcattaaacagaggaaaacaattaaaccggttttgtcgtctcctgtgcatcttaattgcacatcaaaacaggcagatgtatgtgcaaatcagctcaaacaatgactgctagtagtcttctcccaccgatctgaagtgtgtgttcgatgtacaagagcacgcgtcgttgaacggttcggcggatgaaattccgtggcaaaacaaagtacaagtgccccgctcctcctccccggcgaccgacagccacaccaccccgcggcccgcggaaggaaaggcttggagtacgacccggacggaggagacgcgcggaaaaccgcggcaccaacgaccatctacgacgacgtcgcttgccgcgggccccgtggagaacgagtccacccgtgcacaggcgtgcgcagcgggagcagagctcgtaggacgccgcgccgcaccgcgtcgcgtcgcccaggggagggggaggagtcgtcgtggtcacgctcacacagtcacacttgctcccacggcgcgacaaccacgtagccaaagccactggctatggcctccctgggcgcgcccccaccaccaccccacgcgcgtttgacgccttcctgtctcttcacctcgcttcggcccggggcaagctcgctaccgcagcgcaagctacgtacactcgcacgcacgcacacgcgcgacccgtgagccagtgagccaacgacccgcggatgcgtgggtccaccaccgcgcgggggccccacgacccaaccaaccgtgtggctcggatcgtgtttgtcatgtggtggccggcgtcgcggtcgcggggcggctagtcggctacagtaggcgtcctcgccttttgttccgcacaaggattggttggtttggttggttgtttggatcgatctgcgactgcgagtcgagccgcgagcgagctgctttgcttttggctcatcagcgccgatggttttcgcggttcgcgtaggtggtagcgttggaagctctcgcaagtttactatctcaactttgcgaaatttcggctgtgctctgtagttgttggcgcagtatctcaactagctagctggctggtatatttgccagagaattaagggacatgttggctgttagcctgtgagcttactacaagggtctataagttttgaggagttggataatctagagttttattccaactgaattacgagtatttgagtggttttctcaaggcatgattaaacggtctggcatctttttcgctctcctctccatctcatctaagcacatgttgtttgcgctaatgcttaattacatatctgaaggtgtgtttagttcatattaaaattagaaatttggttgaaattgaaacaatgtgacggaaaagttgtaggtttgtgtgtggaggaaagttttgatgtgataaaaaagttagaagtttgaagaaaaaatatataactaaactcagcctgaacttgattactagcttactgattactgattactgtatctacctacacacagtatgggtatatacatgggttgatatatacccatccatgtctctaacccagaaaaagaacagtaaccgtagaagggaggaaaaagaggaaaacaagagcaaagtctcgagtctccacgctccaccatcaaggcatcaactcatcaactccactggtatatcccgtagtaagagcaggtacagtagcattcataaacatattttaaagagataaataaaaaaaaagaagagcaacggttataacggttataaatctatagcacgaactctaatatgtaatgtgtgtatgacagataggaccaagtatcaatagtatagtaagcaaatattatatgaattgactatagatgatttcgaaatagtagtgcgctataccgttaaactggctctaagagtaataaattaagacgaagatgacagatcagaacctgcctttctgttccgacctcgagccggccagccacacaggacgcgtcacgtgtatgcacctgtactccaccacatccgagagggaggcagcgtcggcggcttcgaatctcaggcggcggccggcagatcagaataaaagtagccgcgcgcgcaccggatcacgacccaaaagccaccgaaaccggtggacctgctcgccgcgcgccgtgctccagcttcagacggcgtcacggcgcctaactagcgaggcattggctagcccagcccccacgctttccaccgggaaaaaaaaaagaggaatcccgtgtggtcgtgtcccctcggccagccaccagcgtacgtacgtactccaccactcccccgcgcgcgccgccgcctacgaaacgatgcacgcaacccaccacaccacacgtccacaccgcaatgcgcagctagcgggcggcaggtcaacattgtacgcatcgccaggtatgcgtgtgtccaccggtagtactagtagtgcagctaccgtgctcgaggagtaactaacagaatcaccgaacgatctctttcgtgcgccggaacgacacgtgcgtgcgtccggactagctgtgctcgatcgatcgatcgtcgtcgtggccccagcgaacccacgcgaaacctgtcacggcgccgcgtccgtggagattatttcctcgtccgcgtcgctgctgctgctgctgctgctgcatgcggctcgtccggtgctttgagccgtggaggtgcacgaactgccgcgccgatcgatcgagctcccgcctcccgcggcacgttgcggcgcacgcgcgcggcggaactagccatgatgaaccgctccgcgcggtctacgaccccacgaatcctcccacccaccgggttaaacaccgtaccgcgcgccgcgggtggccgttgttcgcgccgtcccacccactctcgatcacgcgagtgcgtgcggaaaacgcgcgcaggcctccacgcgtcgcccctcacccacgaaccacccgcacgaggcacgacgtgccgacgtgttggcacgcactggtggtggtggaggcgtggagctagcgagctggacggaacgaggagggcgtgccgaacagcgcggagcaaggagacggtcgatcggtacggcccattggtgcgaatcaacagcacacacagcccaaacagctagtacccttgccagcggccaaattttaaaatttgaacttaattttaatttattgttaaggtttttcatggtattttatttttaagaattagattttaaatcaaaggtgcaattgcaaaattttatccataaaattatattaggttctttcgtttatatttttttataacaatttattggttgtagctcaatcggtcacataacaagtacttcttcgtaccaaaatataacaatctaggatctgattgaacatattaggtggtgtttggatctcctaaagatgaagataaagattaagtgtttcacgcaaaacgagatggtaataacgtgtgattaattgagttttaattattacaaacttggaaaatagattaatctgatattttagagcaactttcatatagaatctttttgagagaatcccttatatgccactgaaaattggtttgatcccttatataccactgaaaattggctctttccttatatgccattgatccaaatttgcgcaccctctcatgccactcccatcagttgaccgtatgttgaccgttaattttaaaggaaaaaagacatatttacccttctgagtatagggcatgcctaacaactcagacatgcaaatatgtcttttttacttgagagttaacggtcaacacacggttaactgacggtagtggcatgagaaggtacgcaaatttggaccaatggcatataagggaaaaaccaatttttagtggcatataagggatccgacgaattttcagtggcacataagggattatctcaatttttttttgtaacataccgtttagcagtttgaaaaacgtgtcacaagtatacaaaatttcatccaactcttgttggagaaacgaacgcagccttagtatgaatatggtgaatagtggatatatcccgcctatatttacagtagtaggatagtatattttgggatgggggattactatggtagagtattttctttcgctatcgagaattaccgttgcagacatgcagtgatgcagtttcaagaacaatatgagtacagctaatgacgaggctcctaccttggtaagcatttcgtcagcatcgctaatccagtctcgctcggtaatcggtgtcgtatatgctcgagctgagcggccaagctgcccccgtccatcaccccaattcccacatgtcgcattcgatcacttcctgctccccaccgataggaacggttctgaagtctgaacgtgaatggttaggcgccggcggcagtcaggatcaggggtagtattgtgtcaattaatcgacagaaaccaaacccagctgtgtcagatcagaagaaacatcaggatgtcgtgcacttactatagaacatgtgaatactcttaacccaaattgtgacaccaacaaccgtcagattaactggaatgaatcggatcgaaaggtattacgagtaaaccgatatttgcataaacgcactgatcttttttccccctatctgaagacgcccagcagctctattttctttccctgccgacaattatccttgcagtttcatgtactcctactactccctccgtattttaatgtatgatgacgttaactttttaacaaacggttgacatttcgtcttattcaaaaaaatttatgtaattataatttattttattgtgactttatttatcatcaaatgttctttaagcatgacataagtatttttatatttgcatacaaattttgaataagacaagtggtcaaacgttggttaaaaagtcaacggcataatacattaaaatcaaaattaaaatacagagggagtactttatacagcaaaacaatcgaccatcctttccaccatactcgtcctacaaacacagagatcactgctactccagtggctaatgctgggcaccgatcttactagcatttcgtgaggatttctgctcctgtcttggtaatcagtatcgtgtgctcgaactgcgcggctaggctgccgtccgtcgtgacggccgtccagccgtcgtcccacatgtcgcaatcaatgcttcccatggatagggccggttctggacgaaaagagtaagagccactggcagtcaggatcagaggcattgttttgggagtaaaaccgaacccggttgtgtcagattagaagaaccatcagggtgttgcgtacctattgtgaatgtctggccttcaaccatttgacctggcatattattacctgtctcagagaaaaaaagccgtcagatctaacaattcttggagttatttgtatgcaatgagaagagaagatgcattggtaacattggcatgcagaaatgcactagctcttgattggtaacaatcacttacgctggtgatatatcattggttctgaatgaaatattctcccaactccatgcccaacaaaacgatccacaacaccaaatccgtgcctctcagcatgctcgctgacatgttaaaagcaaactaatgagcaagaaccatttgagatgtatttgaaatcaatcaaagtttgacaaagttgcagtaagagttcctggttatataccgttacagttgacttagtcaattgcatatttattcattaactaaaacacaaccgatgggtaaccaataacaggctgagaatgtttggtagttgaatgcattataatacaagttcttacgaagacataataacctatggattctgaagatagaggcaatgatgattctgtttgtacttgacaaaaacacttcttcaatttttgggttcaaatacctgagagagataccatttggtgcaacttaactagtaaatacagtataaggttgaaaagttctgcaaagaaaaacagaagtctagaatagcacatatggtaaaagtccattctccattggattatggatgcaactatccttgccctgctggccatgacacaaatatggtatgagatttttataccttattcttctgccaattttcttcaagctggtaccatgtttgcaagctgatatagccctgagcatgcactcttcagtaacctgacattaccgtcattagggtccccgattcaaattagtagacagatggttttgaaggaaaagttgccatcaaaagtagatattagctctggttatatgatcaaatgcaaactgagacgtaagcaaaatctcacaaggtaaggaaaaatgaacacaaatgacttctcactttggtgaggcctactataatcatgacttctaataacatgaactacatgtttgcaaagacaaagatatataccttcacaagtcgtttactggcttcatccacttctccacataggaaagtctttgaggtgtccccatgatagccctgaaatggaaagatatattacttcagatgatgatacgaatgaaggcgtgaaaacacatcaatggtatgaagtaacaactaataaaaaagagagtagacatacattcaggtagacagtgacgtcgatattaattatgtctccatcctgcaaaacagaaaaaaagaaatgataatgacatcgtcagtggagcaaggggggtgataagcctgaacatgagggaaaaaaatgactatgtaggcttctcccagaacctgaagttcacgagaatcaggaattccatggcagatgcattcattcacagatgtgcacacgctttttggaaaccctccgtatccgagaggggatggataggctccagcatcaatgatcatcttgtgcactgctttatcaatttcgtctgttgttacagagggctgataaaaggatgcaataaatttcttactgaagctataatttatcatggaataattagcttcaagagaaacataaattgtcgaaatgctgaaatgcaagcttactttcactaaagttccagcgtattcaagaacacgagcagcaagctcacatgcagctttcatgtgaataatgctcactttgtcatgcatttgtatctcacttgctatctctgaagcatcctttttaccaacgtaaggaggttgagttatgtgacctggtactggtagaggtggactcactgtcccacggatcagtggtgctcttttcttcacttgttccaaactttgctttcctcgtgacctttgagtttttgcaagtgttagaactgtatgaagaagatcatgaaggtgcagtggcactaatatgttctaggttatcagccactgaaccacatttcttatagaaggtaaagactcgacttatataggtggattttataccttgggtttgccttctccaatccctctaatctctttgcttggacaaggaaaggcttttgaaggcagctttttccttaaaaattagaagacatcaaacataactttgtttgtcgtttcccaaaaaacaaactttgtttgagtaatagaaagaaataatgtattactgaacatacttccataatatcgttgcagatgcagatatgcaaatgctacctataagaagaatcattgattttgagttacgagatgttctttctgtcacttaactgcattattagtttgatcatattattgattatgcacactgaaccactcagtctcctatacccattccattagcactaccaattgctcatagcattgttcagagttcagactctagtaacggaaaacataactttctttatctactcctcggattattcctgattcgtagcatcgtttctgcctttcagcagtaagagagagagagagaaaaaaaaaccttctccatccttcacagcattgttccagcaacactagtgactgattaaagcccctgactaaaccaaaatctagcacttagaatatcctgatattaaacccaaagttgtcagtttgtcacctcgcacagcgagacgctcgccgcaacaacagcagcctaaaatcacacgcggctgagcgagataaagtttatagaagtttcatgaaccccccacccatccagccaaccttcggcgatgccaaaatccgacgatatcgccatcatattgggagtgatgaatcatgaatagatacctcggacaccggatacggacggcggggggcggtgcagctccatggaagggactctcaccgccatcggagcgccactttggtggccggagcagccgcgcggcgcgaggagtgagagggccagaggttgaagaggataacacgggaaggctgcagatttttttcccccttcccttttcgccttctcgtttcggagaactttaatcatttgggccgtatcatgtttcccacgcacgtgaggcccatagtgtgcgagatggaacgggcttgcgacgtacgggtggcccattgtacatgggctgcagcccatataggttggcccactatatagtttccatggagtttgccccagaatctaccgcgctggtcagtggtcagggtcgccgtcgccgacgtgaggccggccacggccagcttcacggccacgacgctgagcgtggcgcccaggggcggatccagcataggctggcgggatctcaagcctctactactaacatgaacgtgaaaactatgagagccccacgaaaattgcactgaattttttaccttatatagatgagagggggactgtaactctatataatttgctcagacacctattcctttctatatccgtgatcgtctccgacaacgattgcaggcggtcgccctcgaacatgcgttccatcgtctggcacgcctcctagctcgttctcctcctccgtcgttctcaggtcggcggcggccggcggcggcattgttagcttcgccggaacgtctcttagctctccttttaaatttcccgcgctttctgttggtagcttcggtttgcttgcgttgagttgggtgcgtagtgtgaggcgcggggcgggagggattttatacgaggcgtggggatgcgaattggtttggttgctgcgtcatgttgtgacagtttggtagttgattaacgaactgttgctaacgatgttcctataaaaagtggggaaatgaactgtggctaaagatagctattgctgtcgtaccctgattatgtattttgatttgtttgttctcccagcgagagaacttccggtggctacttaaccttgacatgctatcatagtttcattttgtactggatcatgtctttaaggggatagtgtatatgctgttagtataaataagtgtgctttaagattttaccatgtataatttaaagaccaagcattcaacgggttaaatagaataccatcgtacaagtgactttgtcctataaatacattaaaatgtgttgttcatcccgtagcactaatagggggctgttaaaggaaccctaagcaatgacatttcttaggccctctttgtttaggcttaggcttattggactagacttttaagttagcttattgacttatatgatttataagccggtggatttaatgtcctaagtttagtggttgagtcatacatctacctcacataagccaaaaaagcttctccaacctagcttttggcttaatagtgttagagtgacttatggctttaaaaaagccaaacggaaaagctacttatttgtttaggcttagacttttcgacttataagttagcttataagcctaaacaaagagggccttagtcagggccacttgtacgatgatatttcataaaagttgcacttatcaatggcattttatggaattaagcgcttgttaattatatttcttgaattttataaaatatagtatagatataagaaaaaaaactattatgatccctcgatgggatatcctgtcatgtattacatgttattcaaataatcacgaatctttttttaaaaaatataaaaaatatttaacaagacaaaataatgtatgagatatcacttcacaaattttaagacgaagttgatagcgcaaaataggattagaccaaattaggcctataaaattcattccctagtccctataacttcctactcctatcttattatatctcttggatatagttggccaaataggctgcccagcatggcactggtcgtgcctgggccatggttagtcgggctggcacagcccgaccgacacgcaaggccgtgctgtgtcagcccacgtgcttcgtccaggtcaaaatagcgtaccttggatcgggccgcgggcctcgggtctcgggcctcggcccatataaccatctatactcctggaggaaaaaaaaataacaggcacgtcagcaggatgagttgagttcgtccagaacgttcaagccgatcacaccgatcacagcgcgagctcgatccaacggcctctgtctcgacagcaaggcagcgcacacaccatcgctccacgcgtcacctccttccacctcccgccgcgacgtgtcttcggacgtgtcgccccgctcgccttcctcgcccaccgcccgcctcctcctttacaaaaacccccgcctcccacacgcacgacacgacgcttgcacttacagctgcagctagctttgcccagttttgcttagcttttctctgcttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggtgcgtaccgttcgtccgtcgtcgatcgccgtcgccggtgagtgatgggtgttgttgggttggctggctgacatcaatggccgtcgtttttgttcggggtaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgt

SEQ ID NO: 70358 - DNA, 60245 bp, Oryza sativa
  unsure (1)..(60245): unsure at all n locations
aaccttcatttaatggccagcgacttccttgtcatactgcgctgaagcctggaatggatctgaccgggactgacataccaactccaggagttagcacgccggctccggctagggacaagagccagaaagctcttatcattccgacgggacggggcgaggcgtgtgacaggccgcctgttgccacctaacccgcgatctgaccgatctgtgaccggtcacacaccgcgactggtcacggaccggataagcgtgcgctgcgccgcattgaatgcagcgtggtgcgctcgtccaacctgctataaatgcggttaggtgagccccgctgtgctcacctaacccacacatgtggcgccaaaaccgcagggggtcggggcgccccagccctcggggccgaaacgggggcgccccagccctcggggccgaaacgggagcggtccgacccctcggggagacagagggaggggtggccacgtcatcctcgggcccgacccccccgagggggtcaggccacgtgggtgaccgcggctatccaagcctctagtcacgatacccccagccccatgtcaccgacaagtactattctagagtataatattgtagtgtttaacatgtaaatatgtcaaatcatctttctcacatcattttcacaatatttcaatattcattatttatataatatttaacatatattcatctatgcgtttcgcagcaaagcacttggtatcacctagtttaaatataagaaggcctataagattttcttttaaaaactacgattatgcacgactgttttttttatgacgaacttatatcatgtgttgtgtgtgacgtacatacatatgtaatttcaggtatgactactgcttcatgcggtacaagaacgccaacttcattggacaggtggacacgagggtggacgccagcgtaagaattaggaaagaagaaaacatggacaaccctaagacgttccaaaaggtggtggcgaagacgatggacaaataccccaggcggtggcgaccgcggggagtgccgcattgggaagggtgaaggaaaaatacatgacgtttgtgaacatctacgggctgtcgcagtgcacgcgggatctagcaccgctggcatgtgcccaatgcctgtcgacggcagtgtccgacttcggcgacatctgcaacgccgcggagggatgtcagatcgaatacagcacctgttgggtgcgctacgagatttaccccttctattttccgctcaagactgacgggcgagccaccactgacatgacgaagtacaccaaggtcgttgtgcactgataattaagtttacaactagttatgtaaaggattatgttgtaacgcgtagcaatatacatataattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccgtggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtgggcggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcggtccaggcaattgtatcgtctacgttggtgtcgttcaaggctgcatcagtacattcgacctcttggattactctgctttggataatatatttgcctacctatttatcatatgtctctgttaatctagtcttagcatatcaatttagctctatcggctgcttcccgttttagggtttctgccggtatcggctaaatcgcgttgctagattagattagcttagacatctaccaccctgaaaactcagtcaacggcttgattgtctagatattatgtttctttttatacttagtgctgcatcagttaagtttgatctactaagtcgtgcttagaaccataatctctagcctgcttcttgattgccaataagggtttcatcggggtttcagtcggtgagttatctagacgttgcatcagctcataaggattgcatatacatataagttggatttagccgatgacaacaaaggcttcactgtttaatctagtcttgtggatttcatgacatcggacctccagccgatgtgtgctttgaccttcggatcgatgtttatttatcatatcattatttgctgattggtttatactggactatattattgttatattttattatcggtagccgattgcctttataccattatctacattggacgtatagccgattgcttaaaccctatcgctatcagctggtatcggcatcggctattatcggcatcggcttgtcagctgatcggctgttttgatctactatttgcatatcttgtcagttgcaggatcaaactgactggcacgcccgcatctcaacaacctttggacctgcactggagctaagcagatctcccaggctagtgtgttcgattttttcgtcaacactcgcgccccccaatgcgcggtggcgaactggcctcgagcgctccggcgtcgacctgaccatgatgcgtagcgacggctggagctcctcctcctcctccgacacgggccccctccccaaccacgtccgtcgcgagaccacccccttcttcctcttggacttgccgccggccgcgcccgtggcgacctcgcgaaggctgaggaagttggcggcaggagcagggggctcggtggccactagggcggcggggttctcgcgctcctcctcctcctcctcatcctcggtgcactcggtgtcctccgccgtgcacattccttcgtgccaccgctccctgctcgctccctccccgccgcggccgccccgcgccatcatcgctggaatcatcccgctcgtcgctgttgtgccctcaccgccacacccttgctgagcgctgccaccgccgaacctgaatccctgctactgcagcagcggaggcggcagaggcgacgcgaagactgtcggctgccgctccgtccatcgcccaccgtcgccgccgccgatccggacgccactccccacgcacgaagagaaagagggagagatagagaagggaggaggaagaagggataagagagggtggcatgtgggacccacatgtcagtgggttccacaatttttttttggtgtgaatgacaaatgggtcccgcatatatattttttattttaatgccacataagcaccacgtcaatgccacgtggaacaaagaccaggtcaacactgccacgtgtgagtcatgtcagcgaaaccgccctccaaaaccaccaaaggagtcaaattgcaccggttttgcaagttcgggggtcaagattactgatattgcggttgagggatacgatttagattcggtggtcagttgagggagttaaagtgatcttgttccagtgagagggaaatcacatgggctgctcaccgtgtgatgatctcatcaggataaggcccaggataagttactcggaatgctcgtcttgaatgcaatatattgggaggccatggaagtgaatttttgtcccttgaagggacatcttctcgttttatacatgtcgttaaaaaagttatcaaaaaaataaaaaaaattattaagatagatcaatatatgatatatcttgccgcaaacatgcgagttaaaattcgacttatacaattcgaaacaaaaataacaaatttgaccgtgaattacgcgttcaattcatagtcaaatttgttatttttttgtatttgtataagttgaatttgaattttcatgtttatgaagtgacatatcatatattgatatatcgtactaatttttttaaaactttttatgactttttaagtgacacgaggggatatcccgatttgagttttccaggaggccatgcagaatcgcagatacacatataaaaagaaggaaacaatgaaaacgcacagacatggttaaaaatgcataataaatgaatcaaacaacaacaataacaataataaataataaataaataacacaatttttcatactaggaaatctggtatacggatgaattggatatatatatatatatatatatatatatatatatatatatgtatgtataggatcaggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgctatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtcaccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaagggaggtggtttatattagctggccaattaactttgctgtgcattattggacgacgtctgtgctcaccttccggcaaactctaaacatactgctaatataagtgaagtttcgaagtcatcatgttatgttcggaaaaggcaaccggttgttgagttgatcataataatttgggccctgatttttagctgattctcaactgaccaaaggccatccagaagcatcggcagggcagacattagtatttcgcattccgaatgcaagaggataaagaaaacactacttcatttggtgccggttgagaaacctccatatatagatgtcagatatcccaacaggcgccatggaggtagtattgatgaggatgacttaaaggtgggtgctggtttaagaaccgatacctttgagttatatggtttgcaaataaaaaaaagccagctcggctcaattcgagccgaaccgatgcttcaaagcaaaaaaaaaaataaatcaaaaaatctaacaaaaaaaatacaagacacataaaagaatcaacatttcatagatcacataatcaaatattcacatcagagaatcaacaagtttgtggaggaagataacaaaatcaaatattcacatcaaagaatcaacaaatttgcggcggaggagccccagcggtccgccgtggcaacgtcacggggtagcaggagcgccttgaggagcagtggcgacgagcgaggcgaggacggcgacggccccgtatggccggtcctggggttttggggccctaggacaaaaacttatatagaggcccctatatatatatatataaacataactaatatatgtatatttatatagtcttataaacacacaacattcgatgtgataaaattatctatatataacattttaaaaaaagaaataaatagcagtaccgagctgagaagacgaccggcgaacgatcgacacgagcgtggctactggtgaaccgtgattctccgacttgctgtttccgtttgtgagacaccgagaagtcgagaagtcaccgagagcgcaggagcaacgagcggcgtgatgtgatcaaggcgacatggcgagtggcgtgatgtgatcgaggcgaagcgactggagtcagatgaagagatcgaggcgaagcgactggagtcagatgaagatcgcttcggctttgctaaaataggcctgacgatggactaaaatttattttctgtattggactattcagttgtctagcttaatatagacctatgacccatggactagaattatccaatacgtagtatatatactatatgtgtataggggccccctagattttgggggccttgggcggccgcacggcctgagccccctccccccaagggccggccctgtggccccgtgacgcaagaggcatggttgacggtgacgggcgccggcactcctcctgctccctcacacgacaaggacgacggcaccgcgttggctcggccacatcggcattgtgctttcccttgtgagggcgctgcagcgtcagcgtgcagcgaggggggcgaggatggcaacggcgccgtggcgcaggaggtgtggttgacggtgacgggcgccggcactctcccactcccccacccaatgaggacaacatcgccgtggggtgcccctacgtcggctcaaccccgtcggcaccacgcttccccttgcggctccgttggccctggaggcagaagggaggaggcggcatggtgaattacgactagtgatttagggaggagaagagacgagaagggaggagaggtgagggaggtggtggcttgggaaagaggaaggaaagggagaggagcacgggctggacgagaaaggaaaagaaggaagaaaagagaataagaagaaagcgaagagactgaagagacaaggacaggaggacgggagataggtatctgttgtattaaaaaccagcacttttaccttgtataaaggtgtcgttttttaatagaaattgacacctttctttgacagaaaagataggtgccggtaccatttaaaaaccgacacctatttataaaaaaggtgtcgatttttgccattggcacccttgcgagtgtgcgtgcgtgtggaaaaaacattataaatgtcggtttagctattccaaccctatagtgccgtctcctttatggctttcttagtcgtcaaatgacatatgaacattatatatacataactgttaaccttaaatgaagaacacattaaggtggatttatgtcgtatcctctaccattttaatccatgttatgatttatattacccttcttcttcgatccagctccaacgagatgacgatgtctccgacgagatggcgacggtctgatcagtttgagtttgtggttagggttaggatgagagggattgcgaaagaggaaagaatattgttggccttaattagagggatgtcaatcagagatggtggcgtggtagtgggagaggcgcgcgataccaaagccatgggagatggatgccaacgatgggctaggtaggcaacgggatgagggatgtcgttcggtgcggataccaatcttcaaaggaacaaattattcattgatgtcactcgaattacaaaacttctagttatgtacctaatacagaagaacattcagtttaattggtatttaccgggtatttttgcttaagccgaatttgagttcacagctgagcgtggtgttgcgccacgcattctcttctagtgtgctctatgcctctagttaacatataagcttataagtttcaccgcgttagctagtactaggcttttgtttgtcaagcttgtattagagagacatactcatggtgtatgtaataatgtgtgacaacgaaacgggcatatgtagacaaaggctttgcccaatgaaattattggtaaggagctttaaatcactagagaagtatggttcaattttcagtagcatcggaaaaaaaatccaaaaaggaactcccatcatacagcacatcggctttgcaagaaagccaatggacgaaacaaattaaagtctgacaattaacatctccgattgaaagatatattgcaaattctttgctggataatactccatataagaatgttttctaagggtcagcgttatacgggtattcccaaattacgcttctgttcaatgtatcatattttttttctagctatagtatacattatccttgtactacgagagatggctctttgtgcttccctacaagaaaccagtgatcaagtagcttatgattatgctccaatgatgcccccttgcatgtacatacgcgtgcgaacttgacaatgtctacgtaaacaaacagctgcagagttatataatacctagattctcattgctaggataaggatgtgggtgggtgatcatctcgttgcaacgaaaatatagtttagttagtataagagctcaaagaggcagcatctgtagaacaagctaggtgtgccgcctttgcatcatgatcccacgtgcatccaatagcagcaaaaccgtaataaacggcactggagtgacccgcacgtatcttcttccagcgcaagccgtttaagcgaggagacagggggcattaggccggcctaaccatcatgaacactccatcatattattgaagagatcaattagagacactcttagcacaagcctaacttgtgtactagtttctgtttactctgttttgcagatcttgcttttcttctctaaagtctggagggaaactattgtaaactctcgagaagatgatatctcgttatttatatgtcacttaaatagttctaaaataattttaaaaaataagatagatagattaatatgtggtatgtcactccacaaacatttaaatatatgtcaactagctataatttaatttgttttctacagctcgtaaagttgaattttaggttgtacgtttgttaagggatatatcacatgttaatacatcttattattattatttttatttttttcataattatatttttataacatgtaaacaataagaaaatattttctcgagagtttaaaaaccactctcgaaatctaaagtacgtaatctcggaagttctgtaacgttttttttccctattcatgcgactactctgagctcacgagagtacgaagctgaggccattggatgcggtaggaagctatctttaatagggttaactgaatccatgtcattcaaaattaccatataagaaaaatattaatactatttgtgattagttacatgtcacggaattttttgaaattaaaaccgcatcatcgctgtcacattttatgtcattatatagaccaaaatgcttctgtatgtgggacctacatgtcagttttatcttcttcctccacccttccctcttatctctttccagttatccctcggtggtcaaagaatgtggcggtgggtgggccatgggtgtgtggcacgggtggctagagagcgaggcaatggtgaccttgttggcgagggaagtagaggtcgtcgaaatttgctctatggatggagccgtcgtgcgagctccccgagggcaagtaggaactttgagatgtcgatggtgttgcacatggaagtagccggacgagcgacacgcaattgacgctaatctcccctctcttttctcactcaggaggagatgcatgagctactcatccttactgtcaggaggtcgccagtagaggtgatgggcggcgtgagcatatccaatgataaagaagggggtggaggggatgggcgatggctgcaggtggtcggcgcctgaaagagcatagatgtaacctagagggggggtatgctttcctgaaaaatacacaaaataatcgtagcagtcaaattaaatagggcccggaacctcctggtaaagaacacatgaacttacgggtagttatatactgcccggaacttctggtgttcttggcttaggaattttcgggtacaccgaaacttagaaaaacgacttgaagattaaattattttctaatcatattcaatcacagggatgcatagaggaataaaagaagagaaaaacacaggcacaaacacagatcaagcacaggagagacaagaccgactttttcccaaagtccggatctcaccgatcctactctccgttgaggaactccgaagagctgggtctcgattaaccccttgcctcacttatgcaaagatcccagaagaagtctacagccttcaaaccaacacccctaggtcattctctagaattgagtgacaaccaagatccatcttaaactccttctagagaagaccacaagtgaggcttgctctactaggacaacctctaatctcagcacaatttccttaatcacttacctcttttacttgcagaggtgtggaataaattcacaaactttcctaggacatccacaattgcaaaggaaggtcgcgggtgacacctaaccgcctaggagaggatctccaagagtaataaggccaaagtgacagcccacgaggtacccaaagtgctcacaccttcctaaccttcaatccttctccaaatcactccaacaccctcatcaacgctctcaatctcactataatggctcaagatttgggtggaggaagcaaaaggatcttgggagaggctagaaacagctaggaggtgaaagaacaaaagtgaaatggccaaagagtgagcgggagatgaaatccatatatatataacgggtaggtgacgccatctagccgttactcacatttttgaactggaatactacctggaagttccagactggggtgccaggaacatccggccaacacttaggaaaaatctcaatttcacctagtggcccagaagttccggacaagagtgccaaaacttccgggtgggactctctgtcctgggaggggctattttcaaaaataactcccaaaaatagttcaatgagttgaagagcctaagagcacttagggaacctcagagcatcacttgaaacccctcttaatagtacagtttttttcctaaactcgaagcgaaaaataaaactagcctaaaccggctccggttcttctcaccacattgaatctgaagaactggtggggggggtctccaagcgtcctagccacctcgtaagcaacctgggactaatctcttgtacttaagctcaataaaatgcattagttcatttaaccatttagtcattaatcaccaaaacccactagggggttagatgcactttcaacgtcggcatcggagtcagagaagccagggaggttgatgcagcgcgggctacaggagaggatgcagatctaacaacgatgacgaaaaacgtgacgacgatggtatggttctatttcacaaaattccaatggcacgtaggagatatcacgaatagtaatagcatttttataatatagtaattttgcaatggcatgatccaattaaccccttttaataaggattcttttattaataagatgtttatgagtcttaaaaaaagtccgaggctgagccacacgtgtttctatagagagcatatgattgatgaggcattaaaaaggttttttttttgttatgcttcgaacggtatataacctacttaagggattcctttaagaaaggatgtagccagaagtagaaatagaattggaaattcacctttgtatccgctcttgagtttttcgttagtctttgagaggtgcataccattactactaggaggtatatatctattgattagaactacaaagtatatattcctttttacactacaaaaggtgttttgcagagggcttccacggcgaggttgtgtggtggcgtgttgggacgaagtcgaagctgcttgtcggaagtggcaaaatcagcaatgataacccttttctgctttgtctcggcaccgttatggacttgtggcggctttagtgtagttgaaaaagagggggaactggctgaaagccgcacatgtttttttactagtgccaatgacgctgtgacacccataggcgtcatcctccttcttgaaggtgtatttatttgctctcttccttctccttgccccgccgatagttcacactctaagtctagtgggagtgcactcgtcgatagctgcctgatcaccttagaagaggattcggcttcctgatccttctcattacctggaatctctggttagagaggaccgctcgcgtttttgatggggtcctctcccaagtggatacggttattgatcacgtcgtgcaggaggggaggctctgggtgaaagcgaagctgagtccttctggagttcttcttggcatatatagtcatttagttttttcttttcttttccatgcgattttgcttgttcagggtttggttctatctagcttagctagctgttgatctccttttctccccgtgtaaaccttccatacccgttacagtagattatagttgtacaaaagaattttctcgtaatattaacatgtaaggttcttgcgtgttcgaaaaaacaacgaatcagtcagcgagatatcccagcagcatttcttcgtaatcatgcatatcaaaaggtactgaagtagcctcgttgcggttaaccaccatatataaattcacgtgcttcctgattagttcagtttggggaacgatccatatctcacccaaaatagatctcagcataatccaacgttctgtgaaagaacatatagccgactggttacagtggcctgagtaacactctaagatcagtcatgagttcaaatctgtctaagctaagatcccaatttcaaaggctgcatacatagcctcatgtgtacagggtcccttcctgatatactcccgtatcagcgtatctcaaaaccgcagaaaatatgaactcctaccgtatattaatttaacaaacgaggtctttatacttgacaccagcaaacaagctagttagccagtactaatgatactactaacaaatagcctgaaacaaagccctgacttgggaaaatctgacaataatagcccgaaagaactcgtcgatgtgtatagtttcttttttcaaattgtccatgtttacactataccccgcctgaaatttacaaaggatctggcgagaaaaagggcttccgtgtccagtggatcaatagtaagaagtagtactcccgagtacagaaacccctataggtgccggttgggaactggctataggtgccggtttctaagccggaacctattggtcggcacctttatctcaatcttattggtgccggttataaaaccgacacctatactatcaaaaaaattaaaaaaacgatggcacctacactgccggccttctccaccgccgccaccaccacctcgcccggcctccacgccgtgccaaccttcgcgccggcctccacgacgtcaccgccacgaggagaggaagccgagaggggtgagtctccacctagccatgcccgcctccgcgccgccacccaacgtcgcgctggaggatgatgaggacatcctccactattacccgctggcaaagatgcaaaattcgggcggcgaccgtgtgagcctctgaataatcccaccttgcttagcttgggaggaggaagccaccttaaaagggagagccacccttcccctaccggactagtcttttagggagattgggcctttccccgagtgggtgtgcctatgaactggagattgggcctttccccgagtgggtgtgcctatgaactgttggggtccgggcaaccttaagttattgggcctcggccaacctcacctgggacggattgttatcaaggggggaggtcccctgggagagaggccgccaccttgccggggccggattgttatcaaggggggaggtcccctaggagagaggccgccacctcgccggggccggattgttatcaaggggggaggtcccctgggagaaaggccgccacctcgccgcggcggccgccaccccacgccatgctagaggagaagaagggaagggaggcgaggtcccccgggagagaggatgctggcgagatccaggcctactccaccaccactgccgtcgccgccacctcgccgcgccagccttcgcgctatcgccaccgcgaggagaggcagccgagaggggtgagcctcctccagctgtcagccgccacgccggccaaccttctccaccaccgcaccgtctcttcgcccgcgtcggtcggccttctccactgtcgagccaccctggaggaggagagaacgggggagggcccccaggccgagagaggaccgccgcgccattcttctccgtcggccgccgccactactctgtcaccgtcgctgcgcaatgggagaggaggggcgagcgagcgagagagagggagggaggtcagaggtggatggatggattaagatgaggctggcactgtgggtggtcaagaagagccggctcggtttttttaaatataggtgccggtttttaaatagaaccgacacctatatttatattataggtgtcggttctaaacaaaaaaccgacacctacagtgtaggtgccggtttttttaataaaaccgacacctataatgtttaaaggtgccaattttaacttttttttatcgtgcggaggtgggaaaatgctcataggtgtcggtttatttaaaacctacattatttatctataaatctataaggtcggtccctatgagggcttttgtagtagtgttactccttgaaggagtttaataatataacgattaactactagctccaaaaattgaaatattatttatagataatctaatagtccactcatacaataagagcaagtacaataagatgccataagcatattgtataagttgccacatcacatttgtatttatgtggataggtaaggaaatgagagagaaacaaagcggactatagatttatagccagcttcagcgtgagttccaataaactatgtgagagagatgggtgaatgatatattaatgatgcagtatatatctccaactaacgattatatgagtgtactattatgttggctatatatgatatttagatttttgaagccagtagttaactatattattgattttgctctaattagttgtagatatatatattgtatcactaatatctaatccatctatctctctcacatagtcagtgtttggctaataggatagggaaataatttcccaccaaccaaaagacatacttaaatcataaccattcattctccctcttccatttaattctaacccttcattcattttccaatcccaatcccactccctatttcctattatccaaacacacccatagtttattggagcttgtgctgcaattggctaaaatttgtagcccactttttctctctccttcacataagtaaaaatatgatgtgacaacttgtacctccacctacatcaggcctatcttactcgcagtaacactcctaatacaaagaacatgaaataatttaatcactttctcggttggatcacctcaataatgcgaacaatgtgattgagggttttgatggtataggatttaaaacaaattaattttacaagatcagagctgttagttaagtatgtatgcatacacgtcttatatattataaaacatgagaaaaaagtggttgtgttttatattataggataatagaagtactacatagtaataagtttcatccggcagaaattcgtgccgagaacatgcaaaacaaaactgggccagagaaatgcacacatatctgtagaagcccagcgcgcagcctgagctgagccggccggccttttcaccttttctcgtgcatgtttcctgtattttcaatcaaaatcatctagtaatgctctctagctatgctgtcgtttcttccctccgggaaatcctcctctgcatgtgcgagcgactgcgtcgacaggatccaggcaggcgcatgcgtgtatgtctccatccatcgggtgccctgtcaaccaaactagtactactactcgtattcctagtgcaatctctttcgtaaaaaaaacaatagtattaaatatgacataacttaatactattataaatttaaatatatctctgtctaaaattatattactcagatatatcatgtttaaagctagattgattttttaatgtaagggagagagtactgcactgcagtgtgcgtgttttgcccattcaagcgcacctacgttagtgtacgtgtggccgctttatctgcccactgccgagctatctatcaatcgcgtcgactacagcggaagccgtcaatccaccggcgatcggtgtcgcgtatgcgcaagcgcaatgcatggatgagtgacttcaactattgctctccggccagttctctcgtgtatatatacgtggaatcaccaactcccaaatcttctcccgttgtcggggcgataatctcttcttgtttctttattttgcgattgcgattagccgcgggttggccagatgtctggtgatcgaggaaattactccctccatctcttaatatagcaacctaatattgaatgggacagctaggttactatgttatggaacgggggagtattattctccgtggctcctaaccatccatccatcgtagtagtacgttttatcgatcaacggtcatcggtcgacggatcgacttgacgagggtgtgtgatcagtgtgttcccttgttgatgtcatgttgtcattctaagttgaacatttgtcgcttactttgagatttttgagattcatgtatatatgtcataaatcacattattgtactttcttttcttttcagtacaggacgaatcttaacaaaagcattcaatggttcagcatgttgcacatgaacttggatcgtgaaaacaatctttccgtttcgattttactgtactgtccgtggataacgtcttacctggagtgtttagctcatgttatgccgttcacaatttctatttgggcttaggcccaaaactctaacagtaaccacattccccgctgtcccgtgacagttgctccaaatgtacactcgaatatgattcgacgatctttttccctgctcaaatcagcggctgagagcgctgagagcacagagagcacggtttgttatcattacttttatctctttcaataaatcagagacagatattagaacggtgaaagctaaaactatcaaaagcatacaagtcaattgcaagcccgccccgcgagacctgccatgtgcatgtgacatgcacgagggcaaagtgaaaaaaatgcggcattgcgtttggagatatgtcccttccgcacgggggaatccacgagcgctgcagcaggctgcatccgtacgctctgggggccagaggcgggggctggctggctggcttgctggcttgcttgctccaacaaagctgcaagctgctcccggtgtccggctggatcgtagggccctgccgtgccggagagcgagcacgcgcatgtgccgacgccgtgcaaagtccccccctgcgcgcgcgcaaccgatcgactcatggcacgcaggcagcagcagtaccagcgacgcgcgcgcttattattggtggtccacgctacttgctgtggctccgctcaacagccagagccagcggtagcgaagccgatcgatcgcgcgcgcgctcgctctctcgctcgctccaccgcgttgtttgtgtcgcattggttggccctctctggtctttagctaagctaccgtaacggctggccggacaggccacatgcatgcgcgctgccacacagcagagacagagcttatcttagggtgtgtttagttctaaagttttttttcaaacttctaactttccatcacatcaaatctttcatacacacaactttttagtcacatcgtctccaatttcaatcaaattctaaactttggttagaactaaatacagccttagctctaagctccgcgccgcgacgcgatcgatcataccaccacggtccacgaccaccacgaggcaaagcaaagcagctgcggccctagctcccgtacgcgtcgcatgcgggacatgctgagataaaactcgtaagtgcacagataaactagtagtgcgtggtgtatcgtacgtacggcccggccgtccggtcggcagtcaggccactttgcaggtcggcccgcccccggccgggctggatggctcagcgtgcatgtgagcgatgtaaaacgaaccgagaaagcttgcgatcgatcgaggggactccatgtcacaccacgtaaagtacatcatcccggcttcttccctgctaagctagctagtagtagctcgcggcttttgcgacccaattcgctttgccattttggtgcgccggggtggtgtggtagtgtacaggtgtgcgtgcattgccgcgctcgacgagccgtgtactccgtatgtgtgtgtcccgggcatcgtgtcgtgtccccccatccccatgtgcaactccggtctactccctctctcctctcgtcaggctcaggccagcctgccgtataaatgaaggcgtcgacgcgtcgacgtgacagtgtgcggcttactgaagtactcttcatactctctcgtctctacgtgtacgtacgagtcagagttatgcactccaattatttctcaatcatgcatgactggtgaggatgtgagtgtgttgaatgtgcgtgcatgcatgcatgacacacgtttgatggagtgatggctgtcatttctcgagtgatctcggaaccaccgcggcgtgcagccggccagtgcatgcatatcagcatatccattggacggtgacgcatttcttgtgggctgttcgtgtcccccgcaagaagatttttttaaaaaaaatacttactcctgatcaaaagagcacatgcatacgctgaaatgcatatgctagtaactctcagcatctgccagaagtggctttgacccctgaatatgaatatatgatcgtgatgatcgcgctcgtggccagccggccggccggtcagtccaaaccctgcatgcgccggcaaggttgcatggcgactctgccccattttgcgagtcttgtcggtacaggcagccacatgtacacgcatgctttcagggtcaggttatacagcagccctccctttctcttggagccgtcgtggccggagcccctccaatcgcttgctcgtgcatttttcaattgcgtgccccctgcgcatgtgttaaagacattctttccacccaatttggccttttcaatccgatcgtgcctttctggctgccatatattttagctcccaaccacatttacggtatgacgaaaaaaatgatcgatgtgacacacccaattattggacgcggtaccagcacaaaaatcttgcgtaactttatatatatggatcgagacatttggatgtgtgatggtcacatacaaaagttcagtaagaaactagtaagaatatttaatttccctgttggatccccgcaaaaaaaaaaattccctgttggaacattcatgcaatcaacttaattagcacccaaacagtcaaattttgtgacacaaaattctttatttgaacttgcgtttgtgaaaaattatttgtactccctccatttcaaatcacttgttttattctagttttgtcgtaaaataaaacatttctatctttaatattaatttataaaaagttcgtaaagtttatcaacatgtgagtatatatatgtcatggaagtattaatactaaggataaatcatgataaatcaaaaatctgaatcttataatataaaacagtatcaatttacttaggatatacataccaggatatataatcgaaaatgcatttagtcggtatcccgttccaagagattggcacgggatcctctccctccctcacgcgactacagcaataaaaaaaatgcagatgcggctggattttgctggggctattgtagcacagaggcatatggattttgcggaaaggttgtggcgtggcgttggccattcagtgctttagtgcggcgtcgcttcttcgcatatgggggtcggaacgggtgcatgcaaggctaggtcgagttaatggcggtgatgacggagccgccgagagatgggggcaactcgcctcctagccacatggtgcaaagaagggaggagtcgggtatctcttggtctagaagaacttgaacagaaagaagattggaaggaggaaggaaaaatgaaaagagaaaggaaggggaaatggtaaagggattgatagagctatcaaaattttgttttaaccattgcacaggagtgaagcggctgcaacggctgcttcaccgggtcaccatggccacacacagaggagagggatgaggaggtctaggtcttgaggagtggccgaagaaggatggaaaacaccgccaccatcacgtcaagggaggatgggaaacactaccaccgttgtgccggtaaccatctccatcccttcctctctcccctctccgcttagatttgataccagataggtacaggatttgtatcggcaagtacatgtgtgataccaatgaggtttaagttggtacctgacaaggtatcggttggtatatggcagatattggccagtaccgacgaggtatcagttggtaagtaacgggtatcggtcggtaccgatgagggccagtacctaccagaaatgataccgataggaatcaggatatgataccttctcggtatcatctccttgagacgggttctcgtatagccgtctcctatataacactagaatgacaagtaatttaaaagaagactaaccatcactattaaaaaaacatatattttgtaaacatgcaaaatagatttttccagacggccatccaccccgcctgcacataaaggcctgtgaaaatgcacgatttttgtaggcgcctcttcatttttgcaggcggtacaaccacccgcctgcgaaaatatactctatgaaaaaaacccccgccaccacccctacccgccatcgtcgcctgctgtggcccacgccctccgctggatctaggtgggagagggaagggagggaagccggatctgggagggtgggaggaagctaggggatgggagcgccgccaccgtcgctccctctacgccgccgccgccgccctccccctccaaccgaatctgagaggtcggggaggggagaggagtgccgccgaccggatatgagagggagggagggaactaggggaggggagtgcttccactgacgctcccgtctccgccacactgcatgtggtggccaccatatctccttccacaccgccccctccaccgcttgcggtggtcgctcccctggcctcttcctatcggatccatgagcgaggagggagagaggggagtagagcaccgccaccattgttccctccatgcgtgttgcctccgctgttgcatgcagtggccgtcactccacctcctccaggcagatctaggagtggggaaggagggagaggaggggagtatcgcctccacaccaccgccctcccctcctccggtcggatctaggagggccacacagcctgctgagaggggtggagggtgaggtgagggagatgggatgagcgatgggaggggagaggacttggtgaaaattaggctaggtagctaggtgatgatttttatgaggtatgaccttttcacaggcagacatattaagacctcgcctgtgaaaatcgattttcacaagtgggactaggtttatggtatctttaggtatttttatgaacattgattttatggtcgcttggaaaaataaatcgtaatgtttggaaaaatcgtttttctattagtgcatgatgcgttagctcatctcaattttaatgcacaataattattttatttaagtacctagctaaatggcagctactaattaacattcatatatacctaccggcttggtggactacgtgagaatgctattctagttttttctggcatttgtcgtaatggaaaatgtctaatatatgatcatcggattgagcagtcgcctaattgcgaaaagcgcgtgacttctccatcaatagcatgcagcctgcctactgtcatgattgatgaatatttgttcctcttcttgctcatcattattgtgtcgtttgcgtatttagaaacaacaattgttgcagtaaaatacaaatgtattggtgctgtgtggattgggaactggcagatctagtgatgcaagcaactaattagagacggaaaggtagagggaggacgagagaaacacatacctctacggctttacatcatgtcattgcgagaaaatatataaaccatgcttggtatggtcagttggagatctatccaacggctaacgcaatccacaactaagtaaccagtaacagagctctgctacggttactctagctagctaaggttgtattctttgtcctgggttcccaaccactctccctctttttcacgcacgcacttttcaaactgataaacgatacgttttttaaaaaaaaaaattctatacgaaaattacttaaaaaactcaaattaatctattttttttaaaaaaatctaatacttaattaatcacgcgctaatagactaatctgttttccgtgcggagaagatgggttcccaaccccattagcgaacacagacttagaggatccattttcccttatgctgatcaatgactatttttatttaccaatatattgattttttttcacattgcatttttttctttttttttctttcttatcgttagtccataaagaaacgcaatattcggaagaacgtgcaaaaatctttcttgtttgtattacaaactaactatggtagcccggcatgcaacgtgttatagctagctattgggagaagcgaccttgcgaccatctaattccaacagtacgtaggagaattgcttcaaaacatttgcatgtcttcatgtgccgacaaaacaaaaccagaccaactgagccagagaaaacacaaaaaggttccactaagaatagcgattggtaaattaacccaagcacatactgattgacagaatctaacacggcaacaacgacgtttgtctttttctttctcccctttattcctggtagacaataatcgcaaagaggaaattttaactgctcggccatgaatattcatacccggccataccctacgcgaagtggcggcatgcgcccctccgctccggcccatacacggttacgtaggaccagccaaattaatcgatccgcctttgtaaccgacccaaccgtagcagccatcccacatggctcgtcgtcactcctcactgccactggagctctttttcggcaagttggcgccaccacaacttgacgcacttggcatctgtttgccctcgtctctcggatcggacccacaatcacagtcggagttccatgtcccttcgctctcaaactagacgagctctctacagcatcgacgaccgaaaaagaaacagctataccgcacagcaccggccttaattcgacgtcgaagcttagtactactagtacgttgtgtcgttaggctagccaacccggcgagtacagatgccgtcgccgatcgcacgcgggcacaatgattaccggctacgatccgtacgcgtcacgtcgtttccccgggcctcgctctgtcgcgaattcacggggcatgaagaaggtagcgcaaggaagagagctggaggatgtagtaaaaccgatcgacctgcgcgacgtacgcccggccgtgtccatgtgtggtcgctctcgccggcgaacaccaatgattgcgcctgtacccgctttcatgcgcgtgcctgcctgccccggccggcccccttgcggcgggtcgccaacatccaacgtgcgtgcgaaagcaacacgcgccgtggcttcgcaacagctcagttaattaggaatcatcaaggatgcacgcgacgcgcaacagaaattaactacgtctcagagatcggcggacggacacgggtggggcacagggcacgtacatgcatacacataccaaaactatatgaccgacagcttacatacgcatggccgacgcatctggctttgcgactgaggtatggaccgtctcgactgtacgtacgtacgtatagtacttattatggtcttatgggcgagcacctgcaaccgcatttgatgaatgcgagagacatataaatccgaacacagattgcgtggctgaatctggtctggacaaagcccgagacgacaacagaggaagggattaggcgaagaccataattccaccccaattaataccaccacgccctgaacaacctgctccaggtcaccggcgacgagccggtgagattccagtacggccgcgcgcctgatctgcccgttcgtttcagcgcccagagatcaggagaggagatctcggcgcccgatcccagtgacgccaacgagaggagatcaggtgaggcggccacgtcactcgcaaaagctgccagagcaccggacgttttatagctggcccatcggtgggcccggcaaaaaattatacacccacgtgctgggctgcttcacggtttccgtttcctgttccgtttaggaagagaaaaaagaaaaacacagagagaaacagctaatagggggatggcgaccccacctgcagcgacggagaaagcggacgaaagtaaaagcggcgcgatgccacgccaccacacgtccacacccatgccatgccacacatcgccactccgacccgacgaaaaaagggcgggaacgtagaactggacgggaccccacgttttttatgggcatcccacatggcacgttgcgtcgtggactcatgcgtcgggggcccaaccgtcactcggaagaaaacaatccaggggccccggttaccgctgcccctggccgttgcagattatgtgagaatcacggctgccctgactcaggatcagcccctaattaggagctcctagcttctgtcgttgggtaagttcagttttttagataaagtacgagttgatcttgagctcattttcctttttgagatagagatatcgaggttaggtttaggtacaattggacgtttactcaaaaaggttttatccaaaaccctatttaaaagacgacatgcattttgtgatggaagggtatatctcagttaatcagctaaacaaaacagtgggcaaagcaaaaaaaaattaaaaaaggagaaattgccaagttcaatatagcactaccctcactgtcgggctgaaaactgctcggtggttggatgacgccgcatgcaggtatagtagtaacaatttgcagcgataggcggtacccaacgtagaggtcaggatatgattcaggtcaggaaacaggtaaacggatggcacgacacggcagggaccggagcatctcgcagatcgccgggtcgcttcatacaggagacgagaaggacagagaggcgcacaggggcgcgcgcccatgatacaaaatacaaatcgcgcatactaccactgtacaccatcagtacatacatacatacggtttgtcacgtagcccgggcaggcacggcacagcctagcattgcagcggcacaccgcacacacaaccccccacacctgaatgcggatggcgacggggccagccagccaatcatgcccgccacatcaccaccgtccatccatccccctgcccaaccccgtacggaccacgtggacgcctccccccgtcggcccggaggaggagccctggcttacaggtgggccctgcccttcattatgagacagctaggcattagcctatggcgtccgaccgaccgaaccaccaccggtggcctcgcccgcccgcacgcctgccgcgctcgcgcgacggagcaccagcgctgctcccggccagtgtcgcgtagcgcgggggcagcgccgtactttcccctacccacgctgccccgatgataaattacaacgacggtgaagaaaaagaaaaggcacggccgtgccctcatccgcaccgtgcagatgagagacgagggatgttttttttaaaaaaaaaaaatttaccgcgtgcgaaggacggccgcgtccggctggccggagccggacccacggttcgtggctgcaccgtggggcccgcgggtttttaacccggcgcgccgttcagatcagatcggccacgtgccactgaatccatcgccacatttcccgttccatgttactcctgcctcagctcgagatgaagcaaactgcaaacacgagaggcctacttccttgcgttggcatttcgtaaagttagcagtagtagtatactccactaatttagtaccgttaattgtagtttgagagagactactacaggcttgggatccacatttgggatactccgttcccttttaccgagatgtagcagagaattcattgctttatcgtcctttctccatgcgaccatgcctctgtccttcacgagagcagtaagtatgattaggagatgatggcatataacttgaaccacactgaagacagtattagatacagtaacaagatggttaattaggcctttcgtcgacaggaggaggaaagacattcatccccacgcactgggcgcacgagagaaaacacagtggtagagaagtgatgtgaaccattcatggtgcatttatcagagatggaagaagaacaaacgaggcatcctacaaaagaatcctgaggagaaagaagagaacaaaacaaatgtggcctactgcattacagcgcgggttaatcaccgcaatgccatcaccaccaccgccataaccgctcacccagctcatggaaaagaagaggacaaactagagagcagacagctcgaggctaactaatcccaaggaaaaaatgaaagaaagaaaaaacaaatttacaacgaatgcacgaatcttgaggcttgggggtcacgccggcgaagaggagccgccggaggaggaggctgagcctgagccggagacggtggaaaggacctcggcgagcgcggtcatggcgcgcacctgcatctccagcgcggcgatgtagtcggaggcctcggcgaggagagccgggaatgggagcttgcggcagccgggcaccagccgcccgagcaccttcgccttcctcgccagagctggggccttcggccctttaccggacgacgaggatgggtggcgcgacggcggggagatggcctcgcggaggcgcgcgcggcgcgcggcctggatgcggcggcggtgggacgcgaggatggcgcggctccagcgcgtccgcccgcgcgccgagacggcgagcgcgcggtcggccgcctcgcgcacggcccggctgcgcggcggggccgccgccgaggaggagggcgacccggaacgcacgaggcggatggcgtcgaggagcttcgacgagtagatctcgtgcgcccgccgcgtccgccacttggaaggctgcgcctcggacccctccgactcccccgtcgcgccacgcttcctcttccgctcactattccccctctcctccaccgccgccgccgagcccgaggtggacgccattgcctcgcgcagcaaagaattcttgccacaaacccaacttacagcacagagaccaccaaaaaacagcaggatcaggatatctgtgacctctcaagattccctcctcctcatggagcatacacctggttgctgtgcagaggaggagaggggtggtgagatggatggaaggaatgggggaggaggggagttgggaggttggggaatataaagggggtggtggcatgtgcaaatgccaacactgatggtgctcccattagtcctgtgatccttttggattttccgagtttttttctcttctctgtgctgctgctgtgtgtgttagttaaataagtgtaattttgctcgtcccatttcttgtaattttttttatatccctatggtctatccattttgcatgtgtgacactgggagtaaccagctaattatgaggtccaccaggtttggactttttcagatcggtgtccaccggttggttcagggtggcaagagggtgcgagtgtgtaaagagagcggacaatatctgtttgttcaatcgaccgaaagcttgaacaaccgaaatcttagtatgaagcaaacaaggaagatgtacatgtatttttaggcgtgatctgttctaattacgaatccaacggaatgaatgtggaatatcaaatgctttctctattggccttgcatatatgcaaattttataattaggtactaagaacaaaaataatttaatctcatcaacaatttcaaaaatcaatataattagtacttttaaaaaagaaagttaccgaaaaaagcgttaagagtggattttaaaaagatcataattaggtactcggctttggagtcaactttttcccccaattcaataatttataaatttaaaatgaataaataaatgggatttaactcttaattaaaaagcataattataaagttgtgactgtgctcattttcgatttagttaattaacctgttatgattcaggtgtgtcctcatttgctccaatattatgcactatcgagcgaggtttgaatacaattggtcccatcttttcgcttatgtttatgcttatcaaccaaaatttaaattttcaacattaaatttgaagctgattttgaggtttttcatcgaagtttatttttcaacctttgcttttaggtcactaagaacacgtaaataaaagttttattcacaattatttatcgtttgcaaatatgacgtttagcttattcctggggcggaacatgtttatcatgaagatctgaaaattaccatattaatcgaattagaaaaagaaagaagatgcacacttaggccaacttgagctattcggtagcttgagctgcggttggggtgtagcccaacgccaacggtgtcgcaagcatcatataaacgttgggttgtgcagccgtaaccttctgaacacccccttatatcgtgatggtccatattatgacatctagtgattttttatgcaaattttttgcaaagctatataaaagtaaaattgaatttgatatacaactcttagcttctattttaataaatacaagtatattttttataatgtattttgaaaaaaaaacataattggatatcatatacaattgttagcttttgttttcatatatacagtgtggtttgtatacaatgaaaaacactcagggatcttccggctagcttcaaaagatggtgggctagtcgacttgggttcaaagccctactctttttaattatttgatattatgtcattccctaatattcatatttttagtttgtatacaatagttttgaaagtagagttcgattagatatgcaattatgatttttttatatatatatacaagtattttgtgtacaacttatgatttacgtacgaaacaatctacacatcatctgaacccatcatgatctaacggcacaaatatttaattaatgtgaaattttgtatgtctctagaacgaatatggtagctccttttagatctatattgacaatatatatagatagatagataggtatatatttatttatttgtatacgaagtataattttacatagaaaaaaagggaaagataagtactgtatatcaaatcaagttgcactttcaaatatattacatatataacacaattctatagggataaaagttgagtaaatttctaaaactataaatactttcgtcaaagtatcacaaaactacagatttaagagcgtatatcacgaattcataggttcggtgtaaaatttatgtaaaactacatatttaaatcatcatatcacaaaactacagaacttgtgatgaaattatcaaagaactacatgttttaaagtttttatccatagcactgttgaggttacaaaagttgtaggtttatgataaaattaatattaaacttataattttctagtacaatcaaaatctatagtttttttgaaaaagggtaaaatgatgctaaatatgtattttgttatatacattctcaaacatatatgtagttttatagttttatgatagattgatcaaattatctgcagttcttatgaacttactcataacagttatatataatatctgattcaatattcaaattatagctccgtgcaaaactgcacaagaagataagttaattagtcacctctaatattgtatgccataggtgcttttgtatgaagaagttgcatgtttttttttatcagttgtataatcaatgtcggggccattgaaaattttaatgttgttgaagggattgaaaactgaatttttacgtaacaaatatgtaatgtacttagatatgctcgcgggcactttgaaattcgatccgggctcagccacttataatataaaaaatatcatgtgtaaattgcgaatagaaagagtcactaaattttgttctgagtacggtctggtttagttcccaactttttttataactttcaatttttctatcacatcaaaattttcatacacacaaacttccaacttttccgtcacatcgttacgatttcaatcaaacttctaatttttgcgtgaactaaggcctggtttagtttccaactttttcttcaaacttccaacttttccattacatcaaaactttcctagacacataaacttccaacttttccatcacatcgtttcaatttcaatcaaacttccaattttagcgtgaactaaacacaccctacatccatcacatgaataaaatcacttatattttagactgaagtagtactattaaattatgagatgaaccgcagaagtaacaatctttcactgtgagatgtggccggcggatccacaacttcagttgtagcgccagtacagcctaggcatcgcatttccggggtgtaggtgaggtatactaaaaacgggggagctccaaacaaggagtactttgctcatgcagcgagcgagtgatccgatgctagtggccatcattagggcagtactacatgcaggccataaccacggtggtactaccaatctagcatactcctatgcattgagctatagcacaggcaagcaagcatgcacgttcctcaggggcatccagtgatgagccactaacactaacatggagccagggagagggtcacatgcaaggacgttgctcggcacaagcaacctgcgctcaactgggctaaatcattcgtgccctttgctcctcaaataatgccggtattcctcccctcgaagacgtacgtgcttatcctgtcgatcgatcacatgtcgttttctttgagtgaaacaaacatgttttttacgtacgttagtacgtaccccggttcggtccaaataaaactatggatttaccccggttcggtctaaataaaattcctacgagattctgtggatttagattattaccgctcaacacgtccttatctctgtctgtccaaattaaacacgtgcagtgccatgcagtaaaaacttgttaaacaggttggaattaacgggagtatatggtcattaatttgattgtccgtgtaaaaatgatgcgtgcatgcatggctgtgtccttgcagatgctcgcccccgttttatgaggcggctgcccaaccttttaatggccgccaaaagtcaaatgctcgtctcggtaagcgtaaactaagctgaaagcaagccgcgttgtaggtagccgtcgcgattcgactgttttttaagccgtcagctagcgtgctctgccaggccgggccttgttttaaatttgaaagcctatctacttaggctgcatgcttgcttgtttgcttccgtgttagcacgtactaagccgctgctaacctctaattagagtcttagactgtgtatttactagtggcactgctagtacaaaagtactaccagtgctgtgcacttgcgttgcaaacagggggacagcttgatccacagcttagctgaggcagaggcgatggtaaatgcatggtgctccttcaatttgttttgctccatcgtcacacactcgcagtgaatcagggataggctgttgtaatcaattatggtatctccttgcagtgtcgtctgatgttgtaaccaaccgacggcacagatcaaagcaccaatagaaaaccctgcgccttttccctatggcctgcggctctgcatgtgctcccaccgggtgtatcggttgactgcagcagatatatatcaatccacgggcctgtgccgatcgaacgcagagacgagacgagacgagacgcagggtacgtgcctaatcaggcacggggctgacgcacgcatcactcgctcaccgccagttcaacagttgacaaattgcgtgcgtatcgtgcgtccaagccaacgcagatgtgtgcatgcaatgagggatcaaacgtacactcgattggttggtaggatcagagagacgcaggcaggcaggcaggtgaagagagatcgatggccagattccctcctggacgatgcccccacatacgccatgataacgcccgcacagtaactagatagtagtagtagtacccagtaataattcagcatgcatgctgcaggaacacatgagccaagtaaaggcaaggcaaacgcactgtcatttcgtccccagccgagcttaatgtaagacagtgaagagaaagagatggggtcagatgcttgcagctatatgtgctttggttggttcgctgtacgtacgagcgagagcgatcaatcgcacacgacgaggacggaccggcgcttgtgttcagtgctcgtctcgtgtagtcgtgtgtgggggcgcgcgcgcgcgcgcgcagcgcgggtttacagctgcatcgatcgaccgagtgcatgcgcctgcagcgatcgagcgcaaacgcggaaacgcgcatgtgagcacgcgcgaggacggagggtgcatggcagcgagcgagcggacgctagctgcgccgcgccactgcacggcgcgcgggccgggtcaggtcgtgcagccgcggccgtacgtgcagcgggacagggggggggggggggggtgggacgagccgtgctgaatgaaaggctggcgcgtgtcgcgctccaattttgcgaacgcgcgagtacgtgctccctgctgtaaatggttccaaagcaatcgacccggacctgatcaagtctacaatgcgttaccattgcccactttttggagatgtgaaagtcgtgcttttgtgcatgtcactgtctagctaggattcatgagaattgagaactgatgcactgtttattactacttcgtatgtataagagaaagctcaagcttggtggaatatttgtgttttctgtagtgaaaaaaaacagatggatatattttacacgaacacatctagagaccgtgaaaatcagaagaaacaagaacttgaggacgcggacgcccgagtcgcctccgctcaggcgactcgggcggcgacccaagccaccgccaccgccgttcttcccccctctcctctacctcgccgccgcctgagcaaacggccagcaaagccagcagcttgctaggatggcagcggcggggctcgtggcggcggccaccctagatccggcgtgggcggatctgagggtggaggccggtcggagtggcgccgtcgtcgaggccggaggcgtgcagggcgtgcaggcgacggcagcaggtggacgtggtggtgacacgcggcgcaggggcacggggttggcggcggcaggcggaggcgaagactggtggcagggtgtgggccgcggtggtgaaggcggcggcggcggagtctgcgacctcgggcatcaccggatccgcgtcggccatcgccggatctggagccaggtgcgggagaggaggcggggtggcggcggggatgcagtggcggcggcaggcgacggggatgcaggcggcagcgggagcagaggaggcgtggctccggtgatggtggcgcgtggaggagcgtggaggcgaggccggcgcggcccgtggagatgcggccggcggcatggaggccagttcggtggcgtggcggaggcgggggtctggtgctgcgacaggaggcggttgcgggaggccctttgtcggcgcggtggcagcctccaactcccaccggcgtcttggcggcgatgcagtgaggctgtgggcatttgtggcgacggtggctagccgagtttcgatgaccggtcccttggccgccttggccggttctggtcggtgcagcagatgagtgtgggtgacggtaggttgcctcgagggttgactgcttgtgagacgtcgtggactatcgtgtggccgtcgatgtgagggtgcttgtgggtaatgtgcagacgctggctaaagccttgccgtgcctttggccggttcgatgacgacgacgccgttggcaccgtttcccttcttgaaggcgttgtcatgacgctctcccatttgccccacaaatctccgggtgtaaaccttgctccagcttcggacgagcggcggtggcgttacacgtcgtgttctccggacgagcggcggtggcgttacacgtcgtgttctccttgggggcgtcgcttcggagaagttcctttacatcgatgatattgatagtctcttcggttcaaaagctttctttccttggtgttcggcgaggcctaagcctcttgggtccacttcgttctgtggtgggcgacacactcttcggttgcttatgcggataaagttggagctgctcgctgttggggtgctgcgacgcttggcaacgatgacgtgttgtagtctctttcaaagagttggtgctggctatgtgaaggaagtggctctttggtggcttggctgatgtccattgtggatgtcggagctgctttcgctttggcggctttcgtggcttcagtgtcgctgcggtggtgaagtcggcgctgctgggtcgcttgggcggctagctcggtaacgataacacctcttctgtgatgtcggagctgttgtgccccttttgtgcttagcatggcaacgatgtcctgcatttgggctccactgttgttgttagttgtgtagttaggtcccatgctttcttctgtctgttgggtttcagccggttctccataattaaccgtgtagctgtatggttttctggcctgatttctcttataaactgggtcattgtctcttgtttatacagtttctccctctcttaatataaaacaagcaatgttggcttaggttttttttttaaaaaaaacatctagagaccgtacgcgcaatgcatgcatgggaactggaagtggaccagcatgcagctggtctaccataaaaccgaaagtacatgctcgtgcatatgcatgctactcgagggcttgcaagttgaagcttgcaaaagcagatatcttttccccatctgaaataaaaggaggacaggcacacatgcatccgctctcgatcgatctgttgcatttcaccaccccctgacgttttaatgccttagccttcctcctgcacgtaacgttcgtacgtaccccgcgctgcgcgaacgtacgtacgtacggcgcaccaaaatcctcgcgatcctgggacatccgggacgctcgcggcctgcgttgttgacgaggccgccgggtgggcgagacgtccgcggggaaagcgggtgtctcccgcggaggggcagctcgagcggtaccgcgcgccgagcaggttggcgggttaggcaggcacgggcacgagccgtggccatgatgcgcgcggaggcaggggcgggggcgtggcgtgcgcacggcagcgcagtgcggtgccgggggggggggggggggggggttgtttttnnaaaagacgtgccaaatgcccgggcgggtggctgtgggaacagcacgcgctgccgcggcccggcgggcagcccatgttccgtcagattctgccccgatctgggtgtagtttagcctggttctttcgtggtctctggcttctccagccgttcagtgcggtggcggtgggtggtgcgcctgtaacgacctgtttaccagtgcagatttttgggggtctgcatcatgcacgtatactggtatcgtcgttgttgtgcaggatatattgggatttgggaacaacttactattgctctcatcggatggcctaaacagtcagagagtaagctaaattttaaatttttaaacttaattttaaaattgattttgagatatttttaatatagttttttttcagcattgacttttaagtcatcaagaacatatatatgaaagttttacctataaatttatttttattccctaataaaccgttttggcttattagggaaaaaaccaaacgattggggcttatactttttttagccatgtgaatgaggcaatctagcgagccgtctgcacggttaaacaagcaaagggtgttttcccatgacaaatctcgttataagaaaaacgctaatctcgtttgagttagctacgatttttgtaggcgaatatattgattgtattgaggttcggggaaacagaaggaaagattcccagtcagagtcagtttaagtaatcctatatctgcatggtatatacggtcatctttggagtttcttgacctgactcgaattgggactctcgcaactcctttttcttcaaggaaacaaacaatgcgacactcccattaacctaacccaatgcaaatgaaccatacaacacctggctgcagcctacttgcaatgcttcaacctaatctacccctgccctataaacaagccagtcaggcgcccaagcgaaatatacgcatgctgctggccctccatgaggccaatctggccaacaaatactggagtttcatcagtgcccatttacagggcagcctctggtccgcgtctgcacacgagataaaggggaggcggagtggagcacgagctcagtatctacagggcgcggcaacaccgcctgcctgcctccctccaaggcttccgaccccaggagccaggcagagggggaccgggccaccgccggcagatgccatgaaaccatgtggatcaacaggtcgttcgaacagagctcactgtgcttgacaaacgtttgcaggacggctcactcgatcaccagccgtccgtccgcttctggggctctcaatggacggccccgatttcggttgagcatggggaggcgcgcactcaagatcccgtctcaactagctggtcaggctagaaaaaagacatcctctcttcgaaagagcggcaacacgaaaaaatgcaaaggttttgtccgggtgatacagcccgtgactaatgggtgatcaggttctcacgttatctaatgataccaccaatcccaacagcaaacagcactgtactgtactgctgatggagcagcgcgcatgatggccagaagcagtattcgctggctttgcaaatggcagccatggtgctgttcaaacacatggcagcgctaggacctaaaccatggatactgaaggggacgtaacattaacaatctgtcaactggtcatctctcatctctgtgtgtcccactaagattaataggccttgatctcagtcttctcggctggattccaatcagacctaaatctgtcatcttaatcatttggcagatgcatttgcagattatgaaaaggtagtatgagccaatactggtagtagaagacgcaaaggcaaacaagatgtgtcgtctagtgcctcgtatcatctgaatccagaatcgcagaagctccggcgataacttttggccagcgcagaatcgcccctcaatgtgcatcatatgaagacttaaatgggataccatgctctccaactggcccatgagttatcacattccaacgatgcaatctgatccccattctccattgacatctttacaggcgaacaacggtttgcgtcaaaaaaacaggggaacaacggtaagataaactgatagagatattataccaataaaaatcatagccgaaggggcccaacacactggtttagatgttgtaaagagaagggtcatggcacccaaattactgaagatttaaatattctctcattacattcactaatgagaggtacccaaaagttggattcctaggactaggtggaaaatttgagtttcctggtgacacgtccactcttgttaatcatagaaccgatcaaatgattgatcttatttagcaaattagtccagtcccatgtgccagatttaatcagtacgatgattggggaaatcaacacgcgtgattttctgcaaaagaaaaggttaagcacaaatatactcttttggaacacatgcaggccactacatcgcaatactgcaatcagtttgttcagttcaaccataatggtcgtccatgatttagatacataaacggaatgctataggatgacagtgaaacaaaactccatacgggcattccaatcaatcactgaacttgcaacatacgaaactatctgttgtgttgtcacaccacgggacgatatcattttttctaggcaaacagggcgatgtcaatatatataaaaatgaattggtctaggattctatagggtggaggtagcatgtcaagcatacagcattatattacaacatatacatcatccaaaggcagttggaactttagacaccctccaaaaaagagcttacctttctggcactaaagccaaattcacaatcagcacaggaattaacagtaaaacaatcaccctagatctaactataccttgccgttctttccagcggctattaattgtgcgctacttgaagtatctcttggtaccacagaataggaaagagtaatctgcgctggactggggactgcctcttcccggaatttgacatcgaaggcaacagattggtaaagacaaacttcgtcttctttgcagtagtaaacctacatacaacagcacactatactcaatggaaatagtacaaaactgaaaacgataattcacttagctaggttaccaacttaaaccaaaacaagtcaagatgcataatggtttgttgtgtgtcctaatccagggagctacccaaaaggggcaattgcgttggatgatcttgcattagctattggcaaatccagttttcgttaatatgcatgcaggttggcaggaagtgcagacaagcaacagataagcaatctggtgaactagtctcaatccagtttaactgaaccgtttttgttcacccattaccctctactgggtattattccaatctgaatcctactaccaacaagttaaacaaaagtgttgcttgactaaaatgcattactaccttgcaattgatccttcccgttgatgacgatgaagatttccttctgtacttgagtgatgcctgtcctgagtttagaaaaccattaactggctctatctcaattgcatcagctggttctatgtccacatcaaatttacttcgagcttcctgcaaatgagaacgtatatcatcacaagtaaatcatgctgacagccataaaaaacgttttgcactaagctgacattgaacccagaagactccatgacactatgaaagtaagcaccatccacttcggtggtgtgaccagatcattcaggcctttaacaagttaactgttctctttttttctcagaaaaagagtgtccaaaaggaaggaagaattgatatgcatgaagtatgattgcatggatgttatgccatatatttcatagtaggtaaaagcaaccagaaagaccttatagcataaaaacaaaacaaaaatagtatagtcctgtgaagagtgctgacaaaccatcgaatgaaatgatatttctatttaaaaagtgtaccatacaataacattcacaatataacgggaaaatgctcgtcagtaactatataaggctaccatatatgatgcaaaaacattatagctaaaattctgtgatgattttggaccttggagaaatggtaaccatcagggacagagattgctagagacaaatatccttcaattgaagaaccaccatcaatgttaataacatccgtgtctgctgatagacgtcttcttaggcgtttcaatgtctttggttttggtgatggtggctgaactccaatcaaatctagcgtgcgcacctcagcgcctttctcattcaaaactatatacctgattgtgctattgtttgtatctgctacaagaagccttcctacgatatatcagaaaagcaatagtttgcaccatattattcatcttgcagcacaacaactactgtttgcctattctgtcactgaccaggaaaaatgtaagcagcttacacataacatagggttgttcataaaacaagtgcaaatggtgaaatacataaaataggcaaggttagacgattacaggcaaggtgatccagtgaattgctaggtccatcacctaatcggtgtattcaggaaattaactctagaacaccattagatagcgtgattgttctaattactatctcatgtgtcagttaaactagacaagcaacacagcacatggaaaaagattaccatctcccacttcaacaagtcctgctggctcagacagctgcataaaaaataagtcaaaacaattacggtatgtcttagagctgttcctaggaaaaaaacatatatttcttttcacaaataatacaaaatagaacacactctaatactctattgacctatggactgcgttagcactagtatataatattgattatatataatcacgttttaaaatgatgaggatgatatagctattgtaagttaatttacttatataccaacaaaagaaattgccaaagttgtagctttacttgagctgacaaggctggaccatccttgtatcctgcacgtcccgtaccagcaatcgtcgtaactttccgtgtgacaggatctaacctttttatctgcaattgcataacaatgcattagaaatattagaacaacttgcagtaaaagcaagcagtaaaagcaagtttagtcaagagaaatagtttaggacatggcatggatcacttatgctgttatgcacaattcagaccaacgaactatttgataatggaaattgcatgattcagaccaaccttgtgcgctgctggtaatggaaagttgattcactgcctgattaccccatccattaatttgataaaattttcactggttaccttttttgtgagtgtgaggtacatacacaccagcacaaggcataattttgtgataacttgtttattaaccggaaaaaaaaatctaattcttggtaaagaagacaccttcatgaaattttacatactggatgggttacacatattagagatggtggttaccttgtgattgtaagagtccgcaacatatatttgattatcactagcatagacaacacccaatggatgctggagtagcacatccgagccagtcccatcatgatctccaaactgcaaacaaataaacaaatttaactttatacttcgataaaatttagagcagaacaaaaaaaatcttaaaatgttcagtcacattaatgctgaaaaaaagagaggcagaatcctttagtatcaggatatataaataccctaaacaaattctctggaatcattgggtctcccccagctagcgatcttgaacccccagatttcaaattaacaactcgaatggagctgctttcactatcagcaacaatcaactcctgcaattctgtgccgatagttcatgtgaatctgtgctctctggcatcagagcacaaaggagagaaaaaaggaatcaaccagaaataccaggagctaatgaaatcccagatggctgtgcaaacgatgttctggtcgaactgcgacatgaaattatttctcagaaaaaggatccaacaacatgcacgcacaaggtactgcaggaaccaagtgggcccaaggtagcacaacaaagggtaaagcgaacagttccagcattcacaatagaaatgagattctaatgcaatcccatgagagtagaatgaaacataaacaacatgttcattaatacacaatggataactgcaaaaatattttagtagcaatcatgtatctgacccaatacggccatgtcatttgtaagcaattaaaaagttactttctgatggaccaaacggatgaatgtagaagttgataaacataattacctcgatccattcaaatttctctcgtagccatcaccactgagaacttctgttacaccgtccaatgtgttgtgtttccagatctgatgttgtccagccattgcgatgtatagggtctcctttgagggatcatagcagacatcccatggtgaatttagaacctagataaacactttcaagtcagactgttttctatcaacactagtttgtacattagtatttgcattgataatcgtaattaactcagaattttttgtacagattggacttgtcagatcaattatataatatataaacatcagtcatcaaatttacatcaatacaatttatgcaaggggctgtatcatgtgtaaatggcacaagtgtcacaaatccctttttactaagcctagatgttcttaagggccattttggtttgaagtcctatcaaaactttgtttggtttagtgccaatttcagctaataagaaacaagtaggtaatgccaagatttcactaaaagctaatttggtttgcaacctaccaaaattttggtagggtagcaaaccaaaatgggcaaaaaaaaaatccaaattcaagatggatttgtgtgttggcatgttggtttcctttactcaactggcctatgtaggtagactgcaggactatgagctcattcacagtcaaaatgggataatgatactgcaagattatgtttcaatcaaactatctattcttctaactaatttcttaatttcatcttatgtgagaattaagagttagaactgagtagcatgattttataacgatcgtggaactcgaccaacattctgattttcccaaacaaaacagcacttgcatgtgaacaaaacagaggattatagcacagcaatatggcctatagacataaatgagccttgatttcatgactacattagtagagtatgtatacataaaagaaccatgaagaagcatgcctgattagttccctgacctcctcctctgtaatcagagcctttcgttccatttcccgccagtgttttgacagtctcgctcacaaaattaatctctctggataacaagaaataaatatccaattcaggaaataggaatagtttgttgcatatgacaatgatatgaggacatagttaaccatgctaatcaactacgaaatcaattttatatattacaacaaagaatgactagcagaactagttcatcgttcatagcaaaaggcattatttgtttaaagaattacacatttattccttttcaatgaaaagatgcattcaagataagtgaggcaagaataaaaggtgcatataccagtggcacttttcaccatcaaaacacaatatgagatgaaaggaagaacccttacagaatcaagaaaacaaagaattttctgttgttcagataatacaatcaatttgtgcttgaatagtttatttatttattttttgttttttaagaggatagctatctcgcaaatatcggttagctacaaaaagtttcacaactcttctctccataggccatccacattttctcatttttccctatttacccacattcgggttacaggatggtgtattcagcatagaatatacattagaagaaggatgaacgattatcagaccaacatgcatcatatcagaggaagccacctgctactagatttctaaatgattatggttacaaatttcagttttaccttcagttttccaatattgatattttgagacgtggagactgtgtaataagcaatagtaaacatatgacaatctgaaatcagtatcacatggaggcttagaactatgaaccaggtcagggttctgtaaaaaaaaggcaagccagttttgagccagcaggtaggttcctggaggtattcagagccataaaactactgaatgcgagaattacactgcatgttgacacacgccatttccatcaaataccgacattattttattttacataaggcataagaagatcaataacaaatgttgtgtatgccaccataaactgaatgaattagccttgtaaaaaaaatgaaataagcgaagtgaagtcagtgatagaactaaccgcagtgcatggttctcagtatctgcaacatacaggatattctttttggagttgtaagcaagaccctgaaattaatagcaagtattatgaggtcatataacacatgaaaacacaatgaatggaagttcaattcaaggaggtagctagacagggcccaggaattggttacaagtatatgaggtcacagaataaaaatatcacaaaaaggacagttcgattctaaaaggtatgagttcttttcaaataaattcacttaaataaacagagcatttgatatcttagcctctgcccgaggagatatcagtttggttcatgctgtacacaggaactatccaaatatcataccctagctctctactgtagccatggtccatactaccaacaaagttcaaaaggaactcctaacatggtgctacaaaagcataaatttattgtaagaacaaacaataattatttccttacttgagggcgattaaatgaagcagtatcaaatgtgccatcaagtagtccttcttcagaacttccaatttgacatataaattccccttccaggttggtaactaccttaattacagaaatgaggatagaacaaacagctaaatcagataagaaatagatcatacatgtgaagtaaattagcctagtcaatgcaatgctatatcgttgtgcaaaacaaagaatactcacaattcgattatgattactgtctgatataaacaaccgattgttcagtacatctattgcaagtttcccaggaaatttaagcggtgaagctagtaaacgactatccttgtccttctccaatgccaagggaagagaactgttttgtaataatttattttcttcataaaattcaagagctgcaccaaccacatcatcaaggtcctggaaataatgaataagtgtgattgactaggcattgacaccataactaccatgaaaaatgtatgaacaactatgccagtggaaaaaaaaaacaggggatggcttgtttgcagaaatcgttgtacaggttagacaggataaatttgtcctcatatcacaggatagaggtcaggcaggcaggcatatgcagcaacttctgttatcttgtaataacgagatttagattttagaatagttaggtagtccagaacagatgctaaaagaacttgacaagcaagatcaagattaccatggactattaggttctacttagccaacacaattcgtaatcgtttgcagcttaaagcaatcaaaataatcaaataaaaattttgtgttaaatatcatgtatgatggccaagacacctggcaacaggaggctgattccaacaaaggtaacatcattgatctggaaaaggttcagtggtgcactaggagagttgctaggagtctgaccatgttcagagttgacagaatatagtacagtatgaaccagattgaacttttatcagggggctcatctcagcctcctaagatgcatatacctcatttttaatcaagcaaagcaagaaaaaaaatccccttctggatggcctttgtagttattgtgatgtgaacctaggttctcatcatgaaccaaattcatgttttgtgctcatctgttggtattaacctgatgcaaaataaaagcaaccaactactaaacatgtaccatatttatgaactatatgggtaacaccctacaaatatatgctttgcaatgtaacaagagtcgcaggaaacgcttctcttgataataccatcactaggtttcagcctgagcacagccatgacatggaggcaatgtagtttaaacatcaataatgaataaaccatttagttcgtgtggtttaatgaatggcagtacaatcaatttatgtcaaacagtccagtgtcgccactaaaattagcacagacgtcacctagtatatcatgttcatttgagggttggggcaggtacaacataatcatatttgtggtatatcagcatgggtcagttgccaatagcagttaggacaacacagagcataagaaattagcaaatgttgatttgcttggttactcttaaataaaactagctacaaaccccaggtaactgtttggtatatggctcatgatggcatactcgatttgccagccatataactctaataagtactacaaccttatatggagttgtattcaaaacgcttccctcagatattcttctatctgattattttgctgttatagtttagacctaccaaaatattgttggatttttcctcctctcctgatcaatttatgaattataacctttcagtaaatattgtcgctccccttagcattattttaattatgtaatagatatggttttggaacttaactcctaaattcttaatcaatgcctaaactcttaagcaaggatttaaatctccggctatagctgccgctatagccggagatagctgctaggagaagcaaccactaagatatatctaatttacagctacacgttctaaggcgctattagctgcctttagctggagatagccgctaaatgggctctcaaatagcggcagctaactcgttggtgggctgaaatcctgaaattggcgaacggcccatatcacctaacgaaaccctaactctctccattttccactcagtcactcttcgtcctctcctgtcgacggcggcttgcaggcttgcagcggctgctcaaggaggcagcagcagccgcgacggcggttgatcccgaagccggtggctatgacctgcagtggcggcggctgctcccgaaggtggtggctgcgacctgctgcggcaacggtggcggcagcggcggcgactcccgaagacaacagatccaccaatcccggccccaagcgatgactgtgacaggcggcaggcggcggtgcttgttctgtcagtattctttttcttgtgctcgagccaaccttgtgttgtttcttggttcagagatggattggtggcttggctgctcatgaattgtttcttcttggtttgttggtggcttggctgctcatgaattgtttcttcttggtttgttggtggcttggctgctcatgaattgtttcttcttggtttgttggtggcttggctgctcatgaattgtttcttcttggtttgttggtggcttggctgctcatgaattatttcttcttggtttggttggttgcagtggcctcagggtgaggagtatggaggttcttgaattgttttttttgggttcaagttcaggaattcatgggggaggaattcatgggcatgttcctcctgtaatttagcaagatggttgaggaagtggtgaggatttgatcctactgattatcaagcaattcctctctccctagtcttctctgctttccccaagttaaatagctttctcttccatataactgattatcaagttatttatgtctaatttttgcaaaaaccgctaaatagcttagctgcagctatagccagctatagctgatcatagatgatggagaacctagcagctaaatgtcttagccggagatttaaatccttgctcttaaggtgcatctagtagaatctgttgcaggattaaatgatgcaaactggcaaacacagatagtactacacaagttaggacttaatgcttgtcttttgaatagaatgttctagtgctaatacctttctgtgaccttcacctgatatttgtgctaaaaccttcccgttgggcccaatcacaacaaatgtaggccaagagttcacccccagttctctccacaagtacatgtccccatcatttacaaccttaagaaagaccatagctttaaaaagttaagaacaccacaaaaaagcaatagacatgaaagtctatgccagggaggagcacaggaatgatgtttctcatttcaacatttcacaagttatcacagctgtattaccggatgagtaatgttgtagcgcagaacagcatttctgatggcttcaagatctttttcattatcaaatttggcagagtgcacaccgacaacagtgaactgcacaggaacaagcaacattatgtaaatatcaagatatcttcaaatcataccagtttcatcaatgagagacagtgttgcagcaaaatttcacattatggctcgatcatgtattatatacttatattcaaattgcaggtgccatgagcagatccatctaattcctaaacataatatccatgatttataacttacagatgtaagaactaagaatattggatgagtgtaaacatgtgagcttataaggacggaactatactaccaactttttttttttagaacacgcaggagatctgcgtatcatttcattaagatagagaagaaaagatgaacggtgttagagaaagactccgacacccgtccaccaaggatacaacagaacaccacacacccaaaggaacaccacacaaaacacactagtgcattagcagcccaatcctagtactaccaacttcacaagttgatttttttgtgatggtgaattataataaattacaagtttttacagctcagttcagaggatctacagtacaatattttgaggaaaactcagtttcaggactaacgaatcaccatatgatcagtagagagtagttaggagaaaaggaacatgaaaaaaaaaacatcattagaaataaaattaagattagcatcgtcaaaatttacggcgcagaaatactgcagttataatatatcagaacaaatgttaagtagcaaagttataaatcatttattgattccaacctaaagctcttgaaagaaaactaaacatacagtccagcatgcgaggagacagaagctcacaggtttatccttgtacttcttctctataaattccaggtcgggcaagacatgcatgcaattgatgcagcaataggtccaaaaatccaacaggaccactcttccttttaaatcctgcaccaaaaattatgtaattgctttaagtgataatgctatatttccacggacctaaattatgaagcagaaaataaacgaaaacaaattgtcattcgccaatcatcatatctgtatacagctgaaaatcaacccaactgaaaatggtgccttgtcttgaacaggaataaagaaaagggaaacaatcggtactgtagcaaagttgcagctactgagaataacctaaaatgagtttaaattactcttccaaactgaagtggcgctgtattcaaccaatcaagctttcttgggaactcaggtacacaagtagcagaacctctgaggaaacagtttggaagtaaattagtgcttcagtaaaaataaaaatcaacctcagcatgaagcattagaccttgaaaattgatgaacatgtacttagttacctacccagtttcaaaatcagctaaatacttctttatttgttgaacccttgatgtgagttgttctcctatagaaacaaggcagagtgtgcagtatgtaagagaaaagattgtgaatcgaatcaaaagaccaaggccaatctttaattagttttggatccgatttcttccaagctagtttcactgtagtactcaccaaagttgactagcaaatctagtctaacggactaaaatgaagctgccatataatgccagatggaacaaaaaaaatatgtagcatcaaatctcacataacaccccatggtcttttttcagcacaaatcaaatcaagttactgacccggatgattagccaggattgattgattattcaaattattcattaaaaatgaacatacagaacctatatagaaattcttaccttcattactagcaaatatcgaactatttccacccgtgaaataattaagcagccctttgggagatacaaactgcatggcctgaacaaaataaaaataaaaacttcgcaatctgatctcagcacaattataggtgcccaaaaaacataggtacccaaaagaatttgcccactacaagagtggaaattatggagaatggaacgaaaactgcaagctatattaaaataaattatagaaagtgataacatgtgagatggtgccattaggtttctttaacatgtcatcacccaccatgcgatacattcctcttacgtaagttgttccgacagagagctctgagtaattgatgcagccaggctcataccatggacagtatagaagtgataattatatgtgttgaggaaaatgactaactgcaacatcgaagacaggaatggtgtgaagtgaggcattactaaattgaggctaaatagctaaggatgttaggtaacagctaacagtctaatgcccaggttgtgaaagttagtttagaaccctcatcttgtatgtggcagtgctattatttgaaatcattcctagcagaagcacatttgcagtaatttgtttggtagtacttaacaaaaagaatttaaccattgaagaaaaaactaaatgaagtcatgaatatttgcgctttcggctccttcgctttggctacatcgactacggcacaaagggctatcatcgtgttgagtactcttgccggttttttctccagtccaagtgtccgcgctgctcacgcttggactgcggggggatgttaaagtatatggtagttagagtcatattaggataggattaatttgtgtggactccttccatatctgtaatccttccttatctcctccccatgtactcctatatataccagccctgagactcaataaaatcgtcccacgttacgcagtattcctctctccctatactattcaacaaaatagaaggtgtgtagcccggatatgtaaaaatcaaagtcatacaacaaataagtattgtctcacacatgcatcaagggatcaaaagcaaagctgaaaaccgtgaaacaactttgtagtataacaatggtaccttccaattcctggttgtatagataagacaagaaacagctattccaagacttccatatcttaatatgttccgacgagaacctaccagcctgcagaatttcttttctggatgtcaatcaactgtgtcataccgaactacataataatccacatattagaccaacagcattgcattcttttgggcattatatgtgaataactcttgtagctttttttttaacaatgaaggtttagtgtaagctgcgagttcttggaatctgatttggaataagctggcagtttagtacatacaagatagaagtgaagctaagattctatgatatagttttaagcttctttccagaaaccaaccttacccttcacgggaatcatcaattgagcttgcagaatttgtgctcggagcagattcagcattagttgctccattcagaatctctgttgagggttttaaggaactaatattctcagtattttctgtccgttcatctgcaccaactttcttttaatcagcaccaagtactctagtagaaccaacagcaaatgtttctaactccattaacaatgagacaaaagaatgctaaatgctgtaatttctgcattccaatttaactacttagaaaagtgaagtccaaccccaattcaaggaaatgggataggggtcttattcaaaccaatgaaacaaagcaaatataatgagttttgcacaacaagatatgcagattttttttttctttccagtttcaaatacaagagatgcattattttattgaaataaactttgcttgaactacatactgtggtaagcattagaaccaccatacaaaatatctctaattgaaatatctccaatattcttccgtatgagtgagggactggcttgctgtaacgcatcttcctccagagtagtcatcacagcaatgcatctgcaaaatttgtaaatagcataactatttatgctaaatgctccttcgtgtacaatttttttctcaattaaatgaaacctgaagggggttccttatgttcctcaatcaaaaacattaaagataataaaaaagatacattgcaccacttatttgaattgcatggatttgaacagtcagactaaataattaaaagatggtcgttactcagggcatccctcctaataaggacatcataaatgatttggactgaagagcatatatctaatatgtgctatttttgccacagctcaaggaagtacataaaactagtggcttaggatatcaaccaaaataatgccattccattattgcctcccaagaaaatatcaaaatacgtcttctgagaacttaaatactgttatcattgttgaattggtcatatgataacatatggtactaatctttttctaagaaaatccatattaaaatatatgattgcaatcaataaaggttgtgcagtaatcaaaataagaagacataaacatgacgataggtaccacggacctcatttcggcagcttttgcagcttgaactccagcaagtgcgtcttctatcacaatgcactggtacaataccgcaaattcatcacaccccattcaaaatgtttagaaaataaacatctggaaagtattactgacatctggaaacaataaaataaggcaactagccaagtggtaacatactcaacatttcatttcactactaccatctttgggcttgtaatgacaaagtactgcagccaccacccagaattagccacaaatgctctacatataggtcatgaaggtgcatatttattattgccaacaatgatgcattgtctaatgatgcttcaaacagcgatacaggggaaagggcatctattttacatgtatgatgggtcttccataacatggaataggacttaactcctctgcagtactgcttctgcagtaggagtcgctgacattggaatagcattgctagtcataaccataaatcattcagaagctataaaaatagctagacaagccttcttccgctgtctgtttgatctaggatgtatttctccgtgtaccaagaggctatttatgaactatgtcttacatataaagtgtttgtaggattgaggttcacatcagaatgatggagatttaccaaattcacttccacacagcataaaaccagaaagtagatattttccatagccagtaaattctaagttgctgatcttatcataaaagattgtctccataataatttgctagacaattacctcatctgtgtcaacacctagggttttagatgctgccaaaaaaatgtccggagcaggcttcaaattttcaaatgcatcagcagaaacaatggcatcgaatctgaaatttgaaataggtttatcaaaactaaatagcaaacaattaagagattaaattattgcaataatacatcttcagaattatcagtgactcccaatggttttagaatatttggaaatacctaacacgacactctctctgaaacagaattatgatttaatttctatcaattaaataaagctcttcgctggtaaaagagagaatgtcgtggagattctcaaacataagatttcgaagaacatcgaaggaaattgaaatttcagtagcctggcaagtgcagagaaaagggtcaacctatgggttttgctttaacttagaactttattctggttcatgggaggtatgaagaggtatagccaactcatagcattaatagtttaatactcggtacctcttgatacaaaaaaaaaatcatgacttaaataataagacagtagcatgatagcaacaagatatccagtttatattcctactttccttgatggtttttttttctctgaccaataaatagctactctcttatgttgagtacctactggaaccaccatcagagaaagtttgattcagactgaaaaaaattgtgaagacaaacaaaaaggcaactaacatatatgatcttaggcaaaatatgacaagattctctcaaaaaaatgacataaaccatgtaatatattggaataacaatgatacttaaaatgctagtagtagcaaagaaatcttggaacgtgagcacaacgatggcattagcaagtaagtgcttggaatgcaaaggaataagcaaacacctacagcgacagaggcaaaccagcagctgccaaatttgcatccaccttaatcctatcagcactggatgcaacagcaaccttcaaacctgcatttttgcactgaaatattgacaggaatgagctgatgatcacttattaccaaagtacaacaagttttaactcaggcactgcaaatacagaaatacctctgttacgagatctagagccccagggaatccaatgccagcatttggctttgcatactacagaatggaacataatttaagaatgacgccatcaaactacaatgagaataaacaggagagatggtatgaacaaattaaccttgtcaagatatatctcaaaaaaacgtttcttggcactttcagcgttgaaatctttcactcccttcaacttcgctacacctccaaggaaattagcctcacctagaatatatattacaacatttcaaacaaactacacccaacaaaatctgaaggtagctaaattcatttgtgtagagggcgatcctgtcaaaaacggcagcagttataggttgtcatcccccaaagtaaaataggtaagacattttctgtctagagatagcctcaatacttctcccaacttctatattgaaaaaaaaagtaatattttcttagtcctcacatacttgtcatacaaagtaggcaattaacatctctcgcaagcactctgatgcaacaatatactctataggcattaagagcatgctaaggggtttacggttactatctaattagcattcagcttagcaatcactacaattgccaagggatcacagaagatcagcaatggtaggccatatgacatactgattgccgtatccactttaagaaacataaagccacagaacttcagaggatacaagcagcggcggagcttccgatatggcaagatatggcactcgccatacctcaattctattagccaccggtggagtctatgcttgcatgattaacattcactgattcctccttgtaattagctgacttggatgttagttagttacgtgaagcaactaacctagtatcttgttttcactccttgtgattagctgcttgtataagcataagttgttagctagttacatgatgtaacctagatcaaggtttaatctatatgtttggcaatatctatctttccgaaataatttgaaatttgaacaaattttgatcaaatttgaatagattttgctatattcaaaagttttctttgaaaatttccaaattttcgaaaatttcattcgggaattttgaatcctaacatagatcaatatgatttgttgcatcaaaacaacttttgcaagaacttttagcgatgcatgggaacacattgcaaaactatgccgtattacctacaaagtattatgttgtttttgctgccacaccttattgttttctcttcctccgccactggatacaagcaccctgtcaaaaactattctgatggaaatgtataactatggatgtgaccacagaccactgttacaggcatcctaatgaaataggagtatagtactataatacatatagagtttggcaggtagcggagatacgaaaccaacgacgtcaagggagatcccgggaaatattatgtctaatataggaagctactaattgctacaattaccgaatcacacgcaacttaaacagcctacgaccaagtttatgtcacacaagcatagctacgcttaccaatcacgaatcatgagtaatcgagaaaagtaaaataaaaatgcgcgaactacattgtcaattcccagtaccagtaggttgttgaacgtcgagacaatttacctgtgcccatgtaaggaacaaagtcgtccccggtgacgtcgacgcccatctcggcaaataagtcgacgcccgcgaggcgcgagagctcctcgctgttgcagagcacgccgtccatgtcgaagagcacggcggagaccttcccccaggcccccggcgctacctcggtctccggcgaggaggatgccggggcggaggcggcggcgacgtcgcgccgcccgcggcgagggaattccattgcggcggcggccggcggtattagggttttggggaggagaaggagagggcgcggcggcggtgccggggaggaaggcgggtagtgccgggaggcgaggaggcggtggaagcttcctggtggcgcgaggtgccgcgccatggcgaggtgggcgtgtggtttgtcaggttttgggctcgccgctcgcgagctcgagtagtgtcgagtgtgtgtggcggttggttggggacggtttatgcgcggcgatggctgcgacgcacgagtggatggacgaggtgtgtttctgcggctctgttggcctgtggtggatacgtctgccgtgtggtgtggccttatcttggcgtgatcgactccagtcacacaaaaaaaataggaatgggaaattgaacttttattttgctccaaaagcaccgcgtgaggaatactcacaaaattcaacacaagtattcgctgccaaaaatttaaatttttaaaattaattttaaaattaattttgaactatttttcatcgaggtttattttttacattgacacttaaatcactaagtatatatgtatataaatattttccctataaattattattattttgctaatacatcattcggcatattatcctcaattggccaacattatgtctatgaaattcctttatcgctctgaaagcatgaaattcaacatgactatatgaaatcctcgtatgtgcaatactttatgaaattttgctttgaaaagactagggtgaacattcaattagttatatatgcaacaggtaaagacgtattttatataatatactccctccatctacttttgatattaatatttcaccttggtacacagactaaggataagtaactctacttatcatccatttaaacatgctactagttattcctcgtaaacaagcgattcattaatatttgcatttctcaatgcccatgtagccaatcttgtgtagaagaatggagagtcacgcattaaatccgagaaagtcattaaaatgataggttgttggattgaaatatgcctattaaaaataaattttttagatttgaaaatatggctatcaacagtagatgtagggagtattaagagaataagagctgagtaataaattgaaatattgggatcactttacattataattgaaaaggttaatgaaaatataaacattaggatcaaagtatatatatatatatatatatatatatatatatatatatatatattaaaattgaaaaaaataatgaaaatcttttctagcttttgggccaaaagcctttcttccttctcagtacctaggccagtccactgcctccttccgtttggcttgcttcccttcgaccaagggacaaccagagacaagtggagccgtaagcccagctcgcagtgtccactaccatcttcaacctcccgaagatagtctcgtccgtgtccatatggctgcctgtcacccaaaattggttgaggatttttgatccactcgatctattaaagccgaatcgaaagggaaaatcatggagaaaatgataagtgaggagtggaatgatttttgcaattaaattggaggagaaaacacactatcgatatggtggcggtgggcggcgggaggcgtgcggggaatggatcggattaaaaagcgcacgggagaaaaaaatagcaacaaaaaattgacaaaaaaaccaaaagcgccaggcgcgctgtgaacagataggaattaaaaaaaccggacgaaaaaaaaccaaagcattagcgcgtgcgaaaaaaactctttcgcgtgaaaaaaaaggtcgggaaaaaaccggtgcaaaaaatcaaacggacttttttgtttttttacaggcgaaagtcttttttgggagtcggacaatttttttttgtacgactacaattttgagtaagtcgaacctttttttacaaaacggaatttgttgtctcggtagtagagatagaaattagaaccgaaacataaaattaaaaccgattcaaacatggatggcgtaccaaaataccgataaaaacatcttcaatttttataacagtaaagatatgtagtacaactaattcatttgttgcttattcttttacgttattttctactccctatcatcatcaatatttggcatttaggataagattcaatcaaactttttaaacgcagacacatatgcatagacatgctgccaaccgccttaatgttgtggccccttagctatgaaagtccacctcgtatgtctcataggtcaccaaaccactatcaccaagtgcgcgggtgttgcacacctatcgttgttcctgcgtcggctcgtatccagagccaactcattgccgaaccacatggcgtgtccacgcaccctacctcattgccaaggacctagatccactaatcgcagccagcgctggtcctgagtttttagggaccggtgcaaattataatatagaggcccaattttttatggtaatgtgtatcatgtttttcataaaaaaaattgtgtctaaacacaatcttaagtatttatt

SEQ ID NO: 70359 - DNA, 9752 bp, Oryza sativa
ccaacgctttccaaagggattaggccgaagattccaaaggagaaaaggtagagaagatcccgaagatcatttcccctctattaatcgggcgggagaagaaaagaggcggccggatttggaagaaaacagcggcggcggctcggcggcggcacgatagggtttcggcccgaggaagacgacgggcctgacaggtgggacccacctgtcagcggctgcaagggcgcgcgcgcgcgcggctggctgcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattagaattagattttcttttcaagacttttaaaataaattctagaaattccatttaaacaacaatttatatattttgaattttcagggtgtgacaaacatcgacgatatcatccacagcaccaatgctcctcttgctccacctaactcggcaataaatcatggcaataatacctttagcaccaaccactctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagtccgctacttatcatggggtaatcgaaagtttgcagcaataatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcggatatgtgattatgtgtataattgcttactgataaaggagacctagggtctcatttcaaaggaactatgttctaacctcgagttaataaccaacctgttgatggaaaagaaaaccaattaaactgtgttgggttaaaaagccaatgagacagtagttggggaataggagtttggatacgccttttacagatcaagataaggattgttggatgaaacccataagggtacccgccatgcctctacattgataagttcggatatacctgcaaacagttaagaagatccaggagacatcaatatttgagaacataatagtcgatggttggtaattagtcgatcaggtatcagaaaagggtcaaaggtgatatggcagaagaacaatatggatgctccccatcccaaggaagcactaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgcctcccccacaacagtcaccttgtcattaagtaagcaagatgacctaggtaaaagtgtttctatgaaggcaaggagtgaaatcttcaactcggtatcagatgctacacggagtgaaaagtgcaagcccaggttaccaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaccaagtgatatgatcgaagatagtctacagaggtcagagtaaaatcacatctaacaacgaagcttcaaatttggccggataacgatcagacaataagaagtccagcagtaaaactatttgggaagacgtcaaagtatatcaagtgggataagttggttcccttgggaagcataattcaaaggcaaagttatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaaagttctggaactgaatccccatcttcaagtgccgcaacccagtcgaagtcagctaaaggttcaaccagggataagtcaggtgcaaagaagattccatctgcaataggagatcgagccaagcagtccagagtggagaagctttgttaggcaagtttgttatagaaagcggagcggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaacactaaaatacgtacaagaaaaattcaaatatggcccggagaatttttgttaaattctccttggtctaaaaagagccctcaaattttagtggaattttcagagcacaaataataattgaaaagaaataaacaaagttgaaaaggtttataaaaagaaaaaccctaaaagaagtcctcttttcccccccttccttcttgggccggctcggcccagtccctccctctctctctcttcccccgcggcccatcggctcccccgcgcgcgcgcgccgctgacaggcgggcccgcccgccactctcgctgacgggtgggacccacctgtcatcgccttcctcccgccgcgcccgccgcccgcccgtgccctagcgccgccgccgccgctgaatccgccgcatcccgccttccccgcgcgccttaatgaggggggaattactccccgcgtttccctctcccgtttccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgacgtcgctccggtcctccgcccgactcggtgccacctccttcggcttcgccgagtggttgccgaccccgtccgccgctccgcttcgcccgccgactgccggagcaccgtcgccctcggcatcccgaaccgcgccgtcgccttcctccgctccggttcgccgccgccgtcgctccggtcttcctcccggctcggcgccacctccctcggcatcgccgcatcgccgtcgacctcgtccgcgccttcgtttcgctcgccgaccgtcggagcgccgccgtcatcgttatcccgagccgcgccgccgccttcttccgctccgggcgccgttctcgtcgtcgtcgttgtcccggggtgagccgtggaccgtcccttcactttccccctcctctccgctctctcgggcgctgctccgccgcgccgatggtcgccggcggtgaccatcggggcgcgggcgcgttcccttccgtcggccgtgccggcgaggccgccttcgggcgcgccccgcggctgccatgtggggcccggctgtcagccgcccgcgcccgcgggtgcggctgacgcgtgggacccacggcgccggtcggcgtcagccgcgtgcacccggtccaccgtggaccgaggggctgacgcgtgggccccactcccgtggacccggtccgcgcgccctctctctcggctgacgcaataaacccgatttttaattaaaatttaaatgaagaaattcgcaaatatccatttaaagagcatataaatttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagattcgctcttcgtggaagtagaagccgacgtttgggaaagcaagcaaggcaagtcacatcatccttgaacatattgaatcccagtttatcaaattattttgatttaaattattgcattattgctttatttaaattcccgcgttatcactgttttatttagccatgcttatttacctttgttaagacattattattgccattgttattattaccttgttcaccctagaataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggacatacacctctcttcctctttcaaaacccctaaaaccttttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccttatgtgtgtggcgcacccggtctagatcttgttgcttggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagttagtggtttaattcttaaaatttacttaacaactaaaatgtggaaaggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttactgcaaaacctaacccctattattatccccttgtaccccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtggagatggagctgtaggcccgctagtccgctgctgtttatttttgattgtcaggcctgaagcgcctttgtaataatgtaaatattatcgatataataaagatgtgccttttgtatcatgtttgtttggtgcaccccggcttttcctgggacggggattaatgcactagcgttcgggaaaaggcaattttctcggtcgcgacaactgctccatgatcccaacttagttcccaaacagtagatttatcaagaaccgaacttcctataccgatctaatacgatattataggcaaaattacccatctaacctttcaaccaatcaataagctaatacctgacccactttttttaagtacctttttataggtaccttgtattgtagaaggttggaattggatcaacggtcatcttcatttccaagcacaccggagaaacacttgtacaaccaatggatcttaatttgcttgcgatgcagagaatgcatcacacacattggaggttataaattcctgatcagcagtgagaggtttcactgaattaattcagcaaagcttcgcagcagcttagccaggataggatgtcgtcgtcgtcgtcaccgcaggacgggcaggcgagggcgcccgccggcgacgccgaggactggaacgcatggttcaaggagatgcgcgggtggctgatggtggtggcgacggtggcggcgtcggtgacgtaccaggcggggctgaacccgccgggagggttctggcaggacaacctgggagggcgcggcgggcaccgcgccggcaacccggtgctgcgcgacagcgtcgcggcgaggtaccaggcgttctactacctcaattcgacgtcgttcgtgacgtcgctggtgatcatcgtgctgctcatgagcaagcgcttctacgagacgaaggccaaggtggtggcgctgctgctcaccaccttcgccgacctcgccggcctcgtcggcgcctacatcgccggctccacgcgctacatgtcctcctgcatctacgtcatcgtcatcgccggtgtcgccttcctctgcgtcatctacgctggacagtgcgtattatatttatggctatcgacacatatgttatcatcgtcgtccatatatatctatatccatactactttcaataatattagtggtggtgttcagatcttccttcaatatgtcatctcataagttggttgatatgtgggggtcttaaggtctccccatttgaatatcctttcgttggatatggcattatatagctaatcaactaaggccattcccaacccaagatactagacatagattccataaactccacatcacaaagaaactagtactagacactattttttcaatgcaaacaccactatttcacacttaactttaatgctacttatatcacatgatgtcttggatgttgtgtagaaaccatgtctccttctcttttctcatttattgatttgccacatcatttttcttcctaggtggcagcttatttaatgctatggacaccatcctagttattgggttaggaatggcctaactgtgttataaccttttaatatttgtttttgtttttttctcttacaatatcagttgcaattaatacacgggcctatatgtatctctctataaacctatatatgttacatggtttcagtgtaatggaggacgtgatccccgacatgaagaagatcccctgccttgacagtggggggttgtttggggactacaaccgcgcaaaggctaaggcaggtgaagctgaaggacgtcagagcgtttgagaattttcatcgccaatttatgagcctatctggagttctattaaacatgggacttttccatgtttgagagagaggggcgataagcttctgtcgggaaaataatcgtatcggtatacttaatcctatcgtcaaatatttttacaggttgtactatagagatatcagtgcgaataagttgatcattcccaatataatcaggtgcggtccgctaatctgcagcagcaccgtgacagcccttaatatgtaatagagagatctactatatataaatatatgtcacacagtttctttcagttcaacgattttttattacattgcttatttctataacatatatacgagtttatcaattagtctataatatgtcgttaagctttttttaaaaaaataatcaaaatatccttataacatataagggtaaaaaataatttatcctgtcggcactactggagaactgatatttgctcggatgacaaaaatcaattttgtcctggttcgaataggaacgggactaagatcttaggccggattcaaaagcctaaagactttttatgatctttaatcccggttgataaatattatttttattcctggttcaaaaagtcgtcaggccgtgtcaaacccaactatctttactcctgtttgatgttaccaatcaggactaaagatcaacactttaatcccggttgtttatgccatctgggacaaagattgaaaaacaatctggaacaaacgcgttgagccgcacgcctccccgcctccttattgacggaaaacacggcggcctaggagatatgcttaactccagtgcggttccaaggcttgtctcccgggttaagggcgtgccaactcgtttgatcctgcaaccaacaaggaaatcaagaaaatagagttaaatgacgaacagtcgatcaaccaataatccgatgacgtatcgatagtagatctagccgatgtagttaccccagatcggctgtgagttgataatcaggtaaagcaaaccctaaatatgtcccatcgactgtaatatcatctattaggttttattaagcttttcgatgacacagtatttggagcaaaaaatatagaataaagataatatactagctattactctaatacagactcatacaaacaaataaatctaaagaaatatatcaaataacaaacaatcaccaagtttgacaacttagctgatattgatctatacttgatatatttacataaagtgatttatttgtataagtggcaaatatacataaaacagatcatgaaacatgctctataatgcatattaggtaagattggttgaaacgctgatattatcgttaattatgattaattgcatgttagtttataggttctaaacaagactagggatgatgcatcgcaaagtatgtaaagaaatctaaagtctaaacaatcaagaaattaaccacttttcaggatggataccttagctaatctaataactaatctaatctagtaaagctatttagccaatactggcaagaaccctaaagagagaactagccggtagggttcaatcgggatactatgattagcttaactaagatatatgatagcagatggttatgataaaagaattaatatatctaaagcgacatactagccccgataggacaagccatcgaggcaagttacctcttgtcaagagaactcgccgaaaagaagaacaaaaaggtggtgatgccccgaaagttgtatattggattgttgtcccttttttacaatgatctgaggtttatatttatacccagagtgcaaacttagtccattatgtacatggttcaaacttgcctaaagataaaatacaaacaagtccatacggcggactcttgccatatgtctaacttaaaccgacataaatatcctaattaataaat

SEQ ID NO: 70360 - DNA, 703 bp, Oryza sativa
attcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaatagaaggatagacaaaattcaaatgaccattggacatgattcgatccggcgttgaataatcaagaatttccctatcttttttaacaaaagtatccattcagtcgttctttttatcatgccatttttgttatttatcagtttttttggaacaaaaacatggtattttcttagttgatgctttatgcaggtatctactgactttaaagatcatgaaggcataatgcatatatcagggctttgacatggtcttcgtgcaagaataaaatgccattttgtgtttgtcaacaagtgttatttattttttaatcaacaattgtttgtcttacttcaggttcactgatctaatgttttagtcttgcacctatcactt

SEQ ID NO: 70361 - DNA, 703 bp, Oryza sativa
cccccccccccccccccccgtgcgcgcatggatcaggcgggctgggttctccccctttgtgtggatcccgccgcctctcctcttccctcacacatggtagggagggaacgacaaccgaggtggcatggagagcccaccaaatctgcagatgacaccagtgggagggtggatctggcaggctctccccctcttgtgtggatcatgtcgcctctcctcccctgcacatggattcagtgggccgggccctccccctccacgtggatcctgccacctcttccgccccttcatcgcgcatggatccggcgttgcgcatcgacggcgaggaggagaaacaatgactacggcaacggtggccgggagagcttgctggattttctggcggcagcgacaggaggggcgatgggagacatggagaccgggaatggcatcggcggtggcaatgatgatgatcgttgtcacaccctgaagttctcctcccaagcctaaaatttaatttataaatgaccctaagaaaatgccggtgcaaatcaagagaaaaccctaagaaagtaatacaaataataatcgaatctggcatgtggaatttttcttgagttctacatgtcgaaattcactaacaggatttttagtggaattttcagagccctagaattttaaccaattaaaattgagcaagcaatattttaattccgggctgcaggaa

SEQ ID NO: 70362 - DNA, 13341 bp, Oryza sativa
agggagaagtcgggagggagaaggaaaaagaaacgaaagaaagaggaaagtaaaagagaaggagaaggaagaaaataaaagagaaaagaaaaaaaaaagagagagaggggaaggagaagagagggtagagtgggccccacctgtcagtcactatagctcgtggataaggttgtagtataaataaatgaattaggaacagtagccttttacaaactttcggatttattccaatttgaatctttaaactagcgtaacttattcgtcttaactccgattcgagtgaaacttgaacctaaattcatctaaattcataagcttaccaatggtatacaattagctatttaataaaatatatttataattataaattaatatcaaatgattagataatagttaacctaaatagtgtgccaataaataaaaatggatattgtacagtagaataattatccttaatatgttttgtcactgtagcaaccacataaattaagtataatcaatgtttgaaattaatggatatataggaaaatattagtgccatttattaatctatgtccaaatataattaaaacccacgacttattagttatttaaatagagttagccttataattattaggtaagtaaaatatagatacacatagatcgatcctaagcttgtttatggcaaataataacagagctagtgtgattaaatcacctatatgagattaatcaacgacatatcccatataatagcatatattatgagatgtgagcaacccttagttaaccaagcagtaaatagaaactattcaaataaatgattcaatatattaagatattgcgcacacgtatattgtacatcccattatagatatatggtatcgtattaatttacttgttgcatatattaatttagagggagtataagacaaacatgaatattagataaatgctagctatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgagaagtgaaatatgtacataattaaaataaagcctccattaataaaataataatacaaatgattcacagtaattatttgaccgatccaaaatccatccggcaacagaacctctagtgtataaccgttctatttagatagatgcatgtgtaaccataacccttccttagccattagctagactgaaccaccatgacaacagaaagactaagaaaccttagctcttagcttgattagagtccattagcaagcgcgaataatataagcaaccttaggttcgacctcagcaaatatattttgtctgtgcatatttgattgttgcttgaatattggtttttctcgcgtattatagactttgtgtatcggttagtcgtgaggcaacgtctgcaacttccagaaggtgaaggttgatcaagattatatcgagaatagggattatcctgagcaggcaagtcatcactattctttgaacatgttgatcccaattgcgaaattgttttgtttacaaataaaattgcatgcaattatgaacatcctacttgtgattataccatgccttgactattgttcacctttaaatctttgtaaccatagatacgtacgagtccttagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccgggaaaaggttagtgccgtccctggtcaattaaggaccgagccatgaagttaagcatgaaacgacccccgtacaaccgcacttctcgtatgggtatagacctagcggaatagatagctgagcggaggcagtatccatgcatagtggtttcttgatgtgtgcggtaggggctctacggtggggcagtcattggtagaaccgcgaggcgggtgtctacagtggtgtcgccatcagtaggactaccatgtgagaatttgaacataattacaacttaatgcatgtgtgagtctttcctccccgggtgcgccagaactcctctcactgctagaaaccgtgtacgcctagagtgcatgaggatttaagttcatggagcgggtactgccaatgcgaggttatcgaaaagctttgccgtgacgcgtctcatgtgttgggacgaggctcatgtgttgggcagtcacggagtgcgggtaaagtgtacatccactgcagtgtgagtaaaccaaatctattcgaatagccgtgctcgcggttactgagcaccgggacatgtattacacttggctagactctaaattcttaacttgtgtgggatgggttattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatataaactctggtactaaaatttgatcagtctatggtaggttttaggcttgtgaaaagaattgtaaaaattagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgccttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggccgacactatcacgaattataattaattccaaaaactattttagggttctaaacaagactagggataatgcatctcaaagtaagtattgagctatatattatgccatcctttgtgtattttgtgcacttgcatatttgttgtgtggcttgcggagtattccatgtactcactttgcaataatcaattaaaccccagttgaagaaaagattcgaagcagaagacgtttggcttataccccaattaagctgcctgtgggagtggatatgatgccatcgctagaccgtttatctgctgctattttcttttcttttgtaaatatgtaacattattattatgatggatttgtatattaaattgtcagtttataaacctcggatgattcctggacgagggttttaatgcacaaattcgaaaattacttgtgaatttttgggcgtgacaatcaattccttaatgggccaattaaaaaaatagcatatatatgacttttagcaaataaattttacattctcaagggaaaaaacaacttccaaatatttacactcaataaagatagaaattacagtcaaagttacaatgtaaattcaactaaaacaagttgtaaataatattttaaataatgtatagcactttaaatattacattaaaattaaaccatagtaaattaaacaatagaaattatgtaatcacaaaaaaataataacttacaattatattgataaaaaaatacataccatttacactgtaaatttagtaattacacaatgtaagtttagtatttgcacactgtaagtttagtatttactccctctgtcccttaatataagagattttgacatttcatttgcaccgtttaaccactcgtcttattcaaaaaatttgtacaagtataaaaaatggaaagttgtgattaaagtactttggaataaagtaagtcacaaataaaactaataataattccaaaattttttgaataagacgaataatcaaacagtgcaagcaaaatatcaaaatcccttatattatgggacagagggaatacatccgttttcgctgcattgagcagagtactacatcatgtcaggctcagaataaaatcaaactcctacatgacaggacgggaaccaaacacccgatctgaccctaaatcacagcctcagcacagatatggaatccaacggatgaaaattcgacaaattttgactgagaaatctgtcgacagatgcgtaataaattcgattttatctaatacaaccctctatattttaagaaaataatcaatgtatttaagcatagaattacattttagcttgcacaacgaaagagttagcaactagctagttttgattaacggacgtatgcaatgcaaccatgagaaataaaaatgtactttcaaaacaaatatttgtttaattaataagaaaagaaataataacaatatcgcacaagattcggtagactacaatctagcagatccatacaatctgcacaagaaatttcttatagtttgtaactatgtaaacatgctaaaaaaattatctaaaaaaaaacatgttagaaaaaatgttgggtgtaaactccatatagacatatccttcgtgaatacgccctagatcagagaaagttaaagttggcatgattgtctcttttttccaatcacaaacgaggttgccagatatgttcttttctcattcgtgttagttagccctcctgttgatcctcatgtcgccatggcagccttatgatgtacttgtatcaatatatcatccgttgatccgtacactgacagcattttatatttactggacagcaacacaatcaagaaaagttgcaattcttcagcctgaacagcctgatgaacgaaaatcccttccttgtccatgctgaattaacctaaagctacataacatatttatatatatcggattgaaacctttcgtcctcttcactaaagtgaaattttcgttactataaccaatacagcttgcttgcaatccaaacaatgcacatacatggcggttataaatgtacggcacttacagtaaccagagtgaacaattaatggactgcagcgagaggatgtcatcagagacgacgaggcataatcagcatgacgagcggtccgagcggaacgcatggttgaaggagatgcgcgggtggctgatggtgctcgcgacggtggcggcgtcggtgacgtaccaggccggcctgaaccctcccggagggttttggcaggaggacgacagggtcgccggccacagggccggcgatccggtgcttcgtgacagcgttgccgctaggtacaacagggttttaaatctcctactatagctgccactatctctagttataactgtatgagaagggttctagttatttgctctcatgtacaatttagccgctaaaactctatttagcatgctatagctaccgctatagctgtttgagaagttaaccgctaaatgtcttagccctctatttaaaacatgaggtacaagacgttctactacttcaactcgacggcgttcgtgacgtcgctggtgatcatggtgctgctcatgagcgagcgcttctaccgcacggagaccaaggtggcggcgctcgtggtcaccaccttcatcgacctcgccagcctcgtcggcgcctacatcgccggctcgacgcggttcatgtcctcctgcgcctacgtcattgccatcaccggcgtcgccttcgtctccgtcatcgccatgggagagtgcgtgctacgtacattaattacattacattgcatatattaattgataattagacaagctacaagcaatgttaatatatatagttagtgctgacgcatggtataatttgcttcagggtgatggggatagtctgcgatttcttcagggggaggtcgccgtgcatgagcagctgctacccgctccatggtagagctgagggtgacggactcccgatccacaaggccgaggatgaagagcaaggtagaggcgcggcgtttcacatcagtagtgttgacgcttgagaattttccccgattttagctaggctggaattgatctaggctacatatatgtaaaaatttcttcaagaattactggaaagttgagagagagagagagagagagagagagagagagttgtgttaagcttctgcaaaaatgcttcagagttcagtattccttttcatggactgttctagtctataggttgccagtgttctgcgcgcggttttcttcatgtgacatgcttgggcttttcatgaacatggagctgtctgtttagttatctgtgagtgtttttaatgatatagtaactttctatacaaatactagtatatgtaaaaacatcctatttttatggatggctatcataagcggtttctgatcatgaagcggtttaaaccaccatcacattcggttttccttttcggctgcttatgaaatggaaagtctaggacctataaaaatataatttttataggggatgtcgatctgttagtaattgaatggtatatggattttggaactgatggtgtgctccatagaaaatacaatctacagtcgaacacatttattccatcgcaaacggtcgaggatgacatatagtccctccttttctttttatcagcacaagtctttgaccaataattactctaccaatattttatttatgtgatataaaattatagcctgaagaaagcatttttgaatacaattataataacaacagttttgtggaagataatatgtacaataatcgtgggttagatcttgttctaataaaactaggtgggcgacccgcgcatttgcactgctagcatcaatttaaaattatctatttttatacatgattttattttaaattatcattcccgtggttctaataattttatagtttttaaaagccacgccagtcgctatcccttactcctttgtcatctttttatttgcttactcgatctaccactacttctattcatcctctttagaacttaaaaaattaggccttatagtttttagagttcattgtctttgttgggtttcgttttcatatataattctttgaagtatcgtcaaacattaccaatttactactctacagcccgtccgctatcatctctctttattatcattgggattttaataatcgaacataattattgtttgtgttctttttaaatttctataagtctccataatcgttagtggcttcgccactatacttctctgcagtccacccgctgcctcctctccttattgtcattgagatttcaaaaattgaacatgattattattggggtttatttttactctccataagtcccgtcaaccgtcgtgatcatgctacttaacggcatgcccattgtcactcctcttaatcgtcattgggattctatttgaagttttgtttatagtttttagatatcccatcgatcgccagcactctactaatttacaggcctattgctcctctcctctttattgccatttataatcattgtgttctagatggactttttttttgaaaatttgcatatttttcattccgataatttttattcgtaaattatattcctacttgaacttttataactatttttctattttttaaatttaatttatttgtcatttcgaactttaattaatctcgtcatgtgttctagattgtctcttatttcaatagtctttattttttattacaaattttagttatttataaattgtattatagttgagctcttatttttctttttctattttctgaatttattttattttttatttctaattttaattaatctcgtattgtgttttatatagactattcttttaatatttcttatttttttatttctaatttcaattgtttcaaaattgtattcctacttaaactctcttttttatttttctaattttttattttatttgatttttttattttgaattttaattaacatcatattggtttcttatatggactcttattttaatattgtttattttcaaattgtattcctacgtgaactctccttttatttttctaattttggattttattttatttttatttcgaattttaattaatctcgtattgggttattatatggactgttctttcaatatcccttatttttaattccgaatttcagttattttaaaattgtattcctacttggactcttcttcttttttttttctttttttttgctaattttggattttattttatttttattctgaatttggattaatctcgtattaggttcttatatggactcttctttcaatattacttaattttaattccgaatttcaggtatttttagattgtatttctacttggactcttcttttttttttctccgattaatgtggaaatttctaaccttcacagcgaacgtggtgtctgctttcaaagctattttaataatataatagatagatagatagatagatagatataatacgtccctatataaaaagagaaggaagggaatatatctttcccacattgtaggtagcccatctcacgggtacttttttgttttggcattctttattttaaggctcctttccagctaggctgatatcatgacatgacatagtaatgatgtaatcaagagtctaatatgtgtcattagtacacaataacaagttggagcaagaacatgtatatgttaattactcccttcagtcagaaatatttgacgccgcccaagaaggccgacaggctagtagaaactagaaagcagaagtgaaatatcacatagtaatacattagcacgctgcagtgggcatatatttttatttcttcatctcgaataattggacaattcctttcttgtccacttaaaaattcgcatatgtgcaccctttcttcgtcttcaccaaagatgggaaaaggaaagctgccttgcttgcaaagcagacaatgcacatgtaatatggacgtcattcggaaaagcgtaatcacaactcacaatccacgcgagtatttaaaccaacaattgaaacatgcaaattaaagcgcactgaaatcaatcagcgtcaccaggatgtcgtgctcgtgccagcgtcagtcgccgtcgtcgggaggccgcggccgcgccgtccccgtcgccgacgcggccccgggcgagctggcggcgccggaggccatcaacctagtccccaacgggaagcgcggcatgccggtgctgatcacgccgtcgctaccgcagcagcagggcggcgcgtcggcggcggcgttccatggcatcatcgtgctcaaggaggagagcgaggacccggtggcgctgcggaacaagtggttcagggagatgcgcgggtggctgatggtggtggcgacggtggcggcgtcggcgtcgtaccaggccgggctgaacccgccgggggggttctggcaggacgacgcgccggggcccggcgggcacagcgccggcaacccggtgctccggcacacgtcgccggcgaggtacaagacgttctactacttcaacgcgacgacgttcgtgacgtcgctggtgatcacggtgctgctgatgagcgagcggttctaccggtcggagacgaaggtggtggcgctcatgatcgccaccttcctcgacctcgccagcctcgtcggcgcctacatcgccggctccacccgcttcacctcctcctgcatctacgtcatcgtcatcaccggcttcgccttcgcctgcgtcatcgccatgggagagtacgtagacaccaatccaatcatctaactatctagcttcggccgtgtttagatccaaactttttgttcaaactttcaacttttccatcacatcaaaactttcctacacacacaaacttctaacttttccatcacatcattccaatttcaaccaaactttcaattttggcgtgaactaaacacaaccttcatgctagtagtgataccagggattgaaatgttggttctttttctttttcctacatggcaaacgcgcacacgcatactctgctatatgcatggtcgcacgtaacaccacattcacccccctaacacacgttctaagaaacggaaaccagtgacccatccctaattaatctaactgaaatcccgttgaaagccctccctcaaacacgtaatattcactttcacgcacccacgactccatgccaccacatcaccagtgtttttccttattttggttcgaaattttgaatggatggatgatgaatatatattgtttattcacctctgctccgcatgcagggtgatggagcaatgctgcgggttcgtgctgaggacgtcgccgtgcatgctgagcctggcgcagcggcactggtgcccggtgccgaggagcgtggtggacagggcggcgcggcaggccaaggacgacctgcacatgatggaccgcgtcaacaacaaagcgaaagcggcggcgccggggagcagtagtagcagcaagcagcggcgaccttgttgctgcctgtgttgcgccggcccgcctcccaccgatgtctgatcgatcgagagggaggggaggcggcagcagcagcagcagcagccggcagaggccatacgcccgtaccaatacaccatggcccttaattagcttgttcttgcatcgggcagtttgtgatctcctttaaactgctttttgcacgcacgcatccatttatgtttttttttttttgctacacatgttattcggctcttgtcagaaaaaaacatttttttctctgtagtatggatatgtatcatgctcggttgattttaccaatttgtcatgaataaaacaagggaacaatgggactacccatatgtatggatccatagttttttttttttaaagaaaaagtcaagtgtaaatttttctaacgagaagaattttagtggaaatactctacaggtaccgtgagatgtttccagctagtaaaaagggattaaatctccttgagaattcgaagcagcatggtggcagaaaaaattcaccaagttcatattggttatttgttcggtgtagtatactatgctgcatgaatttttataggccccattttaaattataaccagctgaggaaacaaggagagaatgctcaaggcttaaggaaaaaagagataaaatggcattggagatggctattgatagaaaggaagcaaaaaatgcttaacatcataccctctttcattaatgactaaaatttatctctttgcaatatggcttctttaataggacttgatttaggatgcacaatagaaatgatgggacacaacttggatacttttagggctttggaaagtgctagattggatttgttccaacaaaacttgaaaaaaaccaatgaaaagtgtcagacagaggacatatctgaattcaaaacatctgatttgggtgtgattgaagatttggcctctgacaatgactctgaacttgatatattagaagatatcctggagaaaatccagtcaaagtcagaaaaaaaaaagaaaactaggaatgctaagagaaactttatgatttgtaaggtcactccaaaagctaagaaaaacagaagacccaaaaataatagaagtacaaaatgaaagtaagggtggacccaaaagggttctaggtatgcaccggcatacccaaaaattacgaaaactttttaatacgtagttggtcgcgatagggtttagagaatcagcgttggcggtggcgcaagcacgtggcgctgcggcagttggcagtggacagcctcgattggaggtggacagcctcgattggaggtccacgccggctggactagccgctagcggaggctacctgcgatcggctatgcacaagcatgcagcagcacgccgtcgcggttgccagcaagtcggcgacaagcagcggttgctcaaggatgccgaccaagttgagccgtttgaggtgtcgtcctcgactcctcgtccacttgtccgtccatgtttagcccgagtatactctctctattgttattctctctccgatttttctcttagcagagagccatagattgattgaaaagtagaaaactgaaattagtaaaatcattgggagttaaaaaattgaaggcatatgcttttgtgatttaatttgtctgagatcaatttaatcaatcaaattcaaatgggaagaggaacatgtcgcgattctttcttaagctagaacataaagaatcttagtgagctttccatcaagctctttaaatcaattaaactcagtatattcacatcaagttgaatcaatcatattctgtcacgccccgaactagtaccgaccggaactagcccgtgacgttccaaattaacctgttaatcgataccagtcccaggaaacagtgccggtatcacaggaagacagaatatcacagcaacaaagatctctttattatagagtagaggtacagtcatgttgggctgcggacagatcccgagctcacaactgcattacaaaagggaagcggaagccaagacttgggccaaacaacacaggcgcgacttgggaactaggccgaaaccctaaaactcatcgaagccggcttgctcctggaagaactcctcgtcagcaggatccgcttcatcttcttcagcaactgggggggggattatttatatagagcaagggtgagtacgggagtactcagcaagccatgggaaataagtgtttaatgcaggcttcaaagaaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgaaacagggttggcacccggccaacagcttttcaaacggccacccgggccaaccactttcaaatggccacccgggccaacaatccttcaaacggccacccgggcctagctgatcccatcagctgcagatttttcaaacatcgaaaccctttccacaacagcaatttcacaagcagtagtcaaacaaaactacgctaggaatcacctcacatccgcccatgaccgtgggcacggctgttcgaacagtttgttaacctctgtagagggggtacactttacccacacaacattactaacccggatcacccagcccgtggggatcagccacgtcgggagacctccaagctttcatgacaaggcatttcgaaag

SEQ ID NO: 70363 - DNA, 692 bp, Oryza sativa
tcctaaatcatgttgagatctccaagctcaatacagaaaggaaaatatataacataaatgaaaaagcaaaattctatttcagatttagctaccttttgaggtagagaactactgctcttggtctctttggcttcattgacatacggtgcaacaaacgcaaataatgatcttgcttcatcatgagacaatggctacaaaaatgaaagacggtgcaacatacgcaacaagtactgataatcctgcatataacatattcggggtgctacttatggtcaaagcattattcaactactggcagcttcaataatcattcatatgctatgccatccagaccaatctgaattatgtttgctaaaacctgaacacaagtgaatgaaacacagaagtggcattcacggttttacacgctagactgtaaagactaataatcagtaagtaaagaatccacagttaatcttccctgaacagaaccaagtgcatctaaaatagcagatgcgcatttatcttcaaggtaagatccttcaggtgtcaaagttaaccaaaattcacaagcagcacttaagtaatatagcttgtgaatttgtggttttaatagccagctgttccaaatgtttcagtaactaaagatccacagttaatcttccctggacagaaccaagtgcatctaaaacagcagatgcacatttatcttc

SEQ ID NO: 70364 - DNA, 1076 bp, Oryza sativa
ccaaagttcgatcgatggtagctcgtccatggtcgaacccatccattccagaaggtcggacctgtcagagcaccgtggcaccccgtgcgacgacgcgactgtggtctgtgggcccccaccctctcaaaaccctcacgccactgacatctgggccccaccccctacttttctctcccccctcgctctcccatccacgcgcgcggagtgggacccaccacccaggcgttcgcccttatcgttgcgcgagcccttcttcttcctcctctctctctctctctctctctctctctcgccaaccaatctcctcccccctcctttcctcctcctcccgaaccaccggaatccgacgcggcgccgccgcgccaccccgttccgccggctctcttcctcacctctcctccccaggagatcgtcaatctcctcggtaagcaagcaagcactcgggtggttcgagctgtgccctgcgatcgatccccttgcggagttgcgacgcgaatatggtgtctaagtttgatgttacgttagggtttggttggttcgtttgcggcggtgttggtgcctcgtgtgtgatgtgtgtgtgtgtgtgcgggggttaatttggttcgttcgtggatgggggggctgatctggcatcgtgacggtgtcggtgttaattgttaaacctttttcatttctgttccttaacttttgccgtgatgggggtgatcttggagcgctgcgctggtgtaaatcgggctagattttggaggaacgtcacagtgaaattcgtcaataatcgtgtcgttttcctgtcgaatttttggcgcacggtttgatgctgttggggacctaacctaacctcgtgttcttgatgcgatgcaggtcaggtgtttgatcgattgcctgtgggaagcatatgggcggttagattcgtgaagttgagaggaatcagaagacgggaattgtttgaggggactgaatttgatctggaaaatggggtggtttcgggctgcgtccggattggctcgggtggcgctgaggaggaacctggcgcgtgctccggcgaacccttttgccggtcctgcgccacggtactt

SEQ ID NO: 70365 - DNA, 20568 bp, Oryza sativa
agttattgagactggaccggtaattgaaccggtgaggctcttggttcgatggttcactggttcaaccggttgaaccattggtctaacccggttcaatagttattaaatatattactcattcctttcaaacacaacaaggatgatagcctggtggttggtgagggctctttttccctcattttcccccgactgctcccttgcatgcacccactccctcgcaaggccggttcaaccatggttttttctccggttctatagcggtttttcatgaaaaccggacagcctaaccggtttataccggcttgattgcatatccggtcttttaactggaccgaaccggcagaggctccagttctggtttttcccggtccgaccgccggtccggtccggtcttaataactatggctaaaactatcaactggaacaagctgtgcatggaaacaagttcacagaccatcttttgtgacccattgctaagctaaagcaataagcatcaccaagagatcaaattattatgcataatgtgtgctagaaaacaaaatcagtgattggagtaaaagatggacctgcctccttccgtagttgtctgaaactacaccccaagtgtaagctcctattagcattccaacaaaaacaatgcttgtaatcatgctttcctgatgtgaagtaagcttccattctaactgtactgatggaccaacaaatgatagtagcatcatctccattgcttctgcaatcaagccgaccccggcatatgaaagaatcaatatttggtacctcccaaaacctgatgacagaagcgcgtcatcgacgctatacgtggctgattgatcctcctccatctgcaaggcaatgataaaatatggttattctttcagcagccagctgattaatcttcctgacagttcttgtatctaaactgcagaagcccaaggctgaaaacaggaactcgaatcctacatttttcctgtaattctgcctgttcagtatccgcacaccatttttcttttgctttgtaaatctagtaagagtatatgttcacggttaatcatccatggaggacagataaaactgaaaaagaggaaaaatctcccttatctcactctgcaaaacaggtcttaatcacatacgtactgttacatacacacacatataactaaagagtaatgaaggattcataagttccatagcagtggcggcggatctaacatgggccaaacctttttgggaaccatcaaactgttattggtattaaggttaaggcaaatttctagaacagaagctagggttagcgcaaattcgagaaaaaagtgcgtgggtagagagcgcgatggatggggatcggcgcaggcggcggtggcggaggatgtgctcaccaggatgcggcggaagcaacgacggcggcgctcgcgggatggatgggggatcggcggaggcggaggcggaggcggaggcggatgattcgccgatgctgtccagatcccgactaatcaaagcggtggatggagagaacgagcgatgaaatggaggagaagaagccaaagtcaaagccaaaagccaaaagtcaaagtgtgtctcgaattcatggatgcggaaaaattagctctaaatcctcccagattccagagataagcgcgtggtttgaggattttgccagccttgaattgaaagcgcagttttagacaatttctttcagctcctttttgaccggagctttgtgttcatgtgccatgtgcaaacccatgtggagaatcccttggaaaaggtaggtggtatatccatgtcaaaaatgttgcgggctctgtgtgcttgggcttatgtgagcccaaatagaggcctttaggggatatcggaataagtccactttgactcccttaaatgtgaccccaatctaatatatgtgaccttaaccgcaaaaccaaatattatggcccctcagctgttaaaaccggtgtaatttaactctctcagcggtttttttacgacacgccaccatcgtctcatcaaacctccgcgatgacgacgagaacaggggcgatggtctccaccagctggctcccgccgcggaggcaccacgctactcgacgtcatacagcgtcggcgaggtggttgtcgcgaaggaaaggagtgccgcccacggtggtgttggtggcgtcatgacgtagcgccgtggtggtcgaagacacgaaacggaggtaggaactaggaagcgccgctcgcggcggagtaggcaaggtggccaccgtccctggcgccgtgaggtgtggccgcggcgacgccatcgttgccaatcgcatacccctcgggttagacagcgtgggaaaaaaaaaagaagaataaagaaagggaggagacagaaaaaaatgtgatgctgacatgtgggtcccacatgctaagtcagctagttgaaccgggtcaagacgccatatcagcaaaaccgctgagggagtcaaattacaccggttttaacaatttatgggtcaagatatttggttttgcggttcagtgtcacggattaaattcgggttacttttaagaaagttaaagtgggcttatttcggggatatctcgcattatattccggactaagttttaaggcccaatagaacaagacgcttcttttgatctaattttttcgtttattcatgctcattcgaatcgttactagcaaataaagaatcgtttaagggtaaaaattttatatagttgtcctcagagactcaaagtaatagttgtaaaataaactataatgaaaaagccaaaaaaacaaattcaaaatcaaattctaaaatttaaattttggattataagcataagctaaccagtgtaaaacaaatagtgtaaaaaaaatcaaacttcgtgcttgtgaagtatcttcagaaaaaaaacagtgtaagaaaaggaaaacaaacagtgtaaaaatgaaacaagcactttggtacacaaaggtgcttatgagataatattacagtgatggtattggcatatacacgagctgattttgcgccaaatacatcagcagatggtactattagacagaacaatttcccctgcttcaatagatgtgcactatccatgtctgtacctagtgctgctaattaaccaacaggcgacatgtgtaattaacgaaatgatcggaacgacatacgtactagtatatgcatactcgatcgaccaaactcccaaacaataaacgtcatgtagattaagtacacgataagttgtagtttaacgaagtgcacctactcaatcgatctgtactgcttaattggttacgacttgcaagcaagcctaactctctctggaggcaattaacctactatctagaccacaaaaagtattgcacatataattcactacctaacaatgtccgaccgtaccgatctggtaatgcatttgcttgcatcagagcatcatcgacacacctgcatctgcatgcccttctttcctacctagcttgataagcatatacacatctggctaatgcatgtaaggaagtgatggcatgtgtgtcagtgagcaattatattaattagcatgttatgatctgctctgaccaacttcaggtttaaaaacattgcgttggcattgagcccttttcttggtgatcttccaactgaacccaatatatttgcctgttacatcttactactaggctttgattgacaagaaaggaaggggttcaagtgatgatgcattaccttgtatataccttcttgttgcaactagagagattataatctcagattaattaatattagcccactccttaactagttgagtgtggttgcttgttacttcggcactggctttctggtctctttgctctgaccacattccttcttcaccttctgttgaaaagagcctgacttcctgccttcccggtcaccaaattatcttgttttttcatgtgcgacgttttcatcagtgcatgcaagatgtaacctgtttaggtggtgattagctcaagcatcgtgtcactgtggttggtaggatgtccatgaacagtggactgaaagatcagccatgcatgcagcattgatcagaagttcataaccactttactgagacacatcaagccctaaaccttagaaggattaatcgaacaagacctaggaaatattcctgacctctgcataactaatatgcatcatcagtgaaacagaggaaactatgattctctgctacatctattcagcagcttcagtattcaccagcaggtttgaccgaggtcaactgagacaaaaaagctgcagtgcctgaacttgatggatggcgccggcgcatcaaaggtgtctgcgaatgtgtaatcttcctgtaatttgctccctagatgatccacaagatcacaagtaaaagcagtatagttatcgaggccgacttcatcaggatgcttaattagctcgtggaatgatcgtcgccgttgccgtttttcttccaaacctgatcgacggcagtttgtcgcctgtgcaactcgtgcagtttgtcaacaagattcttcagatagctagcttaggcaatggtgcgactaagctagcatttcttcagattcttcagtttgtcaagtaattacttcttgcttggttgactgatgaagtgatatgattgtaagtttgtaacactcccaattgagcaatgataatgacggagttaatccttttcaggaaggcttgacaaatgcttttgttgctttttcgaattgataataatgatgatgagtaaggatggtgttaagctacgtttaaaggcttggaaggtgttgggcgagaaacggctgactacagacatgcttggacatgcatgtgaggacatgtttgttggtgaatggtcatacacacttgcattacaggttcaaacggaattaattaggcttgaaaacgcagaagcttatacttctgcaaaattgcttggctacaccctacgtccacaaatataacaacatcaacacggtcttcaaattataacttaaacaaatattatttgtaaacaccaattattttacatagaaagggttacatataagatatactgttccacgataaatctagtaacactattccttaatttttgttattgacaatcaattttaaagaaaagggtatatttgtgaacagaaaaatgtagtttcttattgaaaatattgtggcgcgcttatatatgtactccgtacccagatatcccagttaaatggatatatatatatatatatatatatatatatatatatatatatatatatatatatatatatatttacgaacgcgtaaaaaaattgcacgtcaatatattagaagaaaagagttatagttacaccacgcaatcggccagactggccaatgccaggggaaaggagaaaaaagcaaaataaaataaaaaactgaggcttagaaaaagaaaactacgacggctgaaaaaaaaaactccgcaactgtaggaaggggctgagcggcgtgcacgcggctaattaacgtgctgcgatctcttaatatatgcagtacaattttgacggtcagtaaaactggcaaccaaagtcggtcttcaaagaaaaactaaccaaagggtctttcaaaaactagcaactaagctagtccatacgctgcatttttccagataccttccagggctctccactcatctggaccagaccacaaatctcaccatcatctgttactctccgtgactccgtgtagggtatagctaatgtttttttttcctaccaacttacaattctaaactaaatgaattgtctgtttgtgcatgaaattaataatgacgtgcaaacatcgactaaattttttccggcgttgaactgattcatattactattacattgttaatcacattgtgcaaattgaaaatgactagaacagtataaaaaaatagtgtgaatggcattgatttctgggaaactattttgatccctcgaggtaatatctcctcgttatttgcatgtcaatcaaacggttatgaaaaaaattttaaaaaaagagaatatgtattaacatggtgatattacactacacaaatatgtaagtttaaattcaacttctacatttcgtaacgaaaaaaaaacaaattaaaccacagctagttaatgtatattcacagtcaacttaatttaaacttgtatgtttacaggggcgatatatgatatgttaatatatcttcttattttttttcaaattttttcataactatttaagtggcataaaaacaacgaggagatatcccctcgagagatcaaagtctacttccttgatttccggcatctcctttataaatagaacatccatccatgattcacactcaaaccgatcaccaaacatttctcgacacactcgcgcgcgcaggtacacaaacatggtgcacgaggctatcaatggacatggccacgaggtgaccgtgaaggtgacgtcggcgtcgacggtggcgccggcgctgccggtgcaggagcaccggctgccgctgtccaacctcgacctcatcctgccgcccatggacgtcggcgtcttcttctgctacggcgccggcgagggctccggcggcggcggcgcgctgctgccggcggcgaccctcaaggccgcgctggcgaaggtgctggtggcgtactaccctctcgccggcgaggtcgtggccaatacccgcggcgagggggagctcctgtgcagcggccgcggcgtcgacttcgccgaggcgaccgccggcgacgccgtgctgcgtcagctccggcttgccgtggtcgacgagagcgccgagaagctcgtgcccaagaagaaggctggcgtcatgtgcgtgcaggttagcgtcacgtttttttttggattttgctattttcgttacgacagaattttgtactcctatttttttaaaactttttttagaattttgtactcctattttttttaaacttttttttagaatttttcatcaatattcgtattcttgtgtgtacaacttatagttaaaaaaatagtttctcaacaattgtttttctaaatgtatgatttttatatgtttattgttttattttgttattttatttaaaacaggttttttttaagataatggaataaaaacatcccggcctttgttcaaaagagctacagccaattattacagtctagcactctcgaggagtaaagtccaaaataaagcaatcacactaaataaaagaaggaaaggcaaacaaggcaaggagaacattattccagtctatcggtgaatctccatccatagttggcaaagagttgcataaccatcgtctcaagcgtacggcatgcaaccaacggcctcatcacacttttgtagctgagcccttagccagagttagtatgttgccctgaaaattatctgcatataggaaacatatagtgatttgtcaaaaaccctatcattcctgctcaaccacagaacccaacataaggcagaggctcgaatcagtatcagtctactctttttcttatcaacccccagaagccaatcataaaaaatattatatatgttactgggaaggcataatccaaaagaaaactgaattgctctccaaataaactttgcataatgacattctataaataaatattcaatggtttcattttttttatacagaaacaataattcaagttgtcattctaatttcatcttgctaaaatctaccatattcgaagccataaatccactgaaagataaatacgtagtctttcttttaagcgaagaggcgaagcaaaatgttttcgtcgctcgtacagttgcagcaactgcacacgtggctgcaaaagtgcaagattaaccaatacaaaatctgtcagcagatggatagctattccgttttttgattgatcgtatcggatccgcacgtgagctgcaggtgaccaagttcaagtgcggcggcgccgtcgtgggctgcaccttcgaccaccgcgtctgcgacgcctactccttcaacatgttcctcgtcgcctgggccgccgccgcacggggcagctccgccgcgccggcgccgtccttcgaccggtctttcctcgcgccgaccagcccggctccgccgtgccccgacgcgctctcggacaggctctttgtccccgtcagctgcgtgccggcgccgccgtcttccgccccggaggccgccgccgccgccgtcaaccgcatcttccgcgtggccgccgccgacgtcgcggcgctgcaggccgcggcggggccagggcgcaccaagctggaggcgttcaccgcccacctctggcagctccacgccagggcggcggcgtccccgccgcgccaccgccgttcgtgctgcatgggcgtcgtcgtggacgggcgcacgcgcaaaaaacacgacggcgccatgggggcttacttcggcaacgtgctgaccatccctacggcgccatgagctccggcgacctgtccgccatgcccctcgcggacgtcgcgggcgacgtgcaccggtgggtggcggaggcggcgacgcgcgaccacttccggggcctcgtcgactgggtcgagcagctgcggccggagccgtcggtggcgagggcctacctgggcggcgacggcggcgcggaggcggcggcgtgcgtggtgtcgtcggggatgaggatgccggtcggcgaggtggacttcgggcgggggcggccggcgttcgcgtcttaccacttcccgtggccgggcggcgccgggtacgtgatgccgatgccgagcgcgcgcggcgacggcgactgggtggtgtacgtgcacgcggcggcggaggtggtgaaggcgatggaggaggaggagaccaccgtgttcagggccctcgagtcggactacgtgttcggtccggtgcagcagtaaacacatgcaaaaacacaataatacacacggtaaaagttgtgcccgggatggcaccatcgtggcatcacaaacatctgcgtgcgtgcacatgtgtcgtagtaactgtaagctgtaagcatttatataccgttttgtactcctcgtaccgtggtacgtatggtatgttgtaaattgtaagtttgtaacggtcttgttgcattgcttgtacaaaatggaaggaaattgttatgcttactatccaactgttcgacttacgtacgactgaattcaaccaacgattaatataaaatgctccattttaaccgatttatggttgtatgtctctggttaacaagaccatgggccgacctgagccatgtctgctgctgggccatgtctattggcgaacatgtcgggccgacacgggaaactattctaattcctcgaggagatgtttcctcgtttgcttaaaaaccatctaaacagttataaaaaattctggaaaaaattgacaacattcatacaacacatatatacaactccacaaaatcttaagtccaaactcaactcacacgtcgagatataaaaaagacaaattcagcgtatgaatagtagcgtactgtttatatctaaatttgtcttttttttcttgatgcgtagatcgaatttgaacttgaattttagtggactagtatgtatcattatactctacattgtcaaattttttcagaattttttacaactatttgcatcgaatttgaaagaaaaagatatacgaggggatatcccctcgagggattagaatccactcccgggccgacacctaatctgggctcaaagttcacgcatggtccagtacgttgccctgccccaaacccgcgcgccggcgacttgacactgcgccgcgcgtctaattattcttggatggattcctctcgttttctcgttgcataaacatgcacggagatgggacaaatcaagaatcaacctaaggcagggagtactcacgcctgaaatttgcaagcaagcaaaattttaaaatcaaggtttgctggagctgagacctgagcatcgtgcacttggcttgtccacacacaccgacgtcgtactgaactattagttgataatagtgcatcgcgcattaatgttcacgcaacaaaggggtgcccaaagctgcgaagcgagcgcaactcaagatttcttgtgatgaaacccattcactcgggttcaagttaattatagattttaataggggtgttcgtatttatgactaattattatttcagtggtaaacgacgtactcgttgacagcgagatacccatagtgacttcattaatctcaatatatactggactagtctttcgaaagtgttcataagaataaagtgtacgtgtatatatttataggggtggatacagggccgtcttcagaaatttggggccctggaacgaaatgccaatcgaggccctaaatttaagaaaaattcatatatctaatctaatatatgagggatgattttagctttagtatgtattatttcgtgcaatatttacaaatatcatcatctgtatagtgttttttaaataaaatcttcaattgttcgtaattaatattattgaagacatcattttcagcacctaaatcatgatgaggtgattgacgaaacaaatctattctatttttaaacaaaagcaaagacatgtgtttgattcaataagtaatccattcaatcgttcgtttactcacaataatgtaagggactgtctatatatcatttgacagaatactccttaaaaatcttgtaaattttgaaccaccctattgctttaagatttgtacaggcaatcaaaccctaaaaaaactctcctttcccgattccccctcacgccgccccgctcctcagcgtgagcacattctgcgccgccgcccggcctcgtcggctggccggaaggtgtcaacggcgctggaaagggcccccggccggcctcctccccctcatcctctctctcccacctcacctccctactcgagctatcgaaagtgagatgctcccaacccggcgtcttcctcgtctccggcgactcctcgccaccggatctaccaccataagctcgctatgcccccgccaccaacaccggcccaccaccctactccgtcctcgcggctccgccggcgcctcgccacccgcccactccgacgcctaccgccaggccgctacttcccacgaccatccctcttagcccagcaaactcccccttcttccccctccccctcccacccctccctaccccgggaccctaattcatcagccctctgccagagtttgggttgtcgccggtgccggagaagaagaggagttcgccggagttagagaaagtagttggagcacgaatttataaattacctaatgaagtgattagtgaaactagcaggcggcagtcgctagacgttgctttaggctcggcctccacgctcgcctccagttgtccgcctcgccgttggttgctgcgatacgtgctaccgccgcccgcccgctcgatcgcaggctgccttcgccgtcttgacgcacgcacgtgcaatatgtgggaattatatgatgaaaccgctccttcgtttatgactcgtgacacctcgatgcacacaactaacgcatgcgatcttcaatcgcttgatgctcacgacgcatcagttttgcttctacccaactctccccgtcccataaaaaccaatctattactggaggtaacacattctagtattatgaagctctcattagcatatcgccaggtatgtggcccaccctaggtggtggcgtgggccccccaaaaattggaggccctgtgcggtcgacgggttcgctctcccccatcgatggcactgtgtggatacgggtgtgttgtgagcgtatattttgtaccgtgtgtttctttaaaaaaaaattgtcctaagctaaaaattaagggccatgtgcggtcgacgggttcgctctcccccatcgatggccctgcatggatacagatatgttgtgagcgtctattttgtaccatgtgtttcttaaaaaaaaaattgtcctaagctacgagctatagctagtgacaactgaccagcatggcctgttcgtcgaagccggccgtacgtgttttgcgtgctatggactatggtagcctgttgcgcttgcgcgcgcacctaacgttttgtgcgcgtgtgcatgcgtgcgacggtggtgtctgtgtgcacgcgcgcgcgtgctttgtgcgacgtttcgaagggacgtgacaatgagaggaggaagagtacagtggacatgcgtacgtacaaactgatgatcgatgcacacagatcagattttacatgcagccaacgggtgcttgtcagtttattacgatggtggagatattaatagggatgaaacgtactactccatcctataaaaaagcaaatcctatctacgaagaggaactgaagtagttgactgtccgtgctgactgacggagaggttaacaccaagtgaagcaaaagggtcgacctaactaccactctatatatagcctggaccggaactggccagaattcgtgagagatcaatcgatgtcatgcgtgttaacttggcttcaaccatgcatttttgccggatcggtgaatgtaacaccactcgatctcgctctcttggcaaaatggcaaccgaaatcgaccaacctggcttcccccttaatttgatcccaaaaatatagggaaaggtcattaccacgaatattatatatgatccatccatctcgttagttcgctggttgccgtcaatgcgagcgtacgtacgtctcatgcacgcgctgtagatagagaacgacgtacctctcctctcagcagtgtacgtacagcaccggagtcgctttcatcgataaccattttcacatgactcgatctgtacaaaataaaaaaaaagtcgggaattaccgtaactattttgctgatcacggtttatcctttcgggggggggggggggggggggtgagacggacgatgattacaaagctgggatatatattcgctgtacctcatctgactatcacatcgcagctgcaaaagaagaggcactatatatcgtgggtgtgacaagggaaggtgtagccgagaagtcaattcgaccgatcgagccatgtctcgagtggttggccggctcatggggtctcgattaagattttcaggatctgaattatctgtagttggaaaactaaacgacaatatagtctactccctccatcccaatatattttacagcctacccattctatgactacgaatctgggagtagctagctagctctgttcttttttcttcgtaggttgactcttcgccgtggtcgccattggtcagcatgtcagcataacatcccgtagtaccacttggcacaccgatacgtcatcctattgtagaggtatgtttttttttaaaatttgttcaatttcatataggctgcaggtaggtgactaatacgataaagtaaaagaataacagtcgcctgatgaataaaaaatgtttatcattaatcaaaagctataattttttaaagaaatttattctatttttctatatctatactatgtaaaatgttagtagtggtggtgtccattcccacaccacccctacaactgacatgtgagccccacaatctatattattacatagtcttttaaagagttatctctcatttcactattgattttcctcaaattttaaaatcatttggttgttcaataaggaaaataatattattacttggactaaataagctaattgattttttttttacgaaaaaccagcaggagaggctcctactgaaatgcattgccaatagaagatatttacaatcccaaaaagtttctgagagggagaagaagaaaaaaagaaaatagaacttaaaagaacaattaattgatttagcctagttaattgatttaccttattgattgatttagtaaggtagaaactcaatttgttttccgttgcaacgcacgggctttagcctagtatgatttaaatttcattgtgacatatcagaatttgatcttgtctaaatagctcgagatgcagagaagcagctggtgattagccaccaggtagaacattgggtttctcatattatggcttgtattattattattattattattattattattattattattattattattattattattattattattattattattattatgtaactatggaatgtcagaatttagatgataatctgaactagttaggagtgttggagattctataaaaaggaagatagaagctctcctaaatagggtattcaactggtacatcgttgaaaaaagtaagctatatattgtaactggacattggcttattttttctctctctctctctctctctcatgtttatgataatttgtaaatagttactactccagtctacaatatgaaagcaaggatcatctaaagcatctcgcaatacttgtacatccagatataagaactaattaagcacaactgcgacgcaggaaacatcataaaactaactttagtaacgctacccttgacccaatttcaaacaagtttcaacagaagcagagatatgaagcttcaagagttgaaatataggtcaggtgaccatgacttctatgattctcttccaagctctttcactgtgaacctgaacagagatttgttggcaggaaagctagagaaactgcaggaaatggaaaaccatcttatagaagtaatatttatctacctaatatctatgcagtgtttctaaaaaaaaaatctatgcagtgtttacagcgtcacttatcttaattctccccaactaaaagagattccatctatcctactcatgatataaggcattgtcttcaaaactaatttttgagttataatctttcatacactataatatctgtagcaaggaaactagctataatcatatgaaagtaaacttaaaatgtaaatccagcaaattaaattcaattcatattataagtcaaatgttttaaaattaaatctaaaacatgtgcgcttatattatgggataaagggagcagcatatattattcttaagtcctacgagtattccttttttcttcaaagagcatatacaatcatcagtgttttctcatctgaaacgaaagggggctacaaccaaaccacacgtattgagtattgacactatagttgtacaccaaccctgtattccaaaaatataggtaatctttagggggggtccagctttaaaaaaatggctaggtaagtgaattgcgcaaaagtaatttaactgattttttaacctgacaaggaactaataatgaaatgatcaactgactaaagcatcagattagtaagtgtactattaacagtttttttaagctggattgcattctaagttggtcactagtttacctaacaccctgcctttaaataccacacccatccagtgtctgaatctgcaggcctaattaattaagctgagctccactgtctccactctccggtacactacacacgtaggtatataccatccaacatggtgaaggaagagcaaggtggcgaggtggccatggccgccgccgccgccgtcacgacgacggtggcgccggcgctgccgacgcaggagcaccggctgccgctgtcaaacctggacctcctcctgccgccgctcgacgtcagcgtcttcctttgctaccgccacccggcgccgtccgcggcggcgctcaaggaggcgctggcgaaggcgctggtgccgttctacccgctcgccggcgaggtcgtggccaacggcgacggcgagccggagctgctgtgcagcggccgcggcgtcgacttcacggagtcggtcgccggcgaggagatgcgcgggctgcggattggcatggtggacgagcgcgtcgagaagctggtgcccgccaagaaagccgccagcgtcatggcagttcaggtatatatatatatgggagaaaatatatttaccggaagccccttttttttaaaaaaaagttcaaaaatatgaatttgatctaccaactaacttaactactacttcctctgtttcacaatgtaagttattttagtaatttccacatgcatattatatctagatttattaacatcaatataaatatgaaaaatgcaagaatgatttgtattatgaaacggatggagtactagtatgtgaggataattctgatctatcacatggaaaaaaaaaataaatgaagatgctgtttttctggaactggagagctaattaatgaactaataagctggtatatatatatgtttccagcatatataactgaatatcacatcaagttatcccctcccctggacgttaaaattatgtgggaaagaaaatgtgtgtatgatgtcaagcaagcactggctactaattacacatatacttacgtgctttacgtgacatggacgtacctaccgcatatcaacctactacatgttttctttgagacggagaacatgagagaaaaaacgtagacttgatatgattcatgcatgcaggataaattacctgaaaggtatatctatcgacgaattaactaattattatcatattgtttgacctgttgtggtacaaatggtcagttctttgacctgcactaatccacatggttaatatacgtgcaggtgaccaagttcaagtgcggcggcgccgtcgtgggctgcaccttcgaccaccgcgtctgcgacgcctactccttcaacatgttcctcgtcgcctgggccgccgccgcccgcgatggtcacggcggcggcaccgcgccgcctccgccgacgatcccgtccttccgccggtccatcgtcgcgccgcgcgacccgccgccgccgcgctcaccgtccaccgacgcgctgatcgaccgcctgttcgcccctctcggctccgcgcctccgccaccggacgacgccgcggcggccgccgtcaaccgcatctaccgcgtcgccgccgccgacgccgcctccctgcaggactcggcggggcccgggcgcacgaagctggaggcgttcacggcccacctgtggcagctcaacgccagggcggcggcggcggagcgtgagcggccgtgctgcatgggcgtcgtcgtcgacgggcgcggccggatgttcccggacggcgccatgagggcctacttcggcaacgtgctgaccataccgtacggcgtgatgggctccggcgagctgcgcgccgcggcgctcgccgacgtggccggcgacgtgcaccggtgggtggcggaggcggccaccggcgaccacttccgcgggctcgtcgactgggtggaggcgcggcgccccaagccggcggcggcgagggcgtacctgggcggcaccggcggcggcgacgcggcggcgtgcatcgtgtcgtccgggatggggttccccgtcggcgaggccgacttcgggacgggcgcgccggcgttcgcgtcgtaccacttcccgtggcccgccggcgccgggtacgtgatgccgatgcccagcgcgcgcggcgacggcgactgggtggtgtacgtgcacgtgtcgccggagttggcggtggcgatggatgaggagcccaccgtgttcaggtcgctggacaacagctacgtgttcggttgacaaggccatgcacgacaaaataattaatgtctaattataacgtgtctatctttttttttctttcgaataagagaatgtgtatcaactatcgactatcgtcgtatgggagtagtagtgtgttaagggtggagtaccgtgtgatatcgccagatacatcaatcttggcatgaaacagtgtgtgtgaaaaaaaataaaataacagtccatgcaatgtcactgtaataactagaaagtgtcatgtaattaacgaaatctattcgaaatctattaatctttgtacgttgcacgtaaagaagtgcagaaacgcgcaatgttgatggaacgttagttggcaactactctacgacgggatggatgtgtcaagatgacaaaaaccaaaatggaaatgctaggaatttcagtcactttcaagttccacaaggaggcgggcaggaattcgaagagataggaaggaaggagatagcgaggactcaaccgcgacgacgacgacggcgagctagccttggccgccagtggcgctggcacccaaatcccagatggcttttcttcgagttaggattttcggacttggagaagaggatgggagaaggatgaggcggcaggagcatcagattttagagtggtttggccacaagggtagtgatggtgttgagtctcgacgggaagcggatcatctaacgtgaactcctcctgagtagacctacgagcggtggagttcacatgtcagtcagcacgttcctttgactccaacgtcagaagatcacaatccgtctcgacggtgagagcaggcaaagacgggatagacgagtagggtagagacacctcgctactgctcaagcgttgggagggtggggaggtgtggtggaggtcaggtaggcgctagggttgggtcgttggaagtcgctgcagctggtgcgctgacgcgcgtgacctcgcgcacgtacgccgccggtgtcctcgtagcctccgcagctgcgcctctccgatccccgtcgttcgtcgcccgccgagcgcgctgccgctgtacgcctggctgctcgcgatccgcgaagggtggagtcgtgcacagaccaccgcggcgcagcgaccgcgcgcatcaccctgcggcgccggagcccaggacccgtggctggctctggccctagcaagcatgcgtgatgatgtaaaaccagttgccggtttggatattgtgagttgttggatgcgttgatagaattttgtcctgacgaatgattaagccgtcatcctctgatttgagttatccattgttccactgaaagtctgaaactgttctagtgttatgctgttgcattttttttttttttgccttgtttgctgcatctctcatttgagatgtggaccaatcaaatgcaagatacgttgaattcaaagaagggtgacaactgacaatacttttcaacaaaagggcttctctgtgcaatcgactgttattctcaggttaattttgcatctctgcttcttgtgctatatgggcttgtgggaaatgtcaagagggttgcatgatcaaatgtaactacagttcaacatagtatgaacaattccatgtagtctactgagcctttgtttagcctttgtttagttccaaactttttcttcaaacttctaacttttccatcacatcaaaacttttctacacacataaacttctaacttttccgtcacattgttccaattttaacgtgaactaaacacaccctgattttcttttaaaaaaatgtttgtgaacttgcttttaagttagtcgattattgatgatttgacattacaaggcactattgctatatttgtatcgcccttttactaaatttgtacttatgcatgggtattacggtgttaaataattagttatgtatgtgaacttgcagtggccgatcaaaataagttctagagcctggctaatattattaagtatttgctacgaagattttgcttctaattcatcgaaaaacattcaaatttcattgtgcagggttgtcgagcagtaaatccacccctgcgaacttgtgaagtagaactatccaatgaaaaatttttagctacaccactagagagagagtaggtggcacgtgcagcgagaggaaaaggttgtcttgcacgaaaatttacgcaatctgaactgctcaaggcaactaaatttataggtattttcaagtttttctcaaaaatactacaaaacagcatatcgttccaacgttcaacgaaataactgttgtcatgatgacgtcagcatgatacctacagggtgtcgacgattgatgtcgcgattctggtatttgcatagtatggggatcgtcggtactagggtatacgcgagactgaggtaaaagagacggagacagggatttttattcaggtttgggcccctgaattgtcaggtaataaccctacatcatgttggccgaagccggtattgctcttattcaccataatcacaccagtactatatttggggtagcctatccaactgttgtcgacatgacggtttgaaggtctgactcgtagtcgacaacagggtagtctttctctttgagttcgtgctcggcgagatcaaagacagcgcaatgtctctcctatcagtatccggagacaccgtaggggattagccgtgcctatctccgaagtcgatatccggcgtcttgtcttgacgtatgttggcttgtattggcttgtggctttgtggcgtctatgttgcccgtgtctgttgattgtgtcttctatggtgggtgtgtctcctctcctcctagggggctttgtatttatacccataggtgtccccttgtctaagtagaactagggaaaccaatatgcatacaatccgagtagtcctcgtcgtttccatgtagaactctggttgtccttccttatccggaactcctgctatatccgcagattgtttccgtataggacatggtatgtggtgggtcctgccgagatttaatcaactattattaggtatgtggtatccataaccttgacacagggtatcatgtctagtaccgaaggtaacatgataacgtgatacctacgagatactccctccgttttttaatagatgacgccgttgactttttcttacatgtttgaccattcgtcttattcaaa

SEQ ID NO: 70366 - DNA, 28749 bp, Oryza sativa
catttcgaaacggagggagtattatatcacctttaaagcatgcaaggccatcccaagatagcacataagaacagaagagcaaggatttatctggaatgcccttctgaaatgatgctcagcaaactcaaacttttcctggcgaaggtacaccactccaaggccataccaggcattgtagtgtctttcatctacctgaagtgcagagcggtatagttttatactgttctcataatcctccaatgcagaatacctacagttcaaaggaatggcagtatagttagaaattttcgacaggtgatctcaaacattaatacaagataagaaactcatatgtgcaccagttataagatagtgtgaacgaaaacatactcgtgaccgcatagcgtgtgagcgtatgcaactcttgagtcaagctgtacagcacgttgaaaattcttcaaggcagtctcatgatctttcctcaaggcaaagcaatttcccacagcacaccttttgaacatttaaaaacagatacattagaaaatgtaacacaatattatgtcagcttaaaagcatttccactaaagatctgtaattgtctccttgcttcatccagatgttttgcacagcatcaggactaagacaaagttatcatggactaacaaaatcaatcaagtagatgtgttgctttaacatctattaattactttcagtaaagcacatttgcagagttccattttggcatttggtccaaaatatcattcacttgctgggcataaaaagacgaaccatgcttggggagatagtcgatcaatagaaacaagatcttgagcaaggtaacttagccgcatttcctcattcaaatgctgcaaaagagaaacaaagctggtgaaattggaggcaaaaggtgggaataaagtactctcaagtacaagagcagttagtccacttacataaagaacagtggagtaaatgtccattccctccaacgtgcatggtgatagtcgatgcgctaactcaaaaaaatgatcggcttctaaataattgacgagttcaaaatatgtcttcccaacctgcaccgttgaccaaaatgaaaacaatttttaattgtgaaaaggaacaaaattacagggtactgttaatatctgtacagtgaaaaaaatattatggcgtgactttttattattaagttgagtatatagaagtggaaatgaaataccagatgtagagtggctcatgtgcaagtaaacatggttatgctgagtgactggaaattccaacaatcagcattcagggccaatgttcaactacagttcaagttatcattttactaatgtcaattctccagattgacccaactaacatatatacaattaccataatgaattcatcacattatcacgtatcagattaatttaaataaactcgtagtttcttttagaaaacgaggaaacaaatatgctatacattacgatacagaccctgaatcattactatacagtccctatgcctcatgccctcatgaataacgtagatacactcatacaaaaccagttttccaaaagttagccctaggagcagagtaaccaccccaattaggcattagattgtcaattaggcggcaaactatccatgaaggttctggtgtagctattttagtgttctattgtttaacttctatgtcatatacttgctaattgcttgggatttactaatcatgttggacctaggctacggccctgcagaccctctagcgcctaccaccttcttgaaccatgtacaaaactaaaggtttttcattacaaaatcaaaagcatgaagataagtcgccaaccattttgcaggggctgtacctggcaaagaacccatccagtattaaattgtgcctctgggagctttctatatacttccaatgcttcctgatcattaagtgaatgaaatcaaccacataacaggatagtaggttagcatttccaacacaaacatcgtgaacatacctgacacttaaacaagcaagaaagcctatacccttcccctagtgtccgcaagagtgccattagctccctgataccaatagctaatttggagtcctgtgacagaactcgttcagatttctcttgctcgggatatcttccatcaactatacttgtagaagacgaagttgaagttacattatctgtccacatttcatcaacaacgtggtacctgtttcctatggttcagaaggggaaataaaaccatcgtgaatattaatgcaccattcatatagagaaagctgatgcgattattatgataattataatttcacaaaccacgtaattatgatatcgaaaaggataagttgatggattggatgatcctgcatccagtgaaggagaaggatgtgtgatcattttaaaagtcttaagtgttagggctcttgaaacaggattcatggtgcaagaaagttctttcgatttttttttatcacaataatcaggaaaccctatccataggagtgaaaagttcaaacaagcaatgatacagtaaaaatgtatgaatctggatgtaaatatttatgtattttaggaataatgatctaacatgaggcgccaaagaaaaggataagcaattctgcagttcatatgctacatgaagaagaaactaaaaacaatatgataacggagacacttcaagggttgaatgatagctgataatgttctggtggtattatagatgcttaaaatttcagctcaataatagagatatttaaaaggtatatggattaacatgaacagccaataaattcggtgagtagttgcatgatgtttcttagcatcctaaatgccttgtgagttgtggcttggtgtcattattgtacttttcaagtacaatcaatacaatattgatgagtgagttttactaatgtgaacccattgcacatgaacatataagcaaacatgcagatatatcctgattgcagtgtctataacaacatatcaaccacattttttgcgaggcttatataatttgaggcttatataatttgaggcttatataatttgatgagtcatccatgtcgaaatggtaatcaccttcatcaaaattttctgttgcctgtggtttccctttcctaacttgcacggaacgtagagctgttgaacacaattttgatggtgtggacgagtttactcgcaatttacctgacgagtgatctgttccattccctccaaattgagagatatttgagtttgagtttattgttgtatctctagaaagtcttgcacttcttcgaggaactgaatcactactctgattaaacagccttccagaaacctgagaaaataatcttttaactgagaaaaataatcttttaagtctggtatcatcacaagtcaaatctaaagtggggtatgagcatggtgtgaggactatcaacagaaagaacataaaagagactatacagccagacctcaaagcaacagaacaatagaaacataggtccaatattagacgagatgagctctaacgaaggcaataataaatcaaagatgaaaagaacgaaactacaaaaaatatttgctggttccacagtccgtactacatggacaaacctgtgaaaacaaaatgaaaacaatgataatatcccactattattgaacaaaaagaatgctgatggaaaagtgaagaacgtaaggcgctatgcaaagatgaaaatgaggcaacaatctagcagctagaatgttacaaaaacaccatcggagatatacttcaaagttaatgaatggtaaactatcaaaaattgacaaatcagctattatcaggtaaactatctcgtcgctggggttgggtgttggtacaaacttgatgggtagtctggtactgtcaaacagaactatccatagtcaatgaatcttaattaatgggcaatacaaactaacaaataaaaagaagaccgcaatcacaaactttgcaatgcagacgcagttaggtagaagcaagggatcaacatcttgaatcctgatagaacagccatgactgaaactctacagactcatacaaccagcaagtattaggctgtaaatgcaatgagccaatgaatactaatgcattaacaagcaatgctagtatgcacatctggagaggatcagcaagtatgtggtttactccaaacacgtatcattttccgagaggtttaatctaacaatttaaattattgaaagaggacagtcgaccgagagaaacctagaagctcaagagatcagtagaaattatagaagttgcaagacagtatctttcagttgaggaaacaacaaccttctttaggcttgcttcatcgatgtatttttttcggagtgtcaggttcggagcattaacttttggtttggaaggagcattgccacctgctgtattctgataagcatgcatattccgaaagagtggtggtggagcaatgccagaagcctgcaaaaattaaattaattaaatagaaaattgtgatagcgcaaccatagatcacatgtctttacactgtattgtgatgttgtttaaagtgtgctatatgcttctgtcactctttcactgctcatcatcatatccaccatgaagcatataacagtgaaccaaaagatacaaactttgctgtgagtataatttgatttttcgctttccttttccttgtgatttaacatttggcagattatttacatttttgttactcataacatgtaattagtttgattttgatttttttacacctagtcagagtaaatgagaagtacatcaagaaagtgcacaactgcactacaaagggtatgttgcacttcaagagctgctgtctaacaccaagttgttactcttcatgtgcaaaaaggtcaactgaaagcatgtgattcagagaaacaataatgacaatatgccaaatctttcttgcaaacaaaggtaagaagaggatctagataaaccaaatgtgcagattctggagaattcctcaaagtacgaattgattgtatctggttaatcctactgggtgaagaaccaaacaagttttgctgacctgcgttgaagttggcgatggagtgtcaaactgtgataaattagatggtgcaccgttctgcatatgcaatgcagttgactttacatgaggataaccagatacttctgcagtggtgttagcatgcagctgtttaatttgcttaggactatcaccaaaacttgctgacacattggaagatagaaaccgattttcattaacaaagtttgacttttccacatttgatgtggatgtgagttcctgctgaagacgtagagctgttgcttcactgaaacattcatttgcatcttcagcaacacctacaagatagttaattagtgacacacatggtatatgcttgcttttatatttagtgagtatgaggccttcaatataaggactactgggccatagtgtaactgcaacggtatgcaaaaataataatgtatcaacattaggcatatcaatgggcatgtatggcaatgaactaatccctgttttttttataaggtctctaaatgtgaaaatcatgataacaagaaagtactttcaaaagtgaatctaatgacaccaattctgtatcgcagcctctgcatattgttggactatttgttggtcaaaaaatcgacagagggagtaatgaacataatggctaaaaatattatgcctgtttattgatctatcaagctaataatgaatgacagaataaaactactatgatgcaaaacacataacaggcctattgaaggtctactgcaagtcacatattttggatgacgtgttcttcttcagaaaaatcaacactgtacttttcatttcctactactagacatttaggaaataaatctttgtggtgaagcaacacttgacgcatgtaattctaatgtataaaactaggaatggaggtgctaaaaaacttcactcatagtgtattaacgcaccaacctagtatgcacaattcctcgtatgctgcccatagaagaggatcaagagtcagagcttgtacaaattgctcagctgcagcttccactctgccagtgtacctacatgcagatgtggtaaatacaatgaactatctgacacaactaatggatcaagatatgctgtgattatagatttagttacgagttatgacatgaatattaaacctgtaaattactccaagaaggtagtgccctgttgcaccacttggaacctgcacaaaggaacgaaacaacatataagaaataagttaccaaaataacaatccctcagtttctatttataggtcatattaggagttgtcaagttggcacaagattaagaagagtctaaaaccatgagaaagagaggttaagatgagtagatgaccattctacccgtacttaaataaattcgaaatatagagctgatggttagtgagttcattcgcattaatttaagaggtattatgtcaaaaatgagggtaaacaaggaataaaagcaataaactcacatgcattccttatattttggaaaagtattgaagaagccttgcaaaaaagggaggaagtataacagtaagcaaagatgcaaactgattttttttccacatcattacttcacccgtgtggaatcaaacagttagtggacaacctcaaaatgctgtcatgcacccaaagaaaaaaaagatgtctgcagacgtttctatgcaagcaaaacatcaacttgtagtgacaatgtttctcgtgtacatcacttaatcatacatgcatattttcttttaagacatgatacacttcttgttttcacattgataacattgttgatacgatttcattgacaggcaaccaatcttaatgttttcaaatggtatatcaccagttttggaactcttaattcatgaataatcaaacatgctgcacatcccattttctacttctgatttggaatccagaagacaccatggaacaaatgatacatcatgcgaccccttgtccagaacaaaacttgagttcaagcacttacgaaaaaattaagagcgttggatgaaatatatttcaggaacacaatgaacaaataatgtttaaaaacatgctatatacctcaatatttggttcattgacaggacacaaggcttcttcagcttcccgtaagaggttcattcggaagcatgacatagcaaacaagtaccgggactctggcagcttctttcctttatgttatatcagaaataaaaatcagaaatcgctccaaagaccaaagcactttgcgaccacagaataaaatatactgaaatcacaaaacaggatagaaatgtgcccaaaaagatggacagatactatattcacatttctttgatttttaaataatgtgatttcacttctacacaataataagtggtcacgtggtgagcatatgttattacctttcaagatgtggtatgcagcatatggctggttgttgtgaaggtagcaagtcgctagcaactggacatttgtctgtgcacatgagtagtatacatttagtacaacatgtgatcctggtcatatacgaactaagagaacaaaactacacgctatcagcgatgagaaaactgaaaagactcttattacagcaaacaagtatcggattcagtttactcactatctagcttcatctcaataactgccaaacaattaaagtcatatacaaaagaaaattgaacacatgaaaaaagtaatatttggtctgcccaaacatagtcctactcgaattgttaaaagctaaagcagctaaatccacacactccagtagtccacgttgcaagatactccctccgtttcaaaatgtttgacaccgttgactttttagcacatatttgaccgttcgtcttattaaaaaaatttgtgaaatatgtaaaattatatgtgtacataaaagtatatttaacaatgaatcaaatgatatgaaaataataaataattacttaaattttttgaataagacaaatggtcaaacacgtactaaaaagtcaacggtgtcaaacattttgaaacggagggagtagcatggtagtatgggtagctaactacatagtattaacgtacaattaatctagcctttgcaacttacaatggctagtgttctaaacacccagtaaaataataagatgtaacacatcaccatagctatttcccaaccaaatcactaaaacagactgcaagagtgaaatcgtatcctatcttaggccataaaagtctttcggcacccagattatccataaaccctatggcaaccaattacagtagctctagttctctacagactgaattactgaaaccacttccccaaatggctaaatagctagaggaagcccttctcattcaaccttcccatgaacttggcccaaatctcaccactgaagctccaggcgcacgcctaaacactaaaacctaaacaatgccaataaatcgacccccccggcgcaggcgagcgcccgcaccccaaatcgccgcccccaccccccgaccaagcacccgatctgaaccgcgcttactcccagggaaacacatgcatacctcggcggggaactgggcgcagaggcgctcgcagaggaagacggcgttgcggtgcatgaagaggcggaggctgccgtggacgcggtccaccattagggtttccatcgccgccaacgctccagcggcggcggcggcggcgatgcgtgtcgggctactgcggcggcgcgcggcggccggcggcgagggtgggcaccgtttgaatcgaggaggaggagaggggaggggttgggttagattcgagggggatttttttttttttggtgttgtgttgggatttttgatttttttggattggggattcggacgaacggatcggagtttgggcttgcgcctgtgcgcgttggtgtgagtgagtgtggcgtttgaaatggtgggctgactggctggtgcggtggtgctggcgattagagcggcgcgggggaaccgcggctacgcggacacgggggatttgtctggtgcgtctgtgacatgtgggacccggggttggttgttttgaattgcgccactgtgatgtgtgatgtggggcaggctgtgtgagatttgaatttggttcaagtttaggggctgtttggatcattggatgggagggactagactaaaattagttaatctcatctaaacagggcattagccttaagatccaaactacaaccttctagatttccgttagcatgcttcctaaattgctagtataaaatatgttttgtggtaataattaatactcaattaatcacgcactattaatgatttatctcgttgcgcgagccaccgaaaatccccacacaactgctgaaacaaacgcacccttagagcaagtttaatagtatagccaactactagctacaattcatctatagccaatctaatattcccttcgtactcataaaggaagtcgtttaggacaatgtttaagtcaaaacttgggaatataaatcataaataactctcaagttgttgagtttgaaaatgtaaaaattatataaatagatttgtcttgaaaaatactttcataaaagtatacatatatcactttttaataaatatttttatagaaataagaagtcaaaattgtgttttggagaccgtgtcgctgtcctaaacgacttcctttatgagtatggagggagtagttcattcatacaatagttacatactacactattaatacatgatcccacctatcatacacatcgtgtcttggagtccgtgctacagctagttacaaatctgtagcccgctgcttttctccctagctggcttacttatagcctgctattgtacctgcttttaggcttcgccgtgtttggctagatcgtgttctttatggatgggcacggaccgaccatgcactcctcaacccaaactcgtttatttagttaaactataatgtaatttaccttacgattatgccgtaactcagtgttcagttaaaatataatggtgacaattgggcaacacaagtttgaatttggaattaaaattgtattgcctcactggggctttctttataagtacaaacacgtggggcgcgttcagtagaactaagtgataaatgcattggaggtattgttagtcatttgatctcacctctaacatgtgtaaaagaacatgctcgcatgtgtcttgactcttgagtaagggtggtggtgttgtgttttgtgtgtctttaaagggttgtttgcttcgatctcatgtattggaggtgttagtcctttgatctctcctttagcatgtgtaaatgaacatgcttgtatgagtgtggagcgagtgtagtggttttctaaggggttgtttgcttgttgcctaagtttgcacaactaatgttcggtgagtatgacataatatagaagtgcgcccatgaatttattggtcaccggtattgcatggttagcctagaaatttaagtggatgattcatgagtccaaatttagaggaaagtatagtaaagctaacttatgacactgaagcaaagaaatgtataataaactatagcatgactaaaatatgatgcggtaagatgagaccatgagccaaacattccctaagtgcacactaaaagtattcttaatggtacttatttataagagtaaatttcacaaaattatagatacttggaccaaactatcacaaatcaatagatttaaggtcttatatcacaaaactacagatttagagcaaaatttttcacaaaactacagattttggatggagtgtcacaaaaataaagattaagtagcaaaattgttacaaaactacaggtttagtgtcgatttatcccaaaactataagttctaacataatgttagtaccatggatttaaactctaaaaattgtagttttgtgataacttaaatattaaatatgtagtttcatcataacttcagtataaaatatgtaattttacgaaacttggcattaaatatgtacttgtgtgataaatttaccgctaaatatgtagttttatcatacaacgtcttcaatctatagtcaaaatatctgtagttctatgaaatttactatatttataaactcatggcatcatgttgttcatcttgaccggcttttattattgcttatcgaatcatttttctatgttcatcttggtttctacctctgatatctttttggcttatggattatgaattatcataggtacacttttcaagctttaaattgtactatttctttgaactctcttcatcaacacttataaacatgcctctttaaattagcttttcaaatctataatatttagttcgttcgtttgtgtcctctaattgttataaagtcaactttatccatcatccatcagcactttagaacaagatcttaaaattaatttgagaaaatccactcgaacatcgattcctcgagtggcgactttacaagtatatggttctcagaagagtatatgggttgctataattccgtttggttggaggaagtttttaggagagattgggagtttagagggatgatgctattaactgttttgtttggttgggagacatgagatttttggtaggatggggatggggaattgaggaagtaactccctccttttcaatacctgggtaggggtggtaattgcgagggaattcctcctttacttagcctaaacaaatctcaactatccgttttcaataatgaactaatctccaactaaactccctaccaatttccaccacctctaccaaacaagatattgggattaaaaatcaaattcccatctcaccatcaattccctcgtgtaaactcccaatccccttccttcaagttgccagacaagcctaagtcatttggttggagagatggactagttttcatgaataaaccaaaatttaactcgcttgctagcctggtactataaaattagaagagtaaatttcacataactacaaatttcttgtcaaaactattactttgctacaactttagttagacatttttcaaagctgcaacaacaaagtattttcaatcccctatcaacctatttggcaagaaaagggaaaaggaatgggagtttgaaggagggagttgatcgtgggattggtcataggagtacatttttagtccccatccattgtttggtttttgtatggaattccctcccagtctcatgaattaacaggcctccccagtaagagatcggtgggagctggatcccttaattctccatcccaaaccctctcgaattccaagtctttgaaccaaactacaaacttaaactcctattccctatcaccaacttcctccaactaaataggacgtatgtttttttacgtcagcccaattttcaacagtgtgcctgataggtggagccggttaaacatttgtaattctctggtaaaatcattgatgcacttttgtgaaactctcagctgaagttgaagcaaatactccatctgtcctaaaatatgcccatatctatagtactatatggtatcttcataaggaaaccagattcgtgcatctttcttaaaaccttcgtagaagctgcagaaccagtccttgagcagctcgaccgacagctttgctccaacatcggttggtgtggatgcatattcttcatatgacatgcatctgcgatgggtgcgctctttttcttcatcttccacaatcggctctggcagtgggaattcagcttctgttacagagggccgattgacaaccttcatgactatcaggtttaaccaagtttgcagcagccaccatggtccacctgctccaactactgagccgacggctattttagccgatgcattgttcaacatttgatacagatagcggagaagtattttgcccaaagggaattctttctttgattctagggcttcggctacaaactgccagttggttatagggccacagctggatccacagaagaggaacttttccagccacataagcaagaaagctacatgctctcgaggggtaacggatccttggcccatatatgccgccacatagccagactaaccacctatgcttttggtcttgaagtcaaattggttcttagtgttcatactcatggggttagccgatgaagtcacatctaatccagtaatcatggtgatgtcgattaaagttggagtcatcggcccttggttgaataagaaagcattgatggtattcgaccagaagtaggtggtggcagccatcagaggttcatccttaacagaattggctatggtgagagcaagtgcttggccgattccaatctcatcccagtgaactttcttactagccgatacgcgttggtaccaggtggtccagctcttatcaggtgtgggtttttcgagatatggccaagacttgaaggtattcttccagtgacccaagtcagggttggctagcctgaaggggatccggttggtttcaccaatgatgaaatcagtggggtcgagattgccgattgggctgagaaaatagtggtttttgtgtgaaaggctgggaatcgcgacttggtttgagagatgctacaaatccaagacaaccgagagaaagagagcgatgtaagataggagaaaatcgatctgctgctaagaaaggggatctagccgatggggacttacctcagcatactcggctgatggcgcattagatggattggtggaagacgacatcgctacaggcggaggtctcgtcggagatgaagtcgcccgggagtcgcttttgcgtcggaggaatcgccggagagagagaggataaagtttcgcttgagcggtgaaaacggaagtcacggtgtgagattcctcgagggtgacggttagtatttaaagcacggcaataatggtcggaaaacggcaaagtgtgaaacttgctcggagttgatttacagcaaatccgaaacattaccaaatattccggacttagggggcatgtgttaacaaccaaatttggtaatatcggcattggaaaggaagattagattgaagcgaagtcggaggcagagatcgagttcgaaaacagagcagggatcggctggagtccagatcggctacgatgagatcggctgagtctgggtcggactaggtaagctgatgtagccgatcctagcaatacaacttgatgtgtgatgtcgggttggattgaggtacttcaaggtgattgccgcacatggataaagtcctgaggaggcaattgtatctattaattaggatgttttatgtaatttccttagagatatgattgggcaaaagtctgccgcaaagacttatagtatcttagagtttgttagagacagtagtcgtgtccgttatggacatatcttgtaattctcgggtataaatagacccgagccctatgtaacttttaacacacacgttcaatacaatttcggcgcatcgccacctttttgctttagttttatttcgacgagttcttgctttcgggttgagctgcatcggtttcgatcttcaacaagaggtaaaacttgttatgacggcttgcattctcgggattagtgcttccatctttatgacactctaatcttgtttatgtaattcgtcgagttatcatatattttatataatctctggcaacaccgctatctaatctacaatcggctaacgtccgtcgaagagggcagtcgattaggttagatttcgacgttgacctagattatataagatatctaccactgtatgaaacttctagcggcttgattgtctagatattgatattcttttcatacttaatgctgcatcagttgagtttgatatattaagtcgtgcttagaatatcaatctctagcctgctttctggttgccaattagggtagcatcggagtttcagccgatcttatctgatttaattatatttgctctatatgttttattgacatgttaaatctgccctttatgccaagatattactgtatttgaatatattaggcttttgcttgatattctatacctgttttaatatcctgatataaagtagtatcggagtattagccaatacatgctatatctatctgatcggctatgctataaacatatatagtcatgttattaatatatatttcggtctaagtgatttatactgtctcggtatggcaaccgatctatcccaatcacttgatttaagtatatatcgatataaggagttcatatcgttaacatctacagccaatcaagtagatttagttctttcttacttattcaagattgccgatcgatacacataggacatcggctcaaacataaatgatatgtcatcagcatttagccgatcggctatcatttatagatttaactacgctttctttgcttctatttcttgttgattataggatcaaatcaactggcacgctagcacatccgaaggcgagctttggacctgcactggagttaagcagatctcccaggcctcgtgttttctgtcaacaagtatataattgcaaaattggctccatgccttcaaaagttcccgggttttgatttacacatcgagagtttccgatgcacttaaatactatccaaagtttctattacctttttataccacaaccgttacctttctatggccttgggactccatttgagatggttttgcaagaccaggatgtattatatctggtactgcggttcaaaacattcttaaactcgctgtcaaaattttgttaaacttgccgtcaaaaataagacctaaaatgaacttgttcttagaagtctttcaggacaatattaattaggccaggcccgtttagttcgtacaaggctttttctcggcccaattcctaagcccggcctgaaatatctggacttacatgggtctctctggcccaaaaggcccacataaaccaaacgaaaccacgcgagatgacatggcacattcaagccctcccattggccatgccacggcaccaccccgcgtgggccccaccacctcccttcgccgaaactttcccctcctccttcctcccgaagcaaaatccgagcatctccgacgagtccgccatatttaaacacacccacgagcggcaacccaccgcgagagacaaaaatatctccatcgcgatctccatggatgtagagttcttcgccgacctcgacctcgacgcgctcctcgcctccttctcctcctccgccgccgccgccggctccggcgtctcgggcctcttcgccccgtcaccgccgcacgatgcggaggcggggtcgccggagtcggtgagctcccggcggcccagcccttcccgggaggcggcgctgtcggagatcgagaggttcctgatggaggagggccccgcggcggaggagggggtcggcgcggaggatttcttcgacgcgctgctcgtcgacggcggggaggaggaggaggaagaagaggggaaggggagtgaggcggggggaagcacggatggggattccgggaaggagaatgaggtggctaccccggacgcggagaaggaggatgtggaggcggaggtggatggcgatgatcccatgagcaagaaggggaagaggaggtatgtatgaattgcctaaaaacttgggatttctaaaaatcagggggatttcgtgtgtacaaagatttgtgaatttacataggtagctaggaataatggtcaggttttagttcaacacaattgatcttattcagtgagtgccagaagtccagaaccgcactacacccatagtacattttttttattaattaaaacattatatatgtacatacatgagtatatgatctaatttgtcgtaataagatgcatggtctttttagtgctaatcctttgtgaaattgtaagaaattgctaggctttcaattataagagtgtatggtcttttcaactataagatgttttccgtaatcaaagatgttctagttagacaataatctaatagtatgtgttatgaatttatcaggcagatgagaaatagggattctgccatgaaatcgagggagaggaagaagatgtatgttaaggacctagagactaagagcaagtatctagaggccgagtgtcgtcgcctcagctacgcgcttcagtgctgcgcagctgagaacatggcgctgcgccagagcttgttgaaggataggcctgtcggtgccgccacagccatgcaggagtctgccgtactcacgggtaagacatatcgacaacattttctgtttcatacttctatttcgacatggatgaacaaatcttttcttgccgatcattttgaattgctcagtatgctgacaaacttgtgcttggcatcaatatattcggtgtggtctcatggatgatccgcctaagctaatttttgttgaattcccatgaaatcaaacagctagctattgtagttatagccaattgttgactacattttctgtgtacaagtatgcgtggtttatgcacaaatctgcattgtttatacaataacacttgcttagccttttgttttccaactttggacctaatcagtcaccgaccgaagttgacattaactggaacatggtttctttgctatcctacagtatgcttgagtcataatcctgatgctcctacagtatatttgtgtcataaacctgatgctaaaggtaaccttttcctgtttgcagaaaccctgccgctggtttccctgctttggctcgtgagcatcgtgtgcctactcccggtgcccggtctacccaaccgaaacccggtggctcgaagcagcgccggaagagatctcgcgacggtaaccggaaagggaacaagcagtgaacaacagctagaagaaacattactactccatgggaggcgttgcaagggctcgagggcgaggatcaagctagataccggaccgttccgtttagcagcagctgcttgctaggctgccgcttccttgcaaagttgtttccagtctgtattgtagctagcaaatcaaattggcgtgtctatcgcctgtcgtgctgccgcttatccatggactatctttttctttttttggttccttccccccttgtttttataatatcctcctatgcataatgcattatccaggtagttttgaaatctggctttgttgagttgtttgctggcttctcatcttgtcggaagatttacagttgctcctacactcctacttgccaggctctctggaagtgtatggcagtaaaaaacagatatattgttcctcagcagtatttgccttgatgtgagtaaatgaaacaaataaacaaacaagcgcaaacatagttgatctttgctttccattaatcattaatcgtgaacatataatctaccataaattttcgacagtaaacgcaacttcctgtccggtatgattttcagggaaattttcccatttgcttcagttcattatagttctgtcgaaagcttaattgtatgcccacccaaaatcaccattgagtaagataaacagtttctcgtagctactactaacccgaactgtgattacgcaacacaaacaaagttggccatggtgttgacagttcaactgttcaaggttaaggtcctgtttgaaacagctactgtatttccttagattattgatacgggttgtttacacatgattagtatgataaattagaaaaataaaattcacaaatagcttaggatagacagtctaatgcagcagaagaaagcttctaaaaaaatcatctttttaaaaacgtgaagcaaataatctgtagcaaagatcttagcaaaaatctgggaagacgggctaagctacacaagtagtaaggctgtgtttagttcacactgaagtttaaaaattttgttgaaattgatacgatgtgatagaaaagttgtgtgtgtatgaaaggtttgatgtgatggaaagttggaagtttggaaaaaaaaacttttgaactaaacagggcctaactgagaagacgggctaagctacacaagtaatgagaaacgtttaggggtttttcagctagcttcataagatggtggacagtggtggactagttggtttgggttcgaagtctcaccccattctatttatttgatattaggccattccataaatttgtggtttttacacaattaataaagacaaactaatttctatacgcatagggcttggttgtcacatcggatatacggacacacatttgaagtattaaacgtagtctaataacaaaaaattacagattccaccagaaaaccgcgagacaaatttattaagcctaattaatccgttattagtaaatgtttgctgtagcaccacattgtcaaatcatggtgcaattaggctcaaaagattcgtcttgcaatttccgtcagaactgtgtaattggtttgttttttttcacatttaggacttgtttagttggggaaaaattttagatttagttgtcacattagatatacgggcacacatttaaagtattagatgtagtctaataacaaagcaaattacagattccgtcaggaaactacgagacaaatttattaagcctcattaatccatcattagcaaatgcttactgtagcaccacattatcaaatcatggcgcaattagacttaaaagattcatctcgcaatttacgtgcaaactgtgtaattgttttttttttgtccaaaattaatactccatgtatgttctaaaacattcgatatgatgggtgaaaagtttttgttctagaaactaaataagtccttaatactccatacatacatctaaacattcgatgtgatgagtgaaaagtttttttttgaaactaagggccagttcactttgatgccattttcaaccttaataaattttgataaagttgccaaaaaatagctacatttagtttgctaccaattttttggtaactatataagaaatcatgccaaaatttgataagttgccaaaatttttataatgccaaaatttggtaggtttttttttcatcaaagtgaataggccctaaacgagcccattaagttggtcatgctattattaagcaaaaggtacagtatctacttataatctgaaggagaatcagatgttgggctggtggctgctgctggttctcagctcacccgccgtggtggtggggactttctagaagaagacggcaagtgtcaagacttgtagtttactccgttgatctgctccaaccaaacctcccatctccctcccccctcccctgccacctccacctccactctccccttccaaccacaaccccccatcagcgcgagctcccccagatctccccccacctccactgccgatgacctccgccgcctagcttcccatccaccgcaatgtcgtcgccggctgcgggcgaggccgacgccgccgcccgcgtgctcgcccgcgccctcgacaaggtcatcaagcactcctcctggcgcaagcactccgcgctcgtcgccggctccaagtccgccctcgacctcctctccgcctccccggatgtcgacgaggccgcctccgcctccgcttcccctatccagggggtcgccgcggccccccccgacgcggcaatccgcgctctcctgatcgcgctcgacccggcctcccccaaggtcgccgagcccgcgctggagtgcgtttccaccctcctctccctccgccttctccacggcgaggtcgtagccgtcgctgccgctggcgctgctgacgccgacgacgccgcctcgccggtatccaagctcttcgcggccgtggtctcctgcggggggctcggggacgagggcctcgagctcgccgcgctccgcgtgctggtcgccttcgcgcggtgcccctcggtctccgtctccggggactgcctgggccacgtcgtgagggcgtgctacaacctatacctcggcagcgcgagcggcgggaaccagctctgcgcgaagctggcgctcgcgcaggtgctcgccatcgtgttcgcgcgcgtcgaggcggatgccatggacgtgcgcgtgcgcaccgtctccgccgccgacatgatggacctctccgatcgcagcctgaatgactccagcgtagtgcaggcggcacaggcgttcataaacgaggcaatggaggggagcgatgtgccagaggaggttcccccatcggatttgccagctgaggcagatgaaaatggagatgatgtggggatgagcaggatcagggaggatgggctggcattgttcaaaaacctttgcaagctgtcgatgaagtttgccacgccggataaccccgatgatccggtgctgctgcgggggaaggttttgtcacttgagctgcttagaacagtcgttgacaatgcagggccattctggaaatcaaatgaaatgtatgtatgttttggattgatacatgcttgtgctaattatatccattagaattcagcattgcctattttgttcattaattttgccatgagtcttgatatgtgctaaaagacgataattaaggtggatttgccaaatgtagaaaaacttcagctaacaatagtggatttttttttttggtgggggggggggtaaggtttacgatttggggtatgggagagtagtatttactatttctctagccagatgacatctgcccgtgttgtttctgcatgataggttggccaggtgaagatgcatgtcgcatatgaacaaggcagttgttgtggagactgatgtgtttagaaatatacttttagctatgcatgctttgataagttcttgatcaatctaaaaagaatattcctgatattagatcaattttgtttatagttagagtcagaatcgtaaggaattactgttagataatgaatcttctagctcttccaaatgatataccgattattgagcaactgattctgggttctattggagattttcaatttctagtcaatttgtggcatcccttcaaatcctcaataaatgttccaaacgctggcagaccatgtagagacagtggcgcatgcaccctgtgacttgcagacctgcactgatcatttgttaggaaagaagagcaaatgtcacttgacacttatgaagtcatggttaccaatctaaagttgtggggttttagtttatatgttgatgtccccacttcatgttgcgtattaaatcatttttcatcaatagtttaaagtttaatattcaattcatacatataggaatgcatcaaataattgcacccaaacaaattcatgcatgaggaatttgggtcattccatgtctaaatgttgaactgaatattgggttcaacagaaggtatagctcagtaatactgaccttctcccctactgatgcaggtatcttgaagcgattaagaagcacctatttttatcattgctgaagaacagtgccttgtcagcaatgagtgttttccagcttctgtgctccatttttgttggtctgctgtcaaggtttagatctggcttgaaagaggaaattggattattttttcctatgcttatcctaagagttcttgaaaatgtccttcagcctagctttctgcagaaaatgacagttctaaactttttggagaaaatatgtaaagagcctcaggttatcattgatatttttgtgaactatgattgtgatgttgatgcgccaaatatttttgaaaggtactctacttttcttcttgatggacacacacccttatttttgttttgtagtcaataagaaccattagcattacttctactgaaaatatttgtcactctctttataactttcctatcaataagagccattagcatcacttctactaaaagtatatgtcactctatgatttcttagtaaagcaattttaattccatcagatcttcacaggattgtcaatggactagtaaagactgctttaggtgtccctgctggatcaacaacaacattaactgttgcacaagaccaaacatttcgaattgaatctgtcaagtgccttgcagttattgttaagtcaatgtgttcatggatggaccgacaactgagaattggtgaattttccctgattagttcagaaactccaggctcaatggacaatcatactaccaatggagatggaagtggaatggattatgacatgcaacctgacacaagcagctctgacatatctgattcttcctcacttgagcaacgacgtgcttataaaatagaacttcaggtgtaacttttttccaatttgaattaggtttcctaatttttacgttgtttctctctttctttaggctgaagtgttttttttttcttctgttcaatagtttgtactttggatgactgatgggcctacaatttcttttggcagaaaggaattgccttgtttaacaggaagccttccaaaggtatcgattttcttgtccgcagcaagaaaataggccattcgccggaagatgtggctcttttcttgaaaaacactgctggcttaaatgcaacaatggtaggagactatttgggtgaaagggatgacttccccctaaaagtcatgcatgcttatgtggatgcactgaactttaaaggcatggacttcggtgaagcaatcaggtttttcttgcaaggtttcagattaccaggggaagcacagaaaattgaccggatcatggaaaaatttgctgaacgctactgtaaatgcaatccaaatgcttttactagtgcagatactgcctatattcttgcttactctgttatcttgctaaacactgatgctcacagtgtcatggtgaaagataaggttagtctttggtgatcttcctattttgtcatctgggaatggctcgcttatattgcaagatttcttgtgcagatgtctaaggctgatttcatgcgcaataaccgaggaattgatgatgggaaggacttacctgaagattatcttagtgcattatatgaccaaattgtcaataaggaaattaaaatgagtgctgattcttcaacgacacaaatcaaacaacccaatagcataagcaagcttcttggcttagacaatatcatcaattttgtcaactggggacaggcagaagacaaagcattaggtgcaaatgacttgctcattaagcacatacaggagaaatttaaagcaaaatgcaggaaatcggagtaagatcaacatgatttttctttgttaagtactcatatgctctgatatttgatgaggttaagcttgtgcatgatgcaggtctgtgttctatactgtttctgatgcaaccattttaagattcatgatggaggcctgttgggctcctatgatggcagcattcagtgtgacactagaccaaagcgatgataaggcttctgcagcgcagtgtttaaagggattaagatttgctgtgcatatcacatctgttatgtgcatgcagacacagagagatgcttttttgacaaccatagccaaattcacatccctccattctgctgcagacatgaaacaaaaaaatgtcgatgctatgaaggtaaaaggccacacaaaaacattacccttttttgtgcaatttacataaaaatgttgcttctgacttccaagtaaccaacttctactttaaaaaaagcatataaatttataatctttgaagcatatagatggagcatattagatgtgtttgaacgatttcagctcatatgttctgtatgtgcattccatgtctggcatatctgactgttttgaaacagtggaatgatatacttagtctataatttcgacaggctattatatccatcgcaatcgaagatggcaattacttgcaggaagcatgggaacatgtattgacttgtttgtcacggtttgagcatttgcacctgcttggagaaggggtacctactgactcgtcgtttcttacagtacccttagttgagtccgaacaaaaaaatcataagtccagctctggtctatcttcaaagagaaccaatgctcttcagaatcctgctgtaatggctgctgttagaggaggttcttacgacagcacagtggcaaaaaccagtgcctcgtcattggttactcctgaacagatcagtaatttcatatcgaacttaaatttgttggaccagattggtattgttgagttaaatcatatatttacccacagccaaagattaaacagtgatgccattgttgcttttgtgaaagctctttgcaaggtctcaatgactgagttgcagtctccaacggatcctcgtatcttctgccttacaaaaatagtagaaatcgcgtaagaatttcctagatccacttgtaaaacctacctttcactagcagatagtagctgtgacccagtacttgtcaactattctaattctgaactaaattcgtgcaggcattacaacgtgaaccgcatacgtttggtgtggtctcgaatttggaaagttctgtcagaattttttgtatctgttggactgctagaaaatctttctgttgcaatatttgtgatggattctctgaggcagctggcaatgaagtttctggaaagagaggaactggcaaactataacttccagaatgagttccttagacctttcgtgattgttatgcagaagagtaatgctccagaagtacgagagctgattgtccggtgtgtctcacagatggttctaagtcgtgtcaacaacataaaatctggctggaagggtgtttttatggtatgtattgcagcaacgtttctctcatgaaaagaagactaaaatatgcattattatggtgtttattgaattatttttgcactgtgcaggtatttacttctgctgcagctgatgatacaaaaagtattgtcctattggcatttgaaactatggaaaaaattgttcgagattactttccatacataactgagacggagaacaccacattcactgattgtgttaactgtcttattgcgtttacaagcagccaatttaatagtgatgctaatctcaatgctattgcgtttctccgattctgtgctgttaaacttgccgatgaaggatttggttgtcaggaaaagtgtactgatgaacccaggaatttaggcatgtcagatggaaatgccactgtggacaaggatgattctatttccttatggattcctctccttgcaggtgtggcaatcttttagtgttagttactatcatgcagtgtgaatcttgttggattaaaaaacgtaaggactggttcatttgtaagattattattttatatttccttttaacctttcaggtttagctaaattgactagtgattcaagatcaaccatcaagagaagtgctgtgggagtactttttgacattttgaaggatcatggacaactcttctcagagtccttttggaccaacatccttgaatctgttatttatcctctatttagcagtgaaaggtcttcatcaaatgatccgacctcaacaccgagtatccctgaggatgacttttcaaatcttgaaacccaaacattggcagtgaaatgtttagtgggtttgtttattaatttctttgatgtgatgcgtccagaacttgctagggttgcatctatagtcacatattttatccgaagtccctacaaacattctgctagcataggtgtatctgctttgatgcgcttaattgagggagttggtggtgaactttccaaggaggaatggaaagacatattgctgcgcttcaaggaatcggtggcacatacttttcttgtattctccaaaattgtgagaatgatgcaagatattgaaattcctgatagatttgaatcttattcagaaaatgatcagtactcagatcatgaaaattatggtaatgaagaagaggaagctaatatggagacaacttcttatgctattgtcaaactgaagaatcatatggctctgctcctcttagttgttcaggtacttttctctgttaaacaaattatcttgttaatccacccataacatgttaagtttgattaatggcactttttattcacgtcgactctgggcctaactctacaattgggaacctagtcctaggctgtttacttgccgtccaatactccaatgctctagtgactatgacctgaaaattttagtcgtcaattaaggcagtaacttttgaaagagcagagtggaataatgatgttattacgaaaagcaagggtgtgagaatcaaataatcaatcactacatatcttgaccttgcctagctacctctatggaacagtttggtttttacctaacggttatgccagttcttatggcaaagtagggttacgaagcatgttccttttctaggtgataattgggaatctcttgtcctttcctaggtggacaacaggacaagtgacccagatgtgccatttgctgtggcttctatttcgctctaacatttccagccacatcactgtatctctcagtcttttgcccttttttgcagggaataattaaattatatgaagaacacagaaaatatctgtcttccgatcatattaatattcttttggagatgatatcagctattgcgacacatgcaagtgaagtgagctctgaatcttccttgctgctgaagtttcataaagcatgttcccttatggaagtatctgagccagcaattgtccatttcgaaaatgagtcataccagacctacctcaagcttctgcaagcgctgtttcgtgactatccatccatgtcggaagaaatggacattgaatcacaaatacttcgtgtttgtgagaaaatacttcggatatatctacagtgtgcacagcgagaaccatccaatgaagctttgcacagaaacgcatctatacattgcatagtgccactgggtgctgctaaaaaagaggaattggctgctaggacttcattggtcctcctcgtgatgcagttactgggaaacctggaggaggattcatttaggagagtactgccctggtttttcccgttgctagttgatctgatccgttgtgagcatagctctggagaagttcaacatgcactgtacaaaatcttccaatcatcaataggccccatgctaacagtataatagcacatatttgttctgctaggtctacgattttgttactctattttgttcacgttattccagttaactaagggggcccaggactatctttcgacatccttgatttatcttatctgtttcgaaatcctggagttcaaggtaaaaattcattagttctgtgcacttgcatattatgctgtatgttataaattcaactgagatcaacctgcttatcttatattttgcagtttaatatgatcaatccagatacgtgagggaatagaatcgattttgccagcattcatttcaggcaatacgagactatcagtaaatgaacattgtagactgacatagaatttgccccttatggctggactctcttgagaccgatgatgtgttgaggtaatatttcgcaaccctataatgcggacataagatttacccgatgtgtggaggtaatatgttattgtcaaactgaaggacagcatgctcattgctcgcaaagccacaatccatcatgtatattactagttccatagtactttcaaccatgtgccgtggaaacacctgagctactagatgaattcgctctatgaaattctgtttttgtttttctttttgtaatagcttttgttgtgaaactaaagtagagctagactagccttgtacctaaaatgagcaatgttttgtatcgtattcctttgtttaatgcataatatagcgaaaagaatgttgttttggctactgacatatgcaaactgggatcaaacagattgctaggagcgtttttaaaggcaatgaatatagaattttgctagtgttgagtggaaaaatatttgtctcggacacagctctccaaactatctacaagacaatataggtgatgtgaagtactccatattagagacaacaactgtcttt

SEQ ID NO: 70367 - DNA, 25351 bp, Oryza sativa
  unsure (1)..(25351): unsure at all n locations
agttgattattttctaggattggaactgccattatttagttacacgttgcatataaagtgatataaacagttttacagttttgggatgaataatttacacaaccagccgaggacgcgacccaacgccctaatgctgtacataatgcaacacaatcacatgcattggagatgacgagaaggacgaagatgagagaattgggctatacacaactgtaaccagacgcatcagcaacgtttgaaagaattgactagctctacgattttggaccctacttgagctattatacacagggctggattccggactccatttccggcatccagttttggtccatgtacaggccaccagctatcagaattcctggcaggagatggggaatgcacagacacttgacagaagcagcgcaagagtggctttgaaactctcacgccttcctgcccctttcaacggagcagcttgacattcacattttatatggatcaggtaaccatggataaggagaacctgtggaataaagcgataaacagatgattcaatctagaatatagatgtagcattctccaggtgaaaaaaataaaacagaagcatggtcaggttagatgaatttggataaccaacctttagaatgcaaaagatgacagtttgcaagaaaagaagcatgccgcccaattagcagttctgctgttcttagtcctgctgcagactataggatacctgcaatgacaaaaggcaagtgtcagaatattatatctgacaggagctgaaaacatataataacaaggtggatgcacctcaaatttgtacttgttggcatccttatgtcagcccgacgtttgttccgaaatgttgtttggtgtgaattgtgcacgagcagggatcaagagctgttgctgagggcgtggagctcctgtttccacaaaagtggcagatgttagaaatattaataatatagggtgtgcgcgcaaaagtattctcaatccattcatcaaagattgacttcttgcctggaggatattgttgctgaactgttgacatgcgtacaacatttgcagcattctgattagatagcggcagaatgtgacctggtacatagccaggtgaatacggttgatcacctggcacaggttggccaaactgcccatatgggtaaactgctgggcctactgtcctgggaccgccatatactggaacatactgttgcccaacatatgaaccatatgcattctacagaactaaaagtataataaattagcaaaagtaattgctaagaaggaacacgttatataatataccaagaaaaatgggaacaaaagattctggagttctcaacctgaggatacatgtattctggcccataagttgatggtctgcatttgaaaaaacaatcgatcatttacttgcaacagacaggttgttcatttgaaaacaaaagaaacacacaaagacgttatctatactacaatcccacaaagcacaattccagactagctatgactttaacaatgtgacagatattcacagcctaacaggagatcagatccttagctgtgcatgatcattgcaaagtatgcgttgaatgagctgttaacctacccataagaaggatatacaaatgcctgtggatagttgtaggggggttgctgatatgttgggctttgcacatacatgccccctggaaccgccacacctccattgtatgggatgaccggccttaaaggtgctattaccacattacaaagaagggaacaaattatcacaataattgaacatacacacggacctcataaggtgtttaagcatgcataaaccagtaagagagctttgcaactatatatttttgttgtagagtcctgacaatggcagaatataaaagaaacttaagaataaagcaaggacttcatcccttttccagggtaaccatgagctgtttagcaactgatctttctactaatgcatactgctctatctgagtttttgcgatgtaaagattttctagttagggataaaaatcagtggataccaggagctatacgctattttgtatacttgattttttttaatcctatttactattatgtgttgtatgaagttcacattttcagaaattttcaccaaaaatttgggtagaaattgaatttgttccaagattgaacaataactcattggttactggctggttggtctaggtgcaagagaaacattccagacaggaattccatcttatgccagatcactaactttccagcaaaatctgagaatccatctgtcattgcaagttgcaggccatgaaaaagatgtctggcttgtaaattaccaattttgtcgaaaagcaataatgattgtaccaactaccaaatcatgagtcatgagttgtcccctttctgttatcgattctgttacctaattttcatttaaaccaaatcctgcaatacctttcctctaaaatttataaaagaaaaaggactagtagcacttgatcatctccatttttttcccataaaaaatcaagcttctatcagaaattgattttgtactagactctacagctttggatgacattttttatatcaactagctttcatatcataaataacttaatagactctacacatttgcttttattaatcgtacaatgacaagtcccttttttcttttagaattataattaatgaaaaaaaaaaccattagttagcaaatgaaagaaaagatgtaacaagaaaaagctatgggcaacaactctggcatggtacaaaatatctaatcatgataactccagtttgttgggaacggataatggttaaaaaaaatatgcattacaacaaaattttaagctggaggaaacaatagtatatggatatgacagttatgcaattagggtagctgaaaactaagctagaagacctaccgaaaggtatgtctggcccaggacggcctaggatggcaaggttacagtttgcgcggcgcccgtcgatcaccgggtacgggtccatgcacgccattctcgccgagtctgggtcccggaaggtcacctgtacaagcctccacgcgaaattaagactaaacgttaaaaccagaagacccgatttccccttgcggaacgaaattgcttcaaattccctcttcaattccaaattcacactggaaaaaacgcgaaattgaactccaatttggaagctcggaaaggtagcaaacgaactaaaaacgatagcaacatccaaaccctagacctcattagcagcgaggctttggactccaattccccactaaatttcaaacgctttccccatttccgcaccacaatcataaaattccccaaattaccaccagggaattcaaagctcccaaaagattcacaaaccttcccggccgatcaccaccaatagccaccacacaacctcccaattcaaccccaaaatcaatccccgagccacaaaaaataaaaccccgcaacatctagcttcaaaaaaaggggaaaaaagaaagaaagaaagaagagagaaacacaggaaggaggatttggggaggactcacgaatccgtagcccttggacctccccgtggcgcggtcggtgatgacgacggcctcgaggatctccccggacccctcgaagtgcgccctcagcccctcggtcggcgtctcccacgcgagccccccgacgaacaccttggtgtacgtcgtgtccccgtacggcccgctcaggtagtgcagcgcgggcgtgccccctccccccgccgccgccgccgccggagaccgctgcggcgtcatcnccaccaccaccaccagcccacgcgcatccacccctccccaccccaaaccctaaccctagaagcagcagcagcaaacagcaaacagcgaagccgaggtggtggcgtgttagcgagcgttgcctagggctaatcagccaatcgcgcgcggtattatagccgcgctaatccgaaggcggttataattaagcggttaaactcgcgcgcgcgggagaggtgaggagggaagggaagcgaagcgaagtggtggggagttggtgccaactgcgtgcgaagaaagatcacgcgaagagaaggggagagagagggtggtttggggattttatatttttttgggttggatagggacttgtctcgtgctgattaattattgttatttggattttatatggactctctcagcctggatgatcttttttctgtttctgcttctgtgcttttctgtatctgtaattgcaaaatatctccttccttgctaaatttttttattaaaacgtatcagatataaatcatgtttaaaatactttaagtgatataacaactcacaacaaaataaattatgtattttttttaaaataagacggatggttaaacatgtgacaacggcattatctattaatataattgaaggtagtatatcctactcgcctgttttagttggtgttttagttggggggttttttatgtatattttagtccttttaaaaaatcttatttttataaattgatccctgaaattttcttggtgccaaggtatttgtaatataattgctttaccttcaacgaaatatccttcatggctaaattgatttatatatatcctgcttccctgtttcacaatgtaagatagttttggttttgtcttaagttaaactttataaaatttaaaatataataacatctatacgttaaattaattctattaaatcctccacctttatatagtataggtgaaaaaaaaaggatgtgatggagcttgggggtggagcaagctcagcgttacatgcaatgctttattgtgctttaatgccaagttgattctcaagtttagaattttatttatcgacgtcatctgttttcataatattttcataataccacgaagacatgaaaaaaatctgtcttattgtacttcaaaattaagctttcaaattcaagataaatttggactatgagctggtttggtttaaggtctaaattggctttaccaatatttgtcaatttcaatagtgtttattgtctatttggtttggagccaaattttagcatgcctaagaaaataggccattcaaacagttaatttaggctattttggcttcaatccaaacacaattttacctttaccaaaattagccatgccaaaaattgccaaaatttgacattgacaaaaattggtaaggccaatttaggccacaaaccaaaccagccctataatccaaagcacaatcgcattgccctactccatatggttgaattataaattattttagaattgtacacaagtgacacaagaattagtaactcaaatgacactattgccctgaatatataacattggaaatcatgaagacaaatcatcggcacgcgtaaaaaaaattcttataaacttgaaagaaaaatgatgtggcatactatgaatatattttttttcataaccacgaactaagtagatttaatggttgagatcttagtttgtaaaagttctataagattttttttaaaaaaaagtttgtatagcactgctcgtttgtgagaacgatagcatttatgtatcaaaggtaggcatagaataaaagatggaaacagtgtttaaaagtttaacacaagttactatagaaaaaattacgaaaactaaaatgattagtatctgaaattagagggagcaagtagtaattcagaatgcataaagcaggatccacctgacattgcagtgagagactaaacaaaaaaaaattgatatgtcttgtgtactaacaacatctgacttattctcgccatacaagcaaaaggttgtacatgtcttgaacaaacgagcacaaattaaaatattagggacaccttttattcaattttcgaatatgctaatataaaaatgtattttagttaatctcgattttagttataattatataacatagtgaaaaaatgataacacagctcttcagcagtgttaaatcatcaaactaggatttggcagtcaaaatctcgatttttttaattataaattgagtagtgcatatcacatggattgttcaagcctaatattttgattttccagaaaaaaggaactacttgggttagtgcacgtcattccggaaggatgaaagaacaataaacatatccactgattagagtaactgaattaagtggtcccctactttgtgtcctgatacttctagacgtctatgtccatgccatctcagccaatactcatctttgcagaatgatgcttactaatccacctcttgtgtgaaaaggtctcctgtccggaaaaaaagtgccggcatttcactattttatcattttaccattattgatgtgtgtaatacaggcttctactctttttaggtttagagtttgttttctaaaacaccgtacaccacatatgcgctgacaatacacgcacaatatgcgtaacacacgtaaatgttgtgagattaaccaaatcatcacatgtgtcttaccatcgatgagtacgtcatccactgttgaaagaacaactagcctcatgtcaattttacaagttgaatctgggtaataagcaggttccactataaaaaacccctcactttgctttaggcttagatttatttttgcatagaaaatgtaactaaaatttaaattttaaaatttaattttggatttggtttcaatattattattgtagtttattttttagcatgtcacttagagcatatataaaaaagttttgcgtaaaactttttctactgctaataagtgttacggtttataatgtcaaaggatgggctactaattctgtttgaacagttttgtggatttgcgatcgagattttgcaggaagaagcacccttcccccttttgccgtaaagagtggaggagttctgaataaattatgagaaaacaaaggggctaaagagacatggtctctgtatgtttatccaaaactgcagggaaagggttcctcgaaaaaaaaaaactgcagggaaagaactaaagaagcttcttgacccaaactcccaatgaacctattatattctgctgcgtatgcaaattccattccactttgccgaagtgccatatcccaatcgagatagtaatgcttgcacgtaccacacagaaaaagattcttgacccaattcgaactggatacaaatatgcagctacaccatgcaggtatgcaacaggacatctggagttgaggtaacttttttttattttaaatatagtgaaatttatttcggtctatgttttaaagaagatatagccaactactccctctgtcccataatataagggattttcaatttttgcttgcaacgtttgaccactcgtcttatttaaatttttttgcaaatataaaaaacaaaaagttgtgcttaaagtactgtagataataaagtaagtcacaaataaaataattaataatttcaaaaaattttgaataagacgagtgatcaaacgttataagtaaaaactcaaaatcccttatattatgggacggagggagtattatagagaacgtagtatgaatgaccacgacgaggtaaatttggtgaaagaaattagttgtcggtccttctgcttaattgccttcttttctcagacactatggtggtgtttggatctagggacttaactttagtccttgtatttagacactaatttagagtattaaatatagactacttacaaaactaattacataaatgaaaactaatttgcgagacagagtttataagcctaattaatccataattagagaatgtttactgtagcatcacataggctaatcatggattaattaggctcaatagattcgtcttgcgaattagtccaagattatggatgggttttattaatagtctatatttaatatttataatcaatatccaaacattcaatgtgatagggacttaaaagttttagtacaatctaaacaggtcatataattgggtccatagccatgcatggtaaagtacggactttgcgacagttgagctcccatgggtcgctcattttccctaataaaccaaaactacgtgttctttgcgacttaaaaccaaatgttgaagaagaaattacgttgaaaatagcttaaaatcttcttcaaaattgagtttaaaaatttaaattttagcgttggcttattatggcaaccaatagagctctttgatgtttatgttctctcttcaggcgatttagcagcagagaatgggaggttgcaagctgaaccaaattcttgcttctgccgttctgacttcagcggcacatatgtacgagtgaatagcactagtatcagcgagaagaattccaaaaaaaaaagaaaaaaagtggaggtagactatgtgtttatgtgtttagttccaaagttttttttccaaacttccaactttccatcacatcaaacctttcatacacacataacttttcagtcataattttttaatttcaactaaattttaaactttggccggactaaacacagcctagctagaggaacacgcttgcacagaaagtgccggtgctattgacatcacagtccagtttttttggtgaaataatttgaggggcattgcaatgcaacatgccgtcacgtctgatgctggcgtcagagtctgttgcttgaccttacgtaatcgctactagtacatgggtagcactttgtgaatgttgctgcaatggtgatagtatttgccggtttggcacggatagttgctgggattaacaccttgactcgaggtcaggattcacccaggattgttggaaccttcttcttcttttttttttttcatttttttgttgggtacatagtcgcaagatggttggaacttggaaatgctcaactggttatatttctcgtggtggaataagttcgtgggtttcagtacgaatgtttatatttaagaaaaagtacaaattaccccccccaaactatcgtggtcgtccgaattaccccccgaaccacaaaaccggacattcttcacccccaactatgaattccggacgaattacccccctcgaccaaatccatggtggttttggtctacgtggcgtacacgtggcagtccagtcagcattctatttataaaaaaaattgtaggacccacctgtcatacactactctctcttctctctctcacgggtcggcggcgcggcttcccccctccctgcccagggtccgaaaacagcattggtccatctcagttggtccacacctaacactgcaactcactgcgtttttcgtcctcgctttaacgcaaaaatcctgaaatcggagtttacagtctcggacagctcatccttataagctgctctccacctctccaaactaacgaggtgggactatatatagggggtgtttagatggggctaaaactttttagtccatgtcacatcgaatgtttggacgctaatttgaagtattaaacatagattaataaaaaaaataatttcataaatgagagctaatctgcgagacgaattttttaagcctaattaatccataattatgaaaagtttactgtagcatcacattgtcaaatcatggcgtagtaattagactcaaaagattcgtctcgcgaattagtccaaggttatggaatgggttttataattagtgtatgtttaatactctaaattaatgtccaaacatccgatgtgacatggatttaaaataagtccatatttcccaaacaggccgctacagtaccacgcaatactgtagcgctgctgctctgctcgctgctgggccgcatgcacgcatgcactctatggcctgctgctgctagcttttccttttttttttaagggtgttacacgagcggtggccgagtcgcggcggctagcggagctcaacaaccatgcgacgtctcgggtgcacggagctacgtgactaccgacgacgacgcgcccgagccggtcaaccccgccgtccgcagcctcgcctcctactcgggccacgccatcgccgctaagaggtcccgccgtatcgtcggctgcgatggcgagtaccaccgccggcacccgatccgcggcatctcaaccccgccgcccgcgcgccgtcgtcatctcccctcgagccccgcccgtgccgcgcgccgtcgtccgtcgccccccgccaaccgcctcgccgccgctgccgcctcgcctcctccgccgcaccccgccgccgccgcctcgcctcctccaccgccgcagtcttgcctcgcctcctccgccgcaccccgcggccgcgcgccgccccatcccccgcttgccgtctcctctgctgccgtgcgcatgtgagacaaagagtgaaagaagagagaggaagagtgagagagagaagtggaatatgagtatgacatgtgggctccatattttttaataaataaaatgctgactggaccgccaccgtacgccacgtagaccaaaaccaccgcagattaggtcgaggggggtaatttgtccggtttgcatagttgggggtgaagaatgcccgattttgtggtttagggggggtaattcggacaaccgcgatagttcgggggtaattagtactttttccttatatttatgactatttatacttttagtccacctggtttttattgatagacgatgcacccgttagcagtaagacatcgctaaatctttggaagtaggtgagtgtgcgtgttacatacatatgcgacatatttcttaagatctttgttttaagaaaaaccaacttctcacaacaaacgaattagttttgagattgttgtgttggagggaccgtagtcgccgttgcttccggtcagcaccgtggcctagcaggagagcgtccgagaagggcctaattgggacgcacgatgtggtcacgggccttttggggtaacgcgcacacggcccatccggtttccctgctgcatcgcgcggcacgcgacgcaacaccggtccacttattgatcttatagccaagcttgattcacttggcacgaagtcaagatggccgagttggtctaaggcgccagtttcaggtactggtccgaaagggcatgggttcgaatcccattcttgacaatattttttttgaccttgggttgggttcgaatcccattcttgacattgttttttttcctttgtttaaatttaaccatttaaccgcggccaaaaattttaattttttttgctttgttttaaccacaccacggccaaaaattttaaaatttttttgctttgttttaaccacggtcaaaattaacacggacaaaatttttttgctttgttttaaccacacccaattcttttcctttgtttaaatttaaccacaccagacaatattttttaaaaaattaaccatggataattttttttgctttgtttaaatttaaccacacccaattcttttcctttgtttaaatttaactacacccagccaaaaatttttgttgccttgtttaatttaaacacagccttttttcctttgtttaaatttaaccacacccaaaacaagctcaacctataatttgtttttttcctgggtttctgttatggttttctacttacgtacatgaacaacacccaaaacaagaacgaactatattttttagttttatactttacatgcataaaccacaccggaaaaacaagcactcctgctgtggtcggtggtcctatcaaattgttgttattacttattactgccaagaggtagggaaccaaactctcactcctcaggcaacctggtttcacaatcaacatacaatgcactctccagtcttaaaatctctccttttctttcctctaagaaaagagtgcacacacatttaactgcctaccgatgcaattcgtaaattaacaagttttattgcattgcacacagatgaaattattccaaccttcaacaattcactacgctagtttaaaatttttctttcaaatcccaatatctagctcatttcaggatcccagcagccttgtaggattgaacgctatccctcaggcattcctccaccgtcctgaacttccaccccagcttctgcagcttcttggagctcaaaatcctctcatcctcccctcccacaaacctgccattaattaatcatcaccaagctaaaaaaactgcaagttttacgtttatatgattcactcacatgtatatcaagcaatttaaacaatgttttttttattttatcgaactaattaaccaacgtcatgtaaataaaaatagagggagagctcttgacatgacaacagcctcacaggtgcattggggatatgtatacactccatctgtccataaatataagagatttcaggttgtttagtacttcatccgtttcatattataagttatttgactttttttcctatttaaattattttaagtttgaccaaatttatgaaaaaaaaatatgagaatgattagagccgggcgtccggcgtggggggagctgtatcgggcgctccccccgcgcgcccctccccccacgtgcaaacctatgggcccactcacttttctcttcccttttcccacaaaagatgtttcacctaatataattacaatgtttcattatttatagatctaatattgcagtgaattaaaatactcttttgcaaaaaaaaaaaccacatattttggaaactccctattaagggaatttggtttattttttgttccaccaaaaatgtttcacatagtgtactcacaatgtttcactatgtatagatctaatgttgcaatgaacgaaacattccattgcaagaaaaaaatccacatattttggaaaacccctattaagggaatttggtttattttttgtttcacctagtataataacaatgtttcactgtgtacagatctaatgttgcagtgaactgaaacattctttcgctatttgctgaaacattgtttttatataaggtgaaacaacacccgatttaaacgagtgaaatattttcgatcttcttagtgaaacaattccgatatacctggtggaacatcgtgcaacatttaaaaataattcaataataagctaattttttttcatcgaaatatatccatgtgtggtcttgttttgaagatttaattgcaacgaatttaatggaacaatcagatcatgatttggataagtaatttaggagaaaaatcagtttaaagcagttttgcacgtaaatcgggcgctgacgtaaaaaaatatggtagtattttcaacataaaacaaacatgttatcaaactatatttaatgaaactaattttatattttagatattgttaaatttttctataaacttagtcaaacttaatagccgctacccgtcatcaatagataaagtgcctggatagattgaaagatagcactcaagtgactggatagattgaaagatagcactccttacttttttttaatatatggcatcattgatattttaagatatgacatcattttgtcttatgcaaaaatattatgtaattatcattattttgttgtgacttgatttattattaaatgttctttaagcatgaactcatatttttttattttttatatttgatgtttttctgaaaaaataaaatgaatgaaaaaacagatgaagtattccataacccttagatcaatggagaaaaaagaattcgaaccacataatcctatggagggagtacagtatggatttggatcctctaccttcacggcttgaaggcacgagcgtgcagtcggcacctcatccaccgttcaaataatccaatggctcacgtcgcctgtgcacgtctgaatggatatctgtctgtcaaagcccacgaagcactactgctatatttcagtccgaataccaatgatgtttgcattataagtttcgtaatttttcttatcaatcctatgctctaatcataatttttcttttgcttttatgatgtgacttgacattgcgtcatactcccccattagttcccaaaataaaaactttttatgtggaaaaaaactaattacacagtgtgcgtgtaaattgcgagatgaatcttttaagcctaattgcaccatgatttaacaatgtggtgctacagtaaacatttactaataacgaattaattaggcttaataaatttgtctcgcagtttcctagcgaaatctgtaatttgttttgttattagactacgtttagtatttcaaatgtgtgtccgtatattcgatgtgacaaccaaacccaaaaattttctcaaactaaacaaggcctaagtcgcttgacttttttttttctagtcaaacttcttttttttaactttttaacacaaaataaatatattataaaaatatattcaacgttagatttaataaagctaatttgatattttatatattactattttttatataaattagtcaaacttaacgatttttgactagaaaaaagtcaaatgacttataatatgaaaaagatggagaactactttgtaatgaattagtattgttatttgaaactttcggttttcttgtatttttaatttagtgatatcatccattttttttatgtgtattagcactaatatagtttgtaagtttcttcagctcgcgtatacttcccagaccaaaacaatcatcgtgggatttttttttttttgcgatagaaccatcgcagtcttttacagacaaatttattcgtctttttaagcgcacatgcgacgtaagccgttggattacttcaatgggggataaggggctgactgcatgctcgtgccttcactctgcgaaggcagacgatccaaatccgtagagtatgtgcttactttgggtagttgatatccgggaagaagcgcctgacgatgtcaaccatttcagacaccttgatgtcgtatgcgctgcagatgtagcggccggaagccgccggattttcgtacgtcaggatgagtgcggcggcgacatcacgcacgtcaaccacgttcctcctcttgtccgtggtggcggccttctcctcatcatcaccgccgccgcctgccgccgccgccggcgagcacgtgcataaaagcaattaaccggtgagaaacacatctaggaattcagtttctgtcagatgttcatatgctactagctcttggaattcagtcggtattactgtcagatgcagatgcatttgctgtttaatcatgatcgagcttaatcaatttctgaatatatgtaaaagacagtcttctgaatatttcttaattacctttgatcaggttgatgaggatggagctgctggtgttcacggtcgattggagcagaggtccaagaattaatggcggacagacggtgacgacgtccatggcggcggcgttgtcagccgcgaaacgccacgcctcgcgctcggcgagcgtcttggagaggcagtaccagttctaaccaagatcgtctcataatttcagttcgatgcatggcaactcaaaatacgtgcgaatgattttatttctatttttctttttgaatattgatcgatggtttaatttgtttgtgttgcattttgacacatttcggttgtgtttacctctatggatcggcagtagtgctcgtccgaccacgcgtcctcgtcgaggacggcgtcgcgggggaaggccgggttgaggatgacgggggcgggggaggacaccaccacgacgcgggggacgcccgccttgtggctcgcctcgaccacgttccgcgttcccgccaccgccggagccagcacctccgcctggcagcgccagcgccggagaaattaaaaatcaaacggggacgggacgccgtacgtcgccggtcaggtctggtctcggctgctggactccggtaccaaatatcgtgcctcggcgttattatcggggttagatcttctacgacgtttcttccgggtttagtttctaatgtgatttcggggttgtggggcttggaggcggggacggggctggcgacgtggaagacgccggcgcagccggcgacggggggggccacgctggcgcggtccagcacgtcgggcttgaacagccgcagccgccgctcgccggcgccgtagtccatctccctcaggtgaccgttcttggcatcacctgcactaacggccggcggccatcaacgcgcgtgcattcgattcgattcgattggtcgtcgcgatatcttacttgggtcacggacggtgccatgcacgacgtagtcgccggaggagaggaggcgatggacgagccacgaggcgacgaagccgccggcgccggtgacgcacaccgtcttcttcttgttcttcgtcgtctccctccctgcggcggcggcggcggcagcgccgtcgtccatggtggttttctctcctcgtcccctcgatcgccggaagcctccatttatatacgcgagcggtggctgcccggctgcacgcgcgcgcgacacgtatcgcaggctgccgggacacgtgcgcccgccacgccgcccgtacagcctgtgcggctgctccctctatggatagcatttcgtaggtgatatgtactggcatattccctaattcctccgcaaaatatttgacccattttaaggaatgaaattgctaatcatttttcgacagaaaattcagtcccaatcttacatattttggatcactagatgtgcttcgtgatttgtgttttaggtgtttcttctctaactccgatcctagcgacaacccaaactctggcggagggccgacgaattagggtcccaggttgaggtgggagggaaagggagaagaggggggagttcgttgtctttataggatggtcgtgggaggcggcagccccgccgccaaggtcggaagcgagcagtgggctggtgtaggcggcgggggcaaagcaggaggactgttaggaggaggtggccggtggtgatgccccgtcgtcgaagatggggaagacggcgatgcgaggatagctcgccaccaccgattgaggaaaaggataggagaaagagggggaaagatagggggaaggggccagtcggggcccgggagggcctcgccggtggttgacgctttccggctagccagcaaagccgaagtagcggcgcaggaggtggtgtaaaggaggcgtcgggaagcagcgcactcaagggctttgtgcggtggcgaggagggaaaaggaaaagagttagggttttgtggacttcttacgaatctaaacgtaatccaacggtctaaatttacaaaatattaggaggggtttctatcaaatgaggagtagatggtccctttaaaaagaatctagattggacattttagttttaaaaagatggattacatcccttcgttttttaaaagatagattaaatcccatcatagacaaaaaaaattgtgactatattttttaagaatttcgttttttgaacaaaccaccattttaaattacttcgttttagttttttcttaataaaacttttctatctttcattgttaaattaaaatctctactattataaaacttgaagatgtttttgccggtaatttagtacgtcatccatgtatgagtcggtttttaagttcgtttgcttttggaaatacatatccttatttgagtcgatttttaagatcgtttacttttggtaatacagaaggaatcatataagaaatctgtttaaaaaaacttgcatgctaacttgagatgatcggactcttaattgcagttcatgattttctatatatatatatatatatatatatatatatatatatatccaagcgaactcccacagtgaattttatcttaactaaaccatataacaataataataagattaaaataaacttctcccgttggtcattgcaacgcacgagcatttttttctagtatatatataaagtttaaaagcataagattttgttttgttttttcaaacatggaagaaacgcaggtgctcacatgctgacatgtacacgctacccctatgagtacatccaaaagacttagctgatatatcttgagattaataaaatcaccacgggctaaggatggaaacaatataattatttcattactattttcggaaatgaacggaaacaattaggaaattttcatatttatgaatttaactaaactgtcaacttcaatgtcacaccgacagaaattggaaaaactaaaatttgaaatcagtaaccatctgtaataataatattattattatattagttttgcggaaacagattaatatgatagtgaaattgggacaaacactgagggaaaaaaacattttttttagttaagtacatgccacgaatgaaatcttaggattgatcctcagtccacctaattgggaatgtgctaattgttgccttatttaatgtttgcaaattgcaatggtcatcaagggaaggtcacgcaaagaagatggcagagagaacgttggtaatttaggtgaacatggaaagagtatgatgccttgagccaagtaactacggaactaatgtgcacagcacactagtacataacttcatataggcaagattcaaaactaatccatcaccaactgaattagcgcaagaacaaaccagtttatattaaggccctctttgtttagtattataagccaacttaaaagccgaaaagtttaagcctaaacaaacaagcagcttattcgtttagctttttaaaagacataagccactctaacactattaagccaaaagctaggttggagaagcttttttagcttatatgaggtagatgtatgactccaccactaaacttataagctgacttaaaagtctaaaccaataagcctaagcctaaacaaagagggcctaagccgtcctcaccaccgagccaacaactgtcaactatatatatctgcattgctcaatggacaagattcaggaatcaggatacaccgatacacttgtggtttttgtttttgttttgttttgtttttacggaaatgcactggtggttttaataacgattctttattgacccggttgatctcaacacagattacatgaatcatggagagtttaacagacactgaagttctcacagtttggatcctcaatcaaggatgccaaatgctttgtaggattccacgctgtcccggagggtttcctcaataggcctgaaactccagccaagcttctgaagtttctcaaaactgtatatggtgttctcttccacatccacaaagctacaaaatcattggatgagaggagaataagttgcatgaaagttaagcatagagaagctgaagataggaacaaatatgacgcatctagttcttgtaaaaaaaagaagcatttactggtctagtgaaataattgcccataaaaatttcacaccgctttgataaacttggtactcagttgtattttattgaaccaagtgatgtgggtgtatgaattcaggaaaaatattatggatcttcaattctacctagctatctcaagtttatgtaccctccccttttatgaaatgccagccatatctgttgtacaaatgcagagttaacagctacaacacaggtaaaacacatccagtaacttgttgaggggttgggcttactttttgggataagtataagttggatataaggtctttaaaatgtttatcatatcagagactcttattggagctgagctgcagatgtatcgtccggatgctggattttcatacgccaaaaggagagcattggcaacatcacgaacatccactacattccggagtctattttcgacagtgtcacgatctcctgcaaaagatgagtacttcattttaacagaaagcttaaagcctaaaatactttattgattgaaataacttgatcttagtattaagttctttcacgctattcgttagtaagctttcctttttggaacacaagaaggtggatatcatttctgataacacagctcaaacataatactgcttagaattatgattttaactatctaactccatgtaaaccaagaggaaactaatataacgatgtaacacggttacctttgaaatagttaatgagaactttactactcgcgtttactgtagattgcattaagggtccaatcaccaatgatgggcaaatagttacaatgtccagcccagtttttgctgcataagcaaaagcctcacgctctgccaccgttttcgaaaggtaataccaatcctgccagaataacaacacagataacttcttttgagtgggtaatacagcacagggagttatgtaccacaaacaacaagagtcacgaatattctttgtcaatataggaagatcatttattatgagaaagcacaaagtaactatatgtcatagcaatcaatttgcccagtagcaacatatactgaaaaaggtatctgaaattttgctcctctcaaggacattagtacatataaatttagcaacggaaaaggcattggcttacttgaaggattaagagcattacctgattctttctgcataattcctcatctgaccaactgtcttcagtgaaagccttatcctttggccagttaggattactgaacacggcagcaatggaagacaccatgacaactcgcttaacttttgcctcatggcaggccttcaacacattaagtgtgcctgttacagcaggagctatgacctctacctgcaaaacaacaatagttatataatgtcgacataggaatacaagatcatagagccaggagtcaacgatggtgcaaagcataaatcagaatgaattgtctgtaatcattaattttatggggaacacagatatcctgaaatatgtgacttcacttctgatctaacatcaactgctttatactaatatcaccaatttcaccatgttaaaaccataaccagcgatggccccttgattcaacacaaaaaaatcaccctattttccattgttcgacatcaacccaactgacaacaaatatatgttcttgtcaaatgttaacctcagggttggtggatcggcccgagggtacagggctggcgacatggaagacgccctcacagccggcaaccgctgaagctacactgtcatagtccaacagatcagccttgagcagctgcaacctctcctcggcaccttgtagcgccctgagatgatcattcttggcatcacctacagcatacagaagcaggcacaccacgtcaccaccatcatacatagcaaaacttttgtcccgccataataagtatacaatgtaattttaaaataacttcaaagattaggaccttcaaaattcttgtgattcgacctaaagataaacaaatagttgtacgaagaccaaactaacatttcaggccaacaaaaaaaactcaaaattaggaactagaaactctcctctttgcttccagcaacatacggatcattatttatttatttatttattcatttatttgagtattgcacccctgaaccctttttgcttctttttttctttttgagataataccctctgaaacctaactccatcatccacgcttccacctcgcatacttccgccccaaatttcaccaactccggggcgacgaatcaaaaaagcaaggcgaggtttggaggggctgtgaaggtgtatgtgtgagcggcctcacctggatcccgcacggtgccgcggaccgcgtagttcccccgggagaggagcagctcgacgtgcgacgaggccatgaaccccccggcgccggtgacgcacaccgtctgcctcgccgccgccgctgccatgccttcggacttccgacttcctcaaccccacactcctcttcgctgcggagctcggtttggccgcacggcgccgtctcgattatggcctcccattcgtttttgggaaaaaaaaaagtcgatatcgcctccttgattatgggaaataaatttgtattaaatataagaaaaaggggtgaatagttaatttagtcccttaagttttaccgaagtctcaatttagtctttcaggtttcattttgttcacataggtcctctaagagcaggtataataacaggctattagccagttataaacatattttaatgcgataaacgatgagagagatgagcaacgggctacagatttgtagccagttgcagtaaggactccaagacgcaaggtgtgtatgacaggtgggaccatatattaacaatatagtaagtaactattgtataaattagctattagattggctatagattgaagttagcagtgggctatactattgaacttgctctaagtatttgttttggcctaaaattatccttgggcccacttaatatgccatatgactatttctagtcaacaattatattagaaaatatccattttgcccttaatttgtgtacaactatacattagaaaaaagaaaaccaaaatgaataaacaacattgcatatatacttcccattatttcaacatgtgcatatgaacttgagcctcatggctatcgaatacacttgcaagtacataatttgtttttgttttacataaattgctatgtattatctataaaaagaattcatagcatgcaattttttctcttatatatgtgaatgagggggtataagtgtcatttattaagagagttattggttatgtgggttcaattataagtttgaattaaattaaaaacttgaaggactaatatggacagattgaaacattaaagactaaattgatccttgcatgaaacctggaggatcactttggctatttacccaaaaaaaagccaacctgtagaaaatgtgacccctgctcagggtttacgattccgacaggcccttccgtttcgggcaccggcggaattcggaatttcatgaaatacagtgaaaaaccggtaaatcctgaacaaatttcataaaccaaattttgaatacaaatccctgagtttgccgacaagttctcgaaaaccgatcggttttggcgaaattccgatcgaaatcatagaaattccgatcggtaatttgtttctttttttaattctttatttttttctttcctgatgtaagttttagtaaatacacacaatacatcatttttttcgaaaatttatatcccaataagttctatgaatatcatagtatttataagatttttttctttttttatcaattcaaatttgaatttggatgacactcctcgaaatcttagatggtttctactttcgagcctcgccgaaatttcgcgaaatccaaccggatttcgtcggaatcgtaaaccctgcccctgctactcaagtaatctagacagcgggatggtataaactaggttggccttttatttttttttacggagggagttctttatttctcacttacccacccacttttgtactaatttattctacgtctatcatttttaaattagtttataccatctcttttgtaccatcaattgtacttcgcgttctttttacatccttaatttttacaataaagagagtaacctgttatattatattataggacgaagagagtaattcaaaaccagatacaaagcttcttttcatctttcaatgctaaaaccaattcatttcgtctcccgagtggtctagatgataatttcatccttacgtgacatttacatgataattatgacgtgtcacatctcattacatgcaaaactttttttttaaggaaaataaaagaaccatcaacacccacatgtatctccttcacgaattaagtttgaaaatacactattcattcaattttttccacaaatattcgggatgcaatttatttgacagaaatatatcattcatctcacataaccgatgtgtgaaaacaatgggctggtttgttttgtgacctaaattggccttaccaacttttgtcaatgctaaattttttcaagttttggcatggctaattttggcaagacaaagttgtgtttggattgaagccaaaatagtctaagttaactattgaaatggcatattttctaagttaattttttttctagaagttatttatatcgctgttactgaagacatctcgactgaaattatttttccttgcgcctgcaacagtagaaagttcagtagtacatgttgatttagggataaccctaactgtttaaacaaaaaaggttaactcacacaagatgtagttttggccaacatcggcccatattaggatgcttcattctgatcctattttattttgcatcagcaggcactgcacagctgcagcgttgtaattaaatcatcgacatcagtggtggggccttatgcttgggtacgcagcggaggagggagaaataaattatctgtactgaccatcggtaagtaatatttacacctatccttatttttccaagtgccagtaaaatgtcttagactacttgatcaagcatagaattgagctataagagcaatgagtttcaatgatattttgtgtatgtgtagaagtgtgaatgatgtgtcgacaggaagaatgggttctcgtttaaaattaaacaaggcatatttacaagaaagaattataatacgttaattgccagctttgtgattatgcaccacccataaatcttgcttagaagtttaattaacggtattatggtaatttccacgaacccgtagattctttactgtcctaataggcctaggtgcatttcttatcaatccaaaggcaataccatgcatactgctattggaatatttggcagagctttagatattggattatcatatggcacctatctatatctgtaatactgtagtactccgtactcattaatcattgtacaaattgaggagcatatctttctatcatttttacatgagactatgtccttactggtccttctcatatgagattagctcataagaatttcatactttttgtttttgtgggtgaataccaacgtgcatttggtggaagaacataaatcaactggtcctgctaatctatgatttgctcttaaaaagattatattttttatgtttccaggtgaataccacggtaccaccatgcatttggtggaagaacacaaagctactacatttgtttttgttattttattagatttgggatcaaattttttgtgggcatgtacattataatgtactactacgtatcacaatataaatgcttaggatcaagttgttacttaggggtcttggccacgtagatgattgtgtttgtgtatgggtggatgccattgacacaggttcttaaacatgtatttagagttgcgcaaagcgcaaccatgtggctagtatttttactaaaagaattacatcccgaatatttgtgaaaaaataaatagcatattttcaaatttaattctctccttcactttcttcctctcgatctcaccccctccctgccgtgctcgttgcctctagggacggcccttcctcgcatggtgactgttgggatctgggttactgttcgatgctctttcgagccatccaaactgctacccctaagtaaatgaaattttagtttgccaccaaaaactgctatcatcaaaattttagtgagatttac

SEQ ID NO: 70368 - DNA, 561 bp, Oryza sativa
atgaagtctacaatgctctaaatggcactcagtatgagagcttcttgaatgctgactacagaatatgacagtgtgccttcacactccctgtatagatatatcctttttctggttacatttctttttaaaatagctggccttgatgtgcctggcgaaaattttgatggtgcattgccacggttgcccacgagtgttctttgataggttcactaattgtcatagcagggttttgttttttgttttatgttttctgtaactgatatgctcaggattctaatcttgtgtattgcagtgcttattcttctcccatgttaatgatatgcatgtttccagctcaaaaataagaactatccatccatcatccatgttagctctgacttggatctttcctgctcaggttaatgctaccgagttatctgatgttaataggctaatgtgctcttgacgattcagaactgtaacagtatggtactacaagactaaatttcgcgttacttcgtagtggtgttgtttctttctctctctctctctctcttttttttttttttttttttttttttt

SEQ ID NO: 70369 - DNA, 5873 bp, Oryza sativa
ggaaaaagtacaccgaaggtccttcaacttgttagtcagatacaaaatcgtcccccaaccgtaaaaccggacatccggcgtccctcaacttacaaaaccagtcacaatagatccctcggcggttgtgatcccggttttgtcccacgtggtggctgactcagcgtgggacccagatgtcaggatgccacgtcatccctcccttcctcctctctctccctctctcacttctctcctcatgggcaggtcatgccgtgacgcgcgtcgagtgccgcggccaccaccactgtgacctgtggcagcgaggggcaggcgcagcggagcgggacggtgaggttgtcgccggcaacgaagccgatggctggtgctgctgctcgtcgtcgtcttcttcgtccacaacttaccggagcacgccaggttcgacggggtgcccgcgagcaccattgccatgagctcaaccgcaaggtgctcgagcttgccccgtgcaccgttggcgccagcttccagctgccgaccaagatatcaacaagcgaagagacgacggcggcgaggaaccgccaaggcgaccagaaggtggggacccagatcgccgccgtcttcctcggctgccccgacgaccgggagtcggtggcgttcgcatgccacctcgccaagaacgacggcgccatcaggctgaccgtcatccgccttgtgctattggcgtcgtcacgcacgacggcatcgccaacgctgcatgcatagttagctaaggctttgtgctatgctagtacgtgcatgtgttgcatgagctagtggagcaagtctatcggttggttagcttaatttgtgcatgcatgcagctggtagtggatcgactggagcatgcatgtgtggcacgacctctgctgccagctccaagccaaggagaatctcgccgtcgcaagcaagtgtagaaactcacaccatcacccctccaagcacagacgaaactcactgccgaaactcgccgggcacctcctccagctcatgcacgcggctgggcggcggccggagatcgaactcatcgccatcgtcatcgcgaggcggcggtgaaggcgtggctctccttgttcgcggctgcgcaagttggccagggagccgtcgcacgtgtggctccagctccgccaccgcggtctcccgcagctccgcccagccaaacggcagccacatcggcggcgccgtcatcttcgatctccccttcctctgccgcctctcccggaccggctactggcagtgggagaactgttgagaatataggcatataatgatttaatatattccataaataaatcatgacattacagatgtatactagcattaacgcatcattagatctacacatgtaaactaagcagtaaaacatgaacatatcaaatatgcgcaacatgtcgaacacgtaccgaggtggcggaaagaccggttgctcggcaggaactactcgcggttgcgagcgtcgacgaaggcgcgcagcacgcgagcggagaggaaggcgagctgttgcggacaaacaggaagcagtcgcgcgaagcgctttccaaaaaccttattgctgccttctcccggtgcaggacgtcgaaggcagaggttccggcgacctgctctcccgatcgccggtgcacgctggcgagcgagatggagtagtctacgagtgacggcgcaacacagaggaggaggcaaaccctagattgatttcgcgtgtgttgcgtgaaggcggtggcacggtttatatagagataggtcgcttgatcagggcgcccgcacgatctccactctgcgtaaccgagccggataagtcgcgcgtaacttatccggactccacgccgttttcacgcaccggattttttggaatgtttccaacaacaaaacaaatccgaattttcctgcagcaaaacaaaactgcaaaagaaggctgcatctgcacaagggtgaggagccaattttgcggaccattcgacgcgtacgtcatgcacgtgcgccgcctgccctgccttgcagggccgagctgggcctgccctgcgagatgagcgagcgcgcgcgtgttccccctcttctctccaccacacatgcttcaagtggctaggagggcatcctcccttttaaggaggtccccctcttctagaataagtaaggtggtactaacatccacatgcatgccatcccatgaggtgggcttttgtgattttccaaagaattaatcttcgaatgggccttagcccatctattaattccaacaagaaccaccaccgccggccgaagctagccaagggcaccagcggtggccgcctcgccatctccatcagcagctacggcgacagctagatctccactccgccgtcggccgcgtcgaccctcttccctaccgcgccgatggagctgccgccgctgcattggccctcggatctcctctcagtcgcgctcctccttcgccagccgccggccgcgccggtgtcgccgcctcaccccgacgacgaccgccgcgctcctccccgtgcgacggcagccatcggcggcgccgcccgtcccatcggccctcctctccgcgccgctccttccccgtcagccgccggccacaccagccctcctccacgcgacgctgccgtcatccacgcccagaggaaagaggaagagagagaagaggggaaaaagagaaagggtgatgacgtggtctatctgacatgtggggcccacatgggtcccatgctgagtcagccgtcacgtgggataaaaccggggtcaaaaccgccaatggaccttttctgaccggttttgtaagttgggggacgccggatgtccggttttacggttgggggacgattttgtatctggctaacaagtcgagggaccttcagtgtactttttccaccagattgatgcactggtactatagctactacttgaaggcccaacgcacaaatacatttgggtctaaataggtttcaaattcgattcatgggccaattttatagtctggaatgtcagccttacacggttgttgttgcacgtacaggtctaacactacagatgtttatttatatgttgtgtgatgactaaattctgttgggtcgttaagttttatgcttgtaaatgactaaaaaggtatctcttcgtcatttgcactgtcatagaacggggaattttgctactgaaaagcatgtcatgtccaaatcttggaactgaattaagcaggaattttttttttcagaaatgccccaccaacccgcataaaggatatactaccttttttgcgcacagcgagttttgtaaggagctatagtaatagaccttttatcatgcggtattatcaattgatcactaattaatatacacaataatacagtcatggattggttgttagacagaatgatgacgagctaaaagtattgtaaaaaatgtttagtaatgtatgaccacattccttcactgtttctgccaaagagagtagaaagttcagttatatcgttgagctaatttctcaaccacctacttatgttttaggatcccagcactgtacaaataatttgagatcgcagtactatattccctcagtcgtaaaattaacataaagaattttagttggatgagacacattctaatatcacgaatctgaacaaagatcatatccagatttatatatgtctcatccaaccaaaatctctcgaagcaaaagagcacattgcttgtgttgctgtcaaaatcctccagctgcctcatgggctcatggcggtcctcaggaaaaaaataataatttgaagaaataaaatgatattgtgtccctataacttcttaaatttgtagttggcttgctagctaaacaagtatagatcgaacgaaccgaaacatgcgagaaaactaaccaaatgaacaaactgaactactactctattttttaatatatgactttgttagcttttgacaattaaacgtttgatcagctatcttattcaatcttttctaaatataagaaaaatttaagtcatgcataaaaagaacttttgatgatatatcaagtcataataaaataaatgataattataattttttcgaacaatatgaataatcaaacatatttttcaaaagtccacactgttatatatatcaaaagacgaatagtttcgttaggctaaccacaatcagagccacgctatgtcatgcctcaatcaaccatttcagtctaggaacctgtcaatccattcatgccatagtgcagcatgaccttgaattagaccttggcagcacagggcccatcatttactgtcctgacagcaccaggaaagcgtaacttcatcaggctgtgtttagttcacactgaagtttggaagtttgattgaaattggtacgatgtgatagaaaaattgtgtatgaaaggtttgatgtgatggaaaattgaaaaattgaaaaaaaaactttggaactaaacaggacatgagatccacggctcttcacaggggaccaagttatgcagatgtgggtacgaatctttgagctggcgtatcgaagtaactcgtcacatattcgcactgtgaaggcccttcattaaggacacatttcaaactgattgaagaaaaaatgcattcattctcattcatttttgttcttttggggggaaaaggacacatttcagggactaattaaattaaagttagataaactgaaaccaactactagctggtaattaattaaatcaaagtacttatagttactacaagcagcctcctgccaaccccatttttgttggtgaaggcgtggccggcgccgggactgtgcccgggcgccgtcggccgggcgtcctcgacgatcccgacaccgccgccgccgccgccgccgctctcggcggcgtcgggcgagagcgtgccctgggtcatcgccgtcgtcgtccccttgccgccgccggcggcagcttcttcgacgtcgccgccggaacgcggtgccgacgacgacgacgatagcaggtgtctctgctgctgcgccgccgccgccgccgccgcctccgcaatgagaggtcttccctgtgagcacacgatgatcatgtcggaggaaaggaagaagatgatcccaaggacgaagatgagattcagcttagaggaggacatttttttggcaaggttagctagtattagctctgaagcaaatcacagtgcaagttaagctaagctagctagtgatgagcttaatgaggagtgttatactagctagctagtgtggggattgctatgaggtaatcacacccactaatcctttgctatttatagcatatgttgtgcataactaggatatatttaatggagttaagataagcttagattgggagcatgtacggagaaggaatctttgtgcataattaaatagggctgcatatgcattagcttagctatgccgaggaaagctgctagtactatacggcttatagctaaagtcgaacacaaactctcctttttttgcatgctgcatggtaggtatttatggaactggccacaagtgttcatcagcaatgcactaaccgcgcaccatgcatgtggcaccgttacgttgcaaaatctagctagtgttatactgtacttatatagaacttgatgtatatttttgccaagtgttcaaaaagtaaataaagtaaataagagagaatgaactaatggattctagtatactaccccctccgtttctaaatatttgacgcggttgacttatttttaaatatgtttgaccgttcgtcttattcaaaaagtttaattaattattaatttttttatcatttgattcattgttaaatatacttatatgtatacatatagttttacatatttcacaaaattttttgaataaaacaaacagtcaaacatatgctgaagagttaatgggtg

SEQ ID NO: 70370 - DNA, 24589 bp, Oryza sativa
  unsure (1)..(24589): unsure at all n locations
attcctgcagccccttggttcaaatgagcattaattagcaaggtatgatcatatgtacctgtcaagaagatctgaacatagctcctcaaatttagccctggtaagagttgtctcgatatgcttgggcccatcagcagtagctgtaatgaagggtaaactgaaagaagcataaccaatggttagaatcaaccaagggaatcaaaggattgctacccaaaaggaaacagtccaatagcacaatgctgcagcaaatcaaggcggtcaagcaagctaacctgatatttgtttgggtcaaggatgatagctccatctttgccttctcagctgcttctgtaagacgttgcaaggcctgcttgtcttttagtaggtcaataccttcatcattcttgaagttccccgccagccaatcaacaaccctctgccaatgacaatgatttgtgagcatatacatcttgtagaacagtaagaaatgatgctaaaagatctagcagctacagaaaattataacaaatatacatgacgtaagacccttcaaattaagcaaaagatatgattaccaaatgatgaattagaatattacgattactgagtcggtccatccatttgtttcatcatatcgtacatgtttaatgaagattcaaataattcaggcatccaaaattccaccatagagaaatttattatttattcactgtccccagtttgactagagattaagaacttcaagaaaaaccatagggcatatatatgtagtactgaatttactgccaacttatcatcccctaatcacccagaattaaaggctcataaataatcaaagatttggatggaatatacttcactacgaaactaattgagtccctaaatcaattcttaacggttccgatatgtatagttcaaaacttgagtccatatcaacacattaatactactaaaaacttaattttatatattgaaaaagactgttccttgaaatctcggaaagcaaaactaaccttgtcaaagtcatcaccaccaaggtgagtgtcaccagatgtagacagcacctcaaaaacaccatcaccaacttcaagaactgaaatcatcacccaaaatatagttaggagctgaattctcatttaagagatgaaaagtgttaatttaattaacatttgacagacgaaccaaaatgaagtacacccagaaggatgaatggataaacaaagttcaatagaacagatttgatcttatcaacacaacacaatgtgaccataacggcataatgttactataataattccttcagtctggaaatgccccttttctgaggaacctaatcattctcctgtcacaaattatcacaacgtatttggaaaattgctactattgccataagatcgtagtatttgaacatacagagtcctcatagcactgagcaaaaagttgtttagaccagcattagcctttgaaaattcattacaactgtcagaactacaactgaatgtaattaaataactgaaaaaataattgtccataacagcaagaaaaaatgtttttatttttagttttttgacaaatacttcacttggttatgttatgtcaataaaaaatacactacaacagagtacgtgaaaagatgcaaatagtggttaaaacaacaataactggttaaaacttgtagttgcaaatagtgttcagaaaggcaccgtaattgtaggatagatacctgaaacatcaaatgtgcctcctcccaggtcaaaaacaagaatggtctcattgttcttcttttcaaacccatatgccaaagatgctgcagtaggctcgtttatgatgcggagaacttccaacccagcaatccggccagcatcttttgttgctgtcctttgtgagtcattgaaatatgctgggactgtgatcactgcctttgtgactttatcgttcaagaactttgatgcatcatccaccagctttctaagcacctggagaacataaaatgatcaacactcggattaaaaacaatttgaaccataaaacttattttgcaggcatacataaaacatttgcatgcacatgctatttcagtttttgccaacagatccccaaaagaaaatggcacattcgactccaccaaaattacccatctaggcctagtaattgatgaaagaacaccagtaggaaatattgtactgatgaaaacaaagcaaacatgaagggaacccacaggatttgcactataagctgtcaagctcaaagcatataagatgtctaactcagtccatatatatatatagactgcatcaaaaatccacgtgcacatatttagatatatacaaagagcaagggctgttcagtacaaatatcctactacctgcattcccttttgtgaagtgccgttttaaaaaaaaaaaaaagaattctatagttttgtgaagaatatgctaaacaaagcatacaggatgggattctatttgtgagacaccaaaaacactgttatggaagctgtgctattgttggcatcaagagaagtcaaggcgagattaagcaattaaccattaacccattattccatagagcttcatgaacagtcacgatcctataagctagaaatcaaaactggccacatctaagcaacgcaacaggattccatcttccaaagcattctttctagattctagccgtcagaacccctcaattgatgatcaattccaacacatggtaaacaatcacaaagcgtaagccacccctatacctgggcggagatctcctcggcggcgaactgcttgccaatggcgggacagtcgagcttgacgttgccgttgtcgtccctgatgacgcggtaggagacctgcttggactcctcgtcgacttcgttcatcttgcggccgatgaagcgcttgacggagaagaaggtgttctccgggttgacgaccgcctgtcgcttggcgatctgccccaccagccggtcaccggacttggtgtaggcgacgaccgacggcgtggtgcgggcgccctcggcgttggtgacgatcgtcggcttgccgccctccatggccgccaccgcggagttggtggtcccgaggtcgatcccgaccaccttctcgcacgccacccgcagcggccgccacctccggcccccgccgcgcccgtacaccgcggcggcggtgcggacggagacggacggggacggccgccgcctgccatggtgggcgaagaagggggtcgaggtggggaaggtcgtggtcgccatggccaccgagagagaccgctggtgctagctaggtcacgaaaccctaggggagggagggaggaaggagaaggtcgtggtggattcgagtggtgggttttttgagagattgggggagaaatggcgagaggttgggggaaggataaggaaggggagggagggttttatagacttcgcgtgtggccaccacactttggaggccagcctgtggcctcttctttcttcccttggatttttactatggttgtggtggtaaatcacttcagttcatatcactccagtaataatacttagattagagtaatgctacacatgttacaaataatatcaccctagttagtctatgtgaaaatgaaatgaagattcaatcacaacgtaccacatcaatttttatctgatatacttgtacatgagattttttttcttttacaagtatcatttttttttaccaataccatgttgtgacatatatttataatcagataatttaaatttagcttcaatttttatttattatgatataagataagaaaagatatttgctccggtcaataaaagtagtactccctccgtttcaaaatatttgacacagttgattttttagcacatgtttgaccgttcgtcttattaaaaaaatatgtggtcaaacacgtactgaaaagtcaacggtgtcaaacattttgaaacggagggagtatttgatgttaggacgttgtcgattagagttgaagggagtatattagaaaatgtatccacttatttattgtaagtcataaattttaatcatttggtgataaggacttttcaaacactttagtctcaaaatattacatctaagaatcatcctagtagcaacattttgagacaacatagtatctagaacttttgtaaaatttggttagtgataattagtaaatgcataccattattccatatcaatccctgccaactagtgttctcttagaggaagtttaatagtatagccaactactagctccaaatcaactatagccaacgtaatagtcaattcatacaatagttgtttactatactattaatacttggtcccacatctcatacacacatgacgtcttggagtccgtgctgtagctgactataaatctgtagcccgctgcttttctttctctttcttaagcctgctattgtacctgctctgaaccggtaaaaacctcgcagtaggctgatcctatgtttctggcccagaaattctgggtgtggccacacggttgggcagggagctgtggctggagcagtgcatccgggaggtggtggaacgttctggaatcaacgggacggggtagtagctagggagcacacgcagtaagctcgcggaggcgttgagaagaatgtgacacctgctcgcccgcgtccgcaaagcgcacggaccgtatcgccgacaggtggggccgcctctaccggcagggccttggaccaccgttgcgtggggcgggtcgctggaatcctgcggttgatgaatggccacgacgacggggcgacgtggtactatgcaagcggacgaaccagatcgcgtggcttggatgaaggtacccatcggttggcaataagccgtactataaaatcagcgcgccgactgatttatggtctgtcaccatggtgagcttctctgtatgtccataatctttcctgtttattcagaattagttttatgccaatgaaatttgtaacaaaaaaattcacacattgtgatcccttaattagtgatttcaatccttccctcgtcacttacagtcttaatgaacacctaaaataggtaatattgtatagtggcttaaaaatttataactccaactgtgggatctgtctgataactaaaaaaatattgtcctagactccatgatgtaaaatttgctaggttaaattagaccagattttgtttttagaattgcatgtaacattttattttttaaaattattcttaccttaatttttcctatgaatttactttttgccatcttctcgagagtgctcaaatgccactctcccaaaatttcattcccaaatgccacccggacctacacgtcggcctcacacatcacctggtcccatgttacttttgtttgaatgagaaaagaggctgacatgtgggcccggataacattttagcaaaaagtaaattctccctctaatatttagtctgcattaattttgcttgtaaaatttccttgatggctaacattgatctcttttttttccttgttattttcctcctcttacatgcagcagcaggtgttgcccggccagtagggcacccaaggcccagcacgcgcgcctgacgacattcgtccgctcgtcgcgcgtcctttccttccagccggtagcgcacgtcctcgcacatgggccaatcggcccaacctcactgggagcaggcccaactcggacgcgcgtacgcgagaaatcgggaaggcacgagtagaaagaaaataatcagagcagaatcagagatcgcacgggggacacgtggctaattttcaggggagctaatcctcccagggagccacgtggccgaatcatatgcctgatttttatccctaaaatcggtttagataagattagcgaaaagataatttaaaatcagaacttttatatatgtgtccaactgtccataacaacttaaaagtaaatactaaaacgaaactacgttaaaaatactttaaaatctggcaacggcttattatttatagagaaatgatgaggcccgaaaacagtgtcggaaattcctgctaatcgagcatcatttttataaaaagtacctctctcactgtttcaatctaaaaagttcttttacaattgtatacacatacataaagtattaaatataggttaaataaataactaattgcatatattgcgactaatttgcgagacgaattttgtaagcctaattgctcaatgatttaacaatgtggtgctacaataaacatttgctaatgacgaattagttaggcttaataaattcatctcgcggtttactgatggattctgtaattagttttttattagtgcctgaacaccctatgcgacaccctatataatacccgatgtgacacgccgaaactttacgatccttgttgacaccctctaaatgcatcatgtgagtacttcgcttctgatgaaggggtgcaagatgagcaggagaatgattttagtgtagtatctacaacctttgttgttcatccctattcctaggttcatttgtttctttagaggatcattctatttgcaaaagaattgatgatattacataatgaaagtttcttgtaattcttttcatttgcgtatttctatgggtaagatcatgtattatggggcaaccatcacatgaatataaaacaaaggatggtatttcatgaaaaaaaaggtaggatgacgtgatcacggctactatgtataaaaccattgctcacatcatatatcatcaaggaaggtgtcgtttagcgcaacacaggggagtaacgcacgattaggagtcacacattgataagaaaaagcaaatgctgaaaaataaattataataaaaaaaagcaaattagatattaggctttttttttaccaaactttgaaagtggactagggctaacataagatttttgcaatttggcaaagttctacaatctgagcccctccacgcaggcacaccgttgatcttctcctctaagcggttactccctccggttctatattaattgatgttttggataaggttgaggtcaaacttttataacttagactattaataactttaaaaatatttagtttaaaggaactagaacaacatatatagatttgtcttttaaagtactataataaaaataaacatgcatttatttattatatatattataacagaaaaaaaagatcaaagatgtatcttgtagaccgtgtcattgtctaaaacgtcaattaaaatgaaaccggagggagtacacgcaatctggtcactgccaaggcaccactactgtcctcgaaggtatccataccagcccagggacgcatatcataggattatggtccaaactgcattgcatagtgcaatctgcgcttcttcttgttgtttccctcattatctagagcgccgagattagggccagtgttgccaacttgggagcggcatcttctattaattgttgtttctcttatcatccgcgatacccatgaggagaattagaaaattattaacggagtttaggttaactgacgattcacattaagcttgatcaacagcactccacaaaaatgcaaaggccatatgttagaggacaagtcacgtcatggcaataatcaggacaccataggaagagattagctctcaatgtgagccaccggtccaacttaaagacttttatagtacaaaacctgaaaacattgtctacggagtagtgcattgcaatgggaaaactaatgttatgataataatatatgttatgataataatctatctattaacttagtaaagtaatagaaaaatgagcattcttatggtttagaaattattatcatattaattggagtaaaataaaaaaataaggagaattcattgtagacaaggactctttcattttctttttttctaaaaaaaacaaatacgttatatatgtgtagtgtccaatcggacagctgcataaaacaaatcttttgcaaggaaaaaaaacctaagctggatagattaatctctctatacaaattaatacaaagtattgctattttttaatttttgttgaataaaatttagaaaaagaaatgaaatttggaattaagaaaagaaatattgaaatatgagtagttcatatagaaataaaatttataaaataacaaaaattataaaataaattatatttgatgaggattctagaatattctcccaaagaggttagagtgcatataggaatacaatttagaaaaagacttcaaattcaaataaaaaaataatattgaaatgagagtttagagtttgtatagaaatacaattagaagtaatgtaaataaatcgatatcatgaaaaacgtatagccaaatttcttattggttcaatttagctagaattaaattaataagcagtcataaacgattaaaataatactaatgctatttctgaaaatacaaaaatacttaaaatcactgagagagaaaaaatgattttagccttgcccaaatatatgtccctcttctgtgctacgtatgtgcggtccatgaggcggcccaatggcgacttggcctaggaatgacgcccgacccaacacggcagaagccagggtcgtccgatctgatgaacggtcccgattgatcctgacctaaatgaatatccaacagcttaaaccctaaccttaaaatcatttcccccatacccttgctctctctctcgaaaagcaacggcgacggctgtgatgattccagcgggcggcaacggtagcgcccttccccaccgagcagatccggctacgacggcggcgttagcgtcctcccgcggcttcccacaagcggatcaggaggcgatgggggcaccctccccattttcccacgggcagatctggcggcgacggtggcttcccgtgggtggatccggcggtgacgaagattgagataagattgtgcggtttttattattttttctagttttttttctctttctttggattgtctgattggatttcgatctgacttatggacaaaaaattgatgttacggacaaaaaattgatgtgacaaactgaaagttacaatttttttaagtaaccacacgtgcaatttagtttcaaaatactctaaaaatcattagggagtacctatgcatctttcgaaagatttttatgatcgtatcacacagatttttaatatttggattaaaatctgatagacacagtaaaaggtaaaaagcaactaagaaacaccataatggacactaaattatcctatcttcaagaaaaagtccaaatccaatacaaatttcgaaacttacatgtgaagattcaaaaattacacagtaacaaagttacaatgtaagtttcataaattacactgcaacttacaagaaaatgcactgtaaatttgagtgagaaaatcgagtgagagataagaaaaaaatcttttgagtgagatatagcaaaatcgaaatcacaatgatttaagctaggaaaaagtacaccgaaggtccctcaacttaacatcgggataaaaaacatcctcgaaccgcaaaaccagataccacggatcccttaaatatacaaaccggtcacaataggtccctcagtggttttgatctcggttttgtcctacgtggctgctgagtcagcgtgggacccacgtgggccccacatgtcatcgtgccacatcagcctactctctattttcccctcttctcatctctctcactctctcttctcagggcggcgggggaaggagcggaggccactggcgagggtggcgtagactagccgacgttagggggaggaggccagtggggcgcggtcccgcgccaccgcccgccacgtgctccgtgaggtgggccgcgacgacgtcgtcgtcgtcgacggccgcgccgtctctgcccagttcgccatggctggcgtagacccgggcactgcgacggtggcaggaaggcgagtgtatgtgaggaggccggtggggcgaggcgggaccggcgtcaacggggcgaagcggcgggtgtgccggagacccagtaggaccagattcgggcgctcaagcgcttcaatgtcggcgaggactagcccgtcttcgacggcctctacagcttctgccagacctacgccggcggctccatcgacggtgccatcaagctcaaccacggccacgacatcgccatcaacaccctcgagctcgcctgcgcggcgacaccctccccttctccaacggcgctgcccccgccgacgccgacgtcctcctctttctcccacctcctgggcctctctgaccctaagacggtggggcaggggagagggcgagaaccgcggcgacggcctcccgcgcccaccctcacccgccgccacccagctcctctcctggtaaccatgccgcccgcgccaagctccatgtcgccggctgcgcactactctgcccccgatggccgcaccctgctcctcccccgacggtcgcgctcagctcctcccccggcgacggtggcggcgtgggaggacggcagtgagaggccgtgcggcaccggcaatcggtgtccaacggtctcgccgagggcttctgcctcatcgccctcctcgagttcctctactaggaggcccccgacgccatgcgcagcctcacctccgcctacgccgccctcgccgatggcctcggctgcttcttcgccggtggcctacgccgcccttgctggtggcctccgctccttccccctccgtcctgagaagatagagtgagagagatgagaagaggggaaaagagagagtatgctgacgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcgaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaaggcacgcgagccctagccgccagccgactcgaccagcgcccggaggcggagcacccgccgccgccgccctcgccatcgtcggcttcacccctcatcggcaacctagtgcaggtgagctccatctccacccctcctcatctcctctcctccccacaccatctttcctagtctccctctgttgcttcctcggatctgcttcgctctcgtgctctacgcctcacacgacgcgctcttcctcgtcgccaccaactttgttgctgcgcgcgcgtacgtcggtgcgctgtgcgcgttctacttagtttgccttgtgatgctgctcttagtcgggttagtgcttcgtgctgtgctcgctggtttggcgcttcagatctgtgtgctgtttgctctcggagacgctagatccatagtcgtcgacttgcaaatgctgcgagctaatatgattcttgttggatttcttcgctcctagcgtgagaaatccgaagaattgggagaacacggtctttttttttgtcccaataaattggttggattgttctagtatatattttttattatttttttctcccaaattgttggaatggcttctccctctttcccaactggttggattccaaattgttggaatggcttctccctctttcccaactggttggattgaggtgaagcgtgcttactgtattttttccacctggatttggtactatctttactctctgaactagttgggaacggatattccaatctcctgtctcttcgtgtgacttctttctgcttccacgtggggttctggaatcttcaattcactgtagtataagttcatatcttatttattctcatagactatgatttggtcgacttcgctcatatattgccgtgtagtagagggtttttacaattattcacgttcttggattgctgagatatcatggttagttgtgctgtttgaactggttatggccctcccgctgtgaattgccaaggtgtctgaatgttggtgattttgtggatagttcacgtgttggacaaagaatgcattataggagtgacaaatatgactggtttttgcaaaaccggtatatattgtggttatgttccttggagttacaaataacttgcagtaatgtttgaactgtgggatggttatgacatacatcttatattgggtcgtgtgtgaactgtttgttcatctggatgatgcataattcacacgagttggatgaaaggttctacctgaaatggaagaatatgtttggtttctgtaatttcgttgatttgttggttacatctctttgttgtatattttatctttttaggtgatgtagctatatctgtttccttttatatgacaagacgttgtgtgaaagagggttccagatttatttagattttacgttgtcattgtggtcttgtggtaattgatattcattgtttgttcagattattttaattgagtattatactccctccgtttcataatgtaagttattctagcattgtccacattcatatagatgttaataaatctagacatagcatctatgtgaatgtgggcaatgctagaataacttacattatgaaacggaggaagtagtaattaactacctttgtacttattttgaatattctacttgttcgttctaactatttgtcagtagagcattctaacgttttacagcttggcaaatttttgcatgtcattatcgtatccagttttccacctaactgaaatccatgtcctgaaattgctttttcataggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggtactgcatcctactgtctgttttttatttattctccccttggatgttgacttatattgtacatttgcttaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtaccgtggattcaacatctcctgtgttggtatcattgtctatcgtgggctgtactttggaatgtatgattctctcaagccagtcgttcttgttggcaaccttcaggttagtgaagtgaatgcaatctttgttcatcttctggcaattttttatttattccataaggttgctccactaaaatacctcgcgctcaaatattttgcctttctcattgcttcatttgttttggtttagttgaatctactcaatgtctctatactcctgctggttgttatatttacttctgataatatgtgatatatgttattttcaggataacttccttgccagcttcttacttggttggggcattaccattggtgctggccttgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaagactagatgatgatgataagcagtggggaactatggacatattaggtgctttcggatgctgttgcgtttaaataaatttaacgtatggacaccgtttacatgttattaggcgtcaggtgaggtttctgagtgtgtaaatcggtggcagatgcttatgccttttttgttgggggatcgagcaagacgagttttcctagttgaaaacatgccaaattattgtctgtgaaagcgtttcttgagattgttattgatgtggttcctagtcgattatatagattatcactccattgtagcatcttcgggattttgtcttatctaaccacatatgcaaaaaaaaaagaaaaaaaacccttgttatcttattatgtgagaggtaggacttagaagctgttcaggatattttttgtggtttgcaagctgactttctgaggacataacattccttgagaaaatttaatttgtgtagataacacaagcacgcaaacatccgcggggctgcgctgacatgccggagtagtaataaatgaaacagaaataaaactcctcaaggacttgtttggttaatccttgtgaggaagggattggaaagccttgtttagttaatccctatgaggtagggattggagcaaatttattccacatctattgtggtgtgaaattattaaatgaaagagaaataaaactcctctaggccttgtttggttaatccctgtgaggaaaggattggaaggccttgtttggttaatccctatgagggagggattggaggaaatttattccacatctattgtggtgtgaaattattctcccttaatcccctcccatcttcttcaatccactctaaaacgaacaaggctctctaaaccgaaccaggctttaagaattcatcctcgtgttgacatggcggagtagtaaatcaaactccttaattcgtctttgcgaagatgggaattttggggatctgtactccttaagaatgtcagagtgaatttgttttgtactcagtaatgtaggaattttaagcctcctttgacctttgggaagaggtcttgtacgatttgaataataatatgggaaaatttcttgttgagcgaacaaagtagaatttcttgttgagagcgaacaaaggagtgagactaagagaattctacaaaattcttttagaatgacaaaaacatgggtttttagaaacatgattcctacattttttatacaatttttcatacatagttttttgaaactaaaccgacaggagaactgtcaattatatttcaattaagcaggagtaaaaacacagacagggttacagaaaagaaaaaaaacaaccacttggcgagtaaactcgccaagtacctcaaccgtggccggtacaaatcacacagcacacggagcaccacacaacttctagccaaactaccacggcgaaatccaaagacaaacatcgacgctgagatgctgaagaagtggcacacgactttgacatcacaaggcgcatgtcatcgttgccgagcttgccgcccagcgaccaagcagcttcgacttcacggcgatcgcaacatcatacaaactttttctgtgtaaaactttttctgtgtatcgattttctagtttacgcatgtattcctattaaaatcatatccttcacgcgtttcaaatcaaagtagccctaagaatagtactccttgtgaaggaaattttacaaaatttgttgaactcttgcaagcaaatcactttgtagtttgtacgatccgattccaaccccaaaggcagattggtcagcatcaaatatggcaggctgataatggtaatggcacctacatcaccaacaaagaactgcgaactgcattgacggccacatcaatgggagaacatttctacgcgcatgatccgtcacaatcttacaacaaggcggccgaaaattccataattactactcccttccctctgttccaaaataccaaaatataagtatttttagctataaatttgaataactatatatctagatttatagccaaaagttattatattttaaaacggggataatatagtagtaatgaataatgatggctagtaagtttttgcactccttcactctgacaggctcttttttctctctcataaatatagtagagctaggcttcatttcgttaagaataagcataaaatcccatttccaaaggagggttcacattcatttcattaagaggaaacataaaaacccatttccaaacgagggttcacaacccttacgcgtactcctaccccaaaataaaacaacaaaacatcataagatgacggaggtagtgctcgtaagatgcatcacataaagatgacacacaaccaatttgataagcactaatccacaaaacatcatctttgccacacaaagagtggcagaacattgaagccaaaaacctgtccatgactacagcaaaatgttgcccacaattgctagtagtaagcaagaatagaatacaacaccaagcaggcataaaacagacaaaagtcccagcaacgggcattaacaccgactgtagcagcacatgcagctgtagtaaatatttttcaggtgatcgcagggaggaccggaggaatagtctggtaggtcaacttattctggaccaagatgtctggaatttatacagttgggcatcaatttggaatcttggttcacagggatggtttataccatcttgccacaaccagaacactgaatttgcatgctatccatcatgtacagaaaaactaagcaatcctagtgtttggattgaactgttattaagaaattcgccatctgcttaagcggctgtttgggaaacagggacttatcacatcggatgtttggacattaatttagagtattaaacatagactaattacaaaacccattccataactttggactaattcgcgagacgaatcttttgagcctaattacgccatgatttgacaatgtgatgctacagtaaacttttcataattatggattaatggcttaaaaaattcgtctagtgaattagctctcatttatgaaattagtttttttattagtctatgtttaatactctaaattagcgtttaaacatccgatgtgacagggactaaaaagtgaaaacatcaaatcatgaacaaattgtggcagacaacattaatactgaagggaaccatcactccaaagaaccatctattggtaatcatcaagtgaggtatatgtagcagtacagtattttttttttatctaaatgctaaagggaaccatcactccaaagaactcgccatcaaggagtgattagtgttcttagctgaatgatcaacaagtaaaatcccaatgcatgcgacagaatgcccattggactattccctactaagtactaattaattagacttgagatttctgacctgaatgaaagaattatgtcatatagagaattctccacaaatgccatccaaaatatccatcatcgtcatctgaatcatctgatcatcagtgcaatttcgatagattatgctacagcatggttgcttgatacacctacgtgcttttcttcgtcatgctctgcttccgttctctgaagagctccttccagaggttccaaatccacaggttgctgaccgtgatggcggtgccgacgacgacgatccaagaaatgcgcacccaccacgggatgacgtcgacggcctggccggacaggtagaagaggctcatcttgaggaagaagagcgggccggcgacgcccctgacgacggtgtagatgaagtagaagggcggcgacagcgccctgtacaccctcgccgcggcgggcttctcggcgcgccagatcccggcgagcgtccagacgttctggaggaggctggtgacctcggcgaggacgaggaggacgaggagcgcgtaggcgccgtgcggacgaggtagcggcaggtgacgaacacgaagagcgtggcgacgtggtgggcgatgaagagggtgtccccggggaggaaggcgaggtagtggagcaggtccatggtgaagtaggcgacgctgtagtcgaggacgtggtcctggaggcgggtgttgggcgcggcgaaccccctcgcctccggcggcagcgcgaggatggcgcccgccgcggcgagcgcggcgggcgtgccgtgcgcgagggagatgaggcagctggcgccgtcgaggcggagcggccacgcccaccgccggagcagggcgagttggccgacgcagtagatggcggcgtacatggccaggaaccccgggtacagccaccgctcctcggcggccaaagaatccagcacccccaccaccgccatggccggaccaagattcgcgccgacggagcgagggatcccgccgctcctggccggtctgcctccgattcgggcccaaccccccgcgtgcgcgcgaggcggaggcgaggggattcgatcgacgccggtagggtttcggcggcggcggcggcggcggcggcggcggcggcggagggatggatggctgtggagcagtgtgaagggatggacggccgcgtggatggtggggaacgaaaagggggagattttaaagcgattggttttggtttgtttttttttcttttcttttttcgatatttgtttacgtgggttttggtttggtttttccaaattaaattcaaattaattttgggttgagtgattaggtagaggattatagagggtttgcgtgttaaattggggttttggaaggaaggtcagtcttccgggtgttgtttgaattgaagattatattatggttgagacttgggtgccatgaaatttcttctcggttaactatcattacaatattttgctgagttggcacgagttttcatatcaaagttatatttttagcagttttatgaactgaaaataaaaaaaaatgtttggactttgtaatgagaggcacaatgccgacatggaaaaacaagtaaaattttgtcagtgaatcactcgaaacgaacgaacaaggtatataaatttatactcatcgatcagagtatcttatagtatatatactctttccgtgttttaacatatgtgccgttgattttatgagatatgtttaaccatttgttttattaaaaaaatatcatttattttattgtgactttatttattatcaaatgttctttaagtaagacttttcaatgtatacaagaaatttgaaataagataaatgatccaacatttattaaaagttaataatattatatattaaaaaacgaagatagtattgtaaatggctccttttgttttatactaatatggctgaatagctaaataaactatacttgtctaaaaagcgttaaataaactatatccccttcatcctcaaatataattattactaactatgtattttgataaaggtatgtctaaatgtgtagctaaaattgactatattttgagatagagacagtaaaaattattcgagagtagtataaacaaatgaattaaatattcgagggtaatattatttgggatggagtataaaataaaaaataaatctaacatagttttatcaaaaaatcatatataaaagttttccgtaaatcactctgtttataaacttgggaagcatggacatatatcaaatcatttcattaaacataatttctaaatatttagtcatttttcctccttacattaaagaaaggcatatacatccacgacacaagcttaacaaatgtatggatggatcatggaatatttggttacggagtaattaggtccggaagagcacacgctctatttcgaaacggctacttagatcacgtttcatgaaatgctaaatgcttgtttcatgcaaaagattttagttatatagaagttccattaaaaataaataaatctttttttaaaatataatacttaatactcgattaattatgcataaatggttgtctcattcagtgtgcccttaaaatttcaagctaaatagagctccaaatgaagccttaaaacacgagatttttttttctttacagcttgaaagtttgtcctcgcaaaaaggaaatagaaacattcagaataccgtctaaaggagaatcgcatactccatattgggttgattgggttggttccttaaacacggaagcaagctttgggctgtgtttaaatcaaaagtttggatcgaaacttccaattttttccatcacatcaacatgtcatacgcacacaatttttcagtcacatcatctttaatttcaaccaaaatctaaactttaggctaatctaaacataaccttggtcacgtagtatgcgtaaatgtgtcgatatctttttctggatcatgtgacagatcatggtattggcgaatattccacgcaatttggtatcatgataccttgtagtagtagatcgcgtgggggcgtgtgtgttgctaaagaatgtgattcttgtggcacactgctagctctacttgcgatttctatacactaacactaggctgctcctgtctttttcagccttcagaagcgaataaaattatcatcgctaaagtatataaaggtgataataaatgtatatatgttgtcataagagcaagtttaatagtatagccaactactggctccaattcatctatagctaatctaatagctcattcatacaatagttacatactacactattaatacctggtcccacctgtcatacacactgtgtcttggagtccgtgctacagctgtctataaatctgtagcccgctgctttcctctctcctcatttatcttcttaaaatatgtttgcagctggtttatagcctgttattgtacttgctttaatgctctaatgatgggcgatggcggcacggaatgtaagacggattaggacaagtttaacgaaattcgacggagactaatccgtggctaattgtttattgcacagacatgatttttcctccaacaactgcatttgatttttnnncccggctccaaactacacgtttgttccaatcttgtttacgaaactgcacctgtttgttgcaaagtttagttttctaaaacaatctgcaacaagtgtacttttgtgtttatataagggaagtgaaaagtgtacttttatgaaaccttagtacctgctcgctcttcacgatattcccgtacaggtgccgttaaatttacttgcataacgatattcccgtacaggtgccgttaaattcatttgcgtaatactagcaggcaaagtgttaattacaaactagcaatacaatactccctccatactgtaggacgccgttgactttttaacgttgataaaaaatcaacggcgtcatacattaaaatacacagggagcagtagttttcttagaccgatcactaggtgaaggtttcttcatctgaattgattataagtagggaggataatacaaggttcattgatttacaatggagcataaaggggagatgaaatttcttcacagggtgtaactacaatcctgcaatcgtatttcagatgctcagcttagagccgcatagcatcatctacacattttgttataaacctagcgagggaccgcaggtatgattccacaacctccaaaagcaaagaaggtagaaaaactggaagtgcttgaacggcagttggctgggaggctgcaagctggtttgatctctcatggaggagatgttcagttgcaacggtagttgattcagttaatgagaatacttacataatttgaagctatgatctacgaagaaggaatttgattcagtaatttgaagcgtagtagcaattggcagcagagttgaaaaaacatccagtcatcctatagaggttgactgctcctcaatgtcctccctcttattgtcatcgatgacggaaagctaacaagatgaacaaatatgctgaatctgcttcctgacgtgcatgctcggaaggtgtgaaatatgcctactattagtatcaactatcttcaaccacaacggactgaggtgcatgcttagaaatcatctcttattgtttggattgggtacccatgcgttgcaacggaaaaaaaatcaatttaagatcacatgttttaatcactcacgatcccatgtgactaaaatttgagccaatgccataaaagcgatcatctcttactgtttggattgggtgccaatgcgttgcaacgggaaaaaaaaatcaatttaagatcacatgttttaatcactcactatcccatgtgactaaaatttgagccaatgccatgaaagcgaagtaataagtagataatttgcttaataaaaaaaataccccctccgtattttaatgtacgacgctgttgactttttgactaacgtttgactcttcgtcttattaaaaaaattatgtaattatcatttattttattgacttgatttatcatcaaatgttctttaagcatgacataaatatttttatatttgcacaaaaattttaaataaaacgaatgatcaaatgttggtcaaaaatcaacgacggagggagtacttgaaaaaggaagtttaagcatgaaatatatgtatcttgttttatagctgaacaatattactaatgttttattttgaagtacacataacgttaacaatactattttttttttgcgaggaacgttaacaatagtatgaatacatgatcaacgagttcctaaatttttttgaagtacacataacgtaacgttagatcccactccgaacagtcaatgattatatgtatcaaatatacaacgtaacaatcatccggccatcataaaagctcatggtatattaaaaaaataaaaatcatctcaagagactgtatgctacatattaaatctaatgatagaagcttaatttggacaaaaaatcaacaaggcttaaagaacattaaaaaatcatgcttaaagaacatttgataataaataaagatccaaaaaatcaacaaggcttaaaaatttaaaaatacaaccagctactaatttgtacaatttaatattccaagatgacatcttatatgtccaactaatagaaaaaaccatgactacagacatcatgataacagcttacatcttataggtcaacatacaggaatgatggaatttattgacaatgaaatgccattaggaacatgttagttggacagtaacactggatatttcagcaacataaggacagctacacagactgaaatagattctacatgtgtgtacatatatgaccatataatattcatatttggtgaaatcactctgcaaatctaatcatgcacacatagtgtattaatcttatttttctcaactaatactaatcgaattagttataacaataattgaaaaaaaaagaatgtgataaatgcatgccggatctatcatgtttaactgcatgtgataaaccattgtgtacggtaaatgaaatatgaaataagtttgactgatattccagtaggtaatgatttcaacagttaatataaaaattgcaaagataattagttagtacacaatattctttgtgcacactagatatacctcgtctatgctatgaggacatccttgtacacaatattctttgtgcacgttgtagtatgtttggaccgtttgtttttcttcctctctttgtcctgcatgagagaatcttgatgtttgttcctgaagttgctctagacaacgtgacgtagagctgaccatgagagaacaccggctccgggaggtagacgcctgcatttggaattgtttgtccttatgccttattgatcgtcaattcgaaacatagtctaattggaaacaactttctcttaaagtgaaacgggaacatttcatcatctaaaaggcatagaggtatccgaggaaggaaaactcccttaccagcatgctgccctaccacaatctccacgttaatagcatttcttccgaacccatgaaccactagtggccttgtcccgtttcaaagtccgttggctgggtcaatgttcctcaatagcatgatgggtagtttaacttcagctttagcacatgcggaggtagcccgtttggagttagagagttcaagaattcgggcaggtaatagctatgagggtcatcctctgctcggtaaaaaactatgatatgtcatcatctctcctcgaaatcgctcgatcattttcatgtttattcgatccatgaactcattctgagtggacattatggccctagatgtgatgtagtttgggtccgtaaggttatcatttaggttggggaacacggtatccatgagcccatcgaggtccgagtcaatccctttgcatggcacacaaatatccgaagtcaggtgtatgtgtccttcctcattcacctcctcaatgccattcccaactcgaaggaggttgtccgcaaacaaaaggtcggtatgcgccctcttattgcgaacaagcttcaactgaactatagaatcccaaagatagg

SEQ ID NO: 70371 - DNA, 686 bp, Oryza sativa
atatggaaatacaacccattcttgtggtagagcattttccagtcatggctagaaaatgacatccttctacaccagccagagtagtacccttttttctgatatggttacctgttaatgcattcaaatattactcctttttatgtgcttaactctggatgagatcacacatgaatatgattgttagggtgtcatgctctctgttattatcctgaaaacaccgtcattattgaaactgaggtagtcaagaccctgctggtttaaacaaagtgcggtgtgcatggtgttatgtgatagtttcgaattataactttttaattaagtagatctggacacacatagacttacaatctccataatggctataatcctttgtagaagtaccttctattccaggtttcaccatatcagtataaatgctttatgcatagacaaatcaaactaactaatcatgcacatggttaaaatgatggcaaagcagaataagcattcttctgatattatgtcttcagggtcttgtggcaaatcatgctgatatagctgactacttcaatcgaagaggagtctctgcaatatttctcttcaggtggaacctcctccgtcagttggtatctcaacttgcgaataatcatgacagatacctcaagcagttgaatggaacgcacaaggcccatgttcacacggcatat

SEQ ID NO: 70372 - DNA, 3733 bp, Oryza sativa
ggtcagacgcgtgagtaaaagtcaccggcgtcatctattaaaaaacagaggtagtatcatatttggtactgaagataccataatgatgtcagcatggtatcgtgctgatgtcatctaatcagttgaaacggtataccgttctgtagttaaaaaaaaaaactctccttaagtcaagagggagagcgcgcgggatcgcgtctgccgcctgcagcagaaagcgctcgctgcaatgtacagaacctttgccatgacacatgactgggactactaccatttcacaactcacagccaaaaccaagcaacaatgtatgtacacaacggcaacaacctgcacgccccgttcgattgataaaacagtttatgctggtgtatgtatgcacagacgaatcaccaccgcccaccaccaccctgcacacactcactactcgctactgaacccacaagtttgaacatctccagttttgtccttgctaacatatctcatctctagggtctgttcacaacagctacatactataggtaaaccatcttttttcagcaccaccacacaaattcaatcggaacgaagagaaacgcagagacaatgttgcgaagcgggtgttcagcagcggaatcggatgacgatgcaggagatgtcgtccttgctcttcctcgcaagcgcttcggtcgtcagtcgcttcgctgctgcctgggggtccttgatcgacttcacaagatcgacggcttcctggttcttcattacctgagttgagcaagatcataagatttagcaactgatttgtggatgtactttgttaagggcggaatactcaaatatagattgatgactaatcatggagatcacgaggatcatgcattttgccacatggtaagtgcacaagaaaccatgatatgtacaggtcctaactaaacaatagatatttttgctccgagaggaagcatggtaaaaacaagcagtatacaaggacagaagaagcgaaaggaaaatggagatgcttataaactcttagcattaaaaagacaagattaatgtaggcaagagttttaaggaattatagtaccaaccttccatagtccatcgctggcaagtatgacgaactctatgcttgaatttattggtacatgcctaacatcaggttctgaactcaagtgcgccttgaggctttggtccccaaaggccctcgcaacagcaagctgaccatttacccggggaacatcacctgtaaacaggtcatacaataaattattaagtaacatgaacttttttattttctgaccaagaacagtgatgagacagctgaacaacaaaaatcataccaggaaatgttgttacaaagccaccctgcttctcaatcctctgcctttcattagttgtatgaggttcatggtcaacagtgagctgattagcagcacctctttcacacacaacagctcttgaatcacctacatttgctacccacatatcctttccatcaacgacaatagcagtaactgctgttgaaccaccaggtccaagttgtttggcattctccaaaatatatttgtttgtagagcggtatgcattcttaattgcttcctgagggttagtccagaagataggctgcaacatcagaaaaggcaaatggtgagcaaaagatacatttgtaaggtaaatggaaggaatgaacgtcaataacacatattcgtagttttgcaggcacataaaaaaaaccaaaaaagtaatgcttacctctttcagtatgttgcagaaaaggttagctttcaagtaacttggaacactgtctcccaagtgaccatcaaaaatggcaaagagaccaagctcatggctcttgtcatacttgtactctgccacatggtagtcctccatgtcatgcccagatttcccttccaccaagtggaatccatgagtcactttgttgcttgactgcttactcctccccttgccggtatcggtagatgacgaattaaggcatgttgcactctttaagaccatacacaaatcaggcaaaccaaattaatgtcagtacacactgatgataacccaaacaagaccaatgaagaaaggaggtgtgaggattccatgaaaatggcaccaaaatcagcatgcacaagttctcaaaaacttaaagaaaaaaatagttcactgtacaaacaaggttgaaggttgtaatcgtatcaaatagcagcattcacagtattgttcgtgttaatgaataagaacagaaaaaactagtcttgtggaacaccattttccttggctttgaactttcatttgaaattgtgggcaaatcagagtttttttggtaaacaagttatgaccttgataaatcagcaatgtctagttgtctctatgtatgacaaataacatttttgccgctgatagacaaatgtaagaaatctcaaaccatgatttaaaaaaggagaataatccatccctgaaaataatagtaatagactattcataggaacaggaaagttccattttcatcaatgaagactgcggattgtgattgctgagaatagtaatataacattttcaccatttttgtagttctaaaacatagaatgtattttgtcagaaaatgttttgcacaaattgacagaaatagtcaatagcatatttttttttagataaaagcacatggtccagtactagccttcctattgccaaactattcggagaacatcactatctgtaaagtggtataatgtatgcaaggagcagctatattattccgaaacaatattctgcaaaacatttattagatgaacaacaggacattttctaaggtccaagtggggggccacggcatagaactgaaaaacaaacaagaataaaatcacaatttgcaggtaatattagacttcataggcgatagacgagtagtattcatccttttttgtttccaaaggtgatgtaatctcctaacttagtagacaacgcacatgatcaaatcctgaggatcatgccgataatcccccaacctctgctcgatatctgcaatagggatacttcaagagctactttacgggtggtccaggtctgaactcataacactcgtaagcatgtgaaaacaggtgtctagcaccgcaagttactgactcttgcacgtcattaaccacagtgtaatcaaatcctgagaaaccaattatcaactacacacaccaagaggcaactttcccaaggcaggcaagaacagatgacagttttctttcttgtttgggttcataaacagacagaaacacataacattaaaatataaaaacaagggcactaatatcataatctgattgcttgaagacaactaccgccatcattccgataaccacagataaggctaatgatttgcatgaactggtctggtttggtacagcaaggttacaagcttaagtagggagcaatgctatacgtactaaatttttcttactaaacttttactaacaatcatctcaatcgtttgatttaagtagatggaagttacaaaaaaatctagatgcactcatagcataacagtgttagtaaaaatttagtaaaaaaaagttactaggtatatccttttccttaagtaggtgcacagcaaggctccaagaaagtacaagttgcttacggctggcacggcagcatgggcgcacgcgtactaagtcaaaaaggaggaagcggagggttgcacaagtccgactttgcttggaagttgcaaccccatacttggagatcctgtgactccaagttaac

SEQ ID NO: 70373 - DNA, 3054 bp, Oryza sativa
tgagtggatgtttcgataaacacggatattaatcagatgctaaaaaaacgaagctcctttcaatcaggcaggcaccagcacatcaaagagggtaaacgaagttaaaaaaaatcaaaaattttgctacgcagccaagaattgaaccgcatgaagacaactcaaaatagtcaaattaaagaaaaaaaaaggtaggaaaaaaaagaagaggcgcacgcaggcaggcagggaaacatacccggatcatgttgagtatgtcgggccgcttcttgcccccgcaggccgaagacgaggaggaggtgccggcggcggaggaggagggggagcatgacgccgacgacgacgccgactgccgctccatccgcccgaccatgtcctgtccaatcaccacggacacagaccagctcgctcgctcgctccccactcccgacgacgacgacgacacagcagcagcagcgcacggggatgagagatcttctggggggaggaatttctatcccttggtttgcttctcctgatccgattcttccaccaccagccgagcccgaggcctctcgcggcgcggacacctgtggcggtagcgtgaggagaaatggaatggaatggaggagaagaagaagagaaaaaagaagttggagaagaagaagagaggagagggaggaggagtcgttgcggttggggtttgatgattgtgttgtggtggagtggaagagccgctggaagtgggtcccacaccagggagggggcaaaaaaatcggctgaaaatgaagcaagcaagccgcacacaggcacaggcgcacagctgtggaaaacctggaaaatggaaaacattgctgtgcccggcgtggatatggatggacacggacacatctttgcgtgataaaaacaccaaatttgaaaataggttaatagttttttaaataaaaaaaaggatggattcatgaacagatatgttttcgtaggaatgttattctatcagtatatttggatatgcataaaaccatgcacttatccgtcttcaagggttattgacaaaattgctccctaaaagttttctattgtctagtattgttgattacgtgtataaattaatggtatggctcgaagtgatacgtgtcaaatacttattgtatgtctacgaaatgtcgatttgtctatatcgcagaaataattgttgggttttttactattgacaaatcatccaataaaagtccttcattgtcctcgacgatgtaagtataacaataatatatcttatttagttccgtactaagttagttttgactttcgagtgtggtacatatttatttttatcaacacggaatactgaatttgctctagttgtaaaatcaataaatttgtccctttaaagttcatgtttttaaatacatatgttttttaaataaatatgagggcgagcttggatttggacatgtccttgtgggataaaataccaaatgtgaaaataaatcagtgttgattggatagctacaaatttttatgggcataactacataactctatctcaaactaaaccaatgttgtgtaaattgtggtatacctatttgctaaatactttcatatatcacatgatttgatcacacgaagacatttaatttgcaaattatttgatagatgcaacttactccctcagtctcataaaaaaccaatttattactggatatgacacatcattcgttgtactaaaatgtgtcacatctagtagtagatttgttagatttgtttgtttaggacagagtgagtagaattttgacaagatgatccgtacatattaattggtttccaaatttcgatggcttttttacctcacggcttggatgataaaccgatgcctgtgcgaaccaggaaagaagatagaaattttacaagctaaatatgtttatttacaacctaaatattttgctatctgcagttcggcacgcttcctgacttctattttcatttcctttgggtatcgtttttcgtttcggtgcccgggagcttccaggaagcttcgtccagctcccacccatggcaataatgctaggtgcacacggtgggatagtctgtcttttcgtttgtatctataccatgatttcaactaaatcgaaaagcttggcatgatttccatgtgtcccttccttagccgtgttaggttgcttctaaaaaccaattcaaaaggctggcatgggataaccacattagaccctgtcccaaaagaacaagtcatactttattatgtaacaaattcaagaacacaatattttcttttgtatctgtgctatgcctttttctaacaaacttaaagataccacaattttttttttttgcttatagtgtcatactccatgacaccatatatagcaggtattccactttaaaacacttctcttcagcaaactttttttttgaattattccaaaaggggcaatgcaacgtaaggtgcatgactctctcgtatcctcaaagaaaataataaaagagatatattatgactttttgtgggtgctaatgtttgagtgcaccgtgcacgatattacctaaatggtatccacaattacatagatataggtgttacaaaatgcatcttatataattattcttttgactccatgttatatttgttcgatgggtttagtggtcaaaacttatacatattatatatttatatatacagttgcggagaatgaactcctccaccagggaaccgtgaggcctccctttatgagttcggccgggggcagcgagtgagattcgagggcttggtaagcgaagctgtgtgatttgagggggttcaatcccccaaagacgatgagacaaaagatgtttatacaggttcgggccactaagaagcgtaataccctactcatgtgcttcattgattgggtgtagaacacaagtgctcggggttgcgagacccaagtgccgacttctctcactaggcctggatctccttttatacctcaaggggttaccacataggcccaacaacctaacttcgtcgagaagtattacaatctttgcattaaatggcatggtcttggttccttaacttgg

SEQ ID NO: 70374 - DNA, 12102 bp, Oryza sativa
cctttaggggagggccacgtggcattggagggccgcctcctccgactattctttgggaaggagtggccgccaccccacctcgggcctgactccccttggggagggccacgtggtattggggtcagcctcctccgactagtctttgggaaggagtggccgccaccccacctcgagcctgactcccctaaacatgatatcctcgggcccatatcaccgacaacagttgcgaagacaagcataggacaattaagagtccagccatagacctgttttcttaatcctttaagattccattgtaaatcgtatacatattaagattgttaagcaaattattagttcatccttggctttgatagtttgatggttttccgggtctttccctatctatatgtatacatcttaattgtaataaaaaagaaaaaaacaaagaaaatgtatgagtagcagtgggtagatctgttccggaagatgagtaaccccgttgtacaaacgtacagtataaatgactctctaatataaaggggatgttacctttgttttttccaatatatgacacatcagaatcttctaattcgtttatctatttatttctttagatatttatgcaaataaataaacatactaggcataaccaaagcatttttttttctgatagtatcacaagatactctattcgctattttttctaaaacaaataaaatatttcctccattccaaaatataaaaaaaattggttgtatgggacagatttatagtattaaaaatacgtcctattcaatcaaaactctatatattttaaaacggatggagtaaataataatcgaataaatatttgtggtctaagtttgagaaaaaaaaatcaaccgtatcacatcacacatctcaaagaaatggaggaagtaccgggagtaccgagtgctgtacaccggtacagtgcgcacgtatggagaacggcggagcgttggtacgcatggcatggcgttggcgttggcagggtcagcagcgcagcacagcacagcagggcgacggggggaggggaaggggaccatgcgctgcgttggcttcttctgttgccggttgacccgcgccagaaacagtcggatcacccgtcgtcgtctactaccgcgcgcgtggggacacaggctgccgctgctgctgtgtcgcgggcgcggacgcgcggtggtggacggtagcctgccggtcagaacgacgtacgcgaggacaagcagctagtagctagccggccgggccggcggggcgtgcagggcctgtggcctgtgccctggccggccggccaccgcgcggcggggcccggacaccgccaccaccacccgttccgatacgaggatcgcattcggctacaattacaaaggcgcgagggatttttttattcggtttttgaacttttctaatttttattttttactagaaaaaacgtctgtgcgttacaacgggtgaattctattttaatcttattattgttatgcggtttagctagggtaaattcactgtgaaatttcgcttggatattttttttaagaaaatcatgagctgcaattagtagtctgacttcacttcaagttagcatgtggggtttttttaaaaaggatttcttatacccctccttttgtattttcaaaagcaaacgaggttaaaatctaactcaaatatggatatgtatttccaaaagcgaacgaacttaaaaaccaactcaataccaaaatacccgaaaaaacgtggggcctcccccactgtgttatgataaaaaaataccagaaaaaacatatttaatttttataatagtagaaaattttgaaataaacctttcaaaaacttattttgatctaaacattttaaccacgccagtcgaaccggtgtgacaaaacaacgatatcacgttgatctggctagcacgagaactctatttgctcgcgtcgatctgcttgacgtaacaatattgtttgtgtggcaaaaaaaaaactgtcacacccgttgtgtgtggtgtattagtggcctgattaaaaggtttagattttaaaaatagattttgcaatagtttatttttaaaatttaaaaaataaaaaaggcttaaggaaaatcgtgaggcgacgaggggttgggtggggggcttgcccggcccgcggcgacgcaggggggcacgtgcgctcgcgtccacggtccacggcctgtctgtgtctgtgtcttgtgtctggggttggcttggagcggctgacctgtcaggtgggaccgggtcgccctgtgggggagcagatgactagacgagcggcacggcaacccgctcgtctctttcagccaggccgtagggccagcaaaagtcacggatcttcgcgttgccattgcaaaacgaatctagtactacgcctgtttcaaaataaatttattcttcattcatcttgtatataccaatagaaagttagtaaaaaaaagaagaatatcctaactttaccaataccaatacaactattctcactttatatactttcaatacaactattctatacttttataaattctgagacaatgattactctaaaataaatttattttgaaacaaataaaagaaactaaaaatgaaattattatgagacgaagtaagtaatacttttttcgttttataatatataagtatttttaaattctaaaattagaccacctctgtctcaaaataagttcatttttcacccattccacacatatcaatacaaaactaaaaagaactatttctcattttatctactcctaatacaattattacatgtataaacttggatgcaataattagtataaaataaacttactttgtgacaaataagaggagaaaaaaataaacctaatacgggatggaggaagtattataatataagcattcatgtactgattttcatggctcctaccatttcaatgattacaaagctaatcagacactcgaaaaggaaacataagcaattcaaaataaaaaaaatgacaagtaaaatgactaaaaaggaaccttttgacttaacttgagtgttcgttatacaatctaaaaatccttatattttataacggatagggtactttcccatgagaaagtattaagaaatagatttatttcgaaacaaatgtaaagtatagaaacaactacatcttagaatatgtgaagtaatatttgaaaatggtaccgaaaattactaattgacttaaatttattttctgttagtgttatattgaatttggtgctaaatagttaaattgacggatatgcatggaaaatcgatagacaaccgagaaccatttcatggtatcgttcccgacctgttttcatcccgtcctatttccgcatttgctgaaggccatgagttgcaaaatagcaatcctgcgagctacggcgagcagagaaaatggacaatggacatttagaaagcggtttcactggaatgccatctcgaaaacatgtttcgctgaaatgccaatatggagcgtgtgatcacagtgaaaatggtaaaaatagagaaaatagcaaagttttaacgaaacgtactttcgagatgtattctagcgaaaccctttttttaaacgtggtcaaatatccattttctcacggcgagcacagcgctcacggctacgggagataggaggacaacgcccggccggtgcgtatgagcgtatcggcggcaagtgctcccggccaacgacgcacccaggattgatagatccggggcagcgatgggccggggtcggtcgccactcgccaccgcggatgcgtgatgatcatcatcatcagatcaggtgagattgcattgcgacggggtggtggtagcgcccgcgcgcgagtgcgttccatgattgcgcgctactatagctcggaagtggagccagcggccagcatgtcaaccaaaggtcgtcgcgtgacgacacatcacctaatgagtagggaatctcagctaatggataacgagatgtcgctaggaattaaatttagaaatatactattcattcattttatttttagaaatattcggaattcaaaactttttacaaaaatataccgttgatctcgtacaaccattacgcgaaagtgacgtggacgtgacatcatgggcggtatcgcgctaggaaagtgcgagaccgcgcggtctcgcgaaacagaagagcgagaccgttcggtctcgcttaaccaatcagcgataccggatttcaaaatggttaattagtgattaattaccataattaacgattaattaattattaattaatcgctaattattattagttaaataattaattaggtcattagtcactaacctaatgcagtttaggacggtgtcgctctctgcttgagcgagaccgctcgtccttcccgcgctctcgcgccgtcgccgcgcgagaccgcggggtctcgcgttttctccgcgcaataccgccctcaacgtcacctctgcgtcattttcgcttaacggtagagcgagatcgatggtatatttctacaataaaatttacatcacgaatatttttgaaaataaattgaataaatagtatatttttaaatttaattcatgtcgctagccactcctatctttggtttaaataaatgtgaggtcttgggcgagttatgaaagaaaaaaaaagagaaaaaagggtcttgggcggcgtcaaagaggtcagggaggaactgatgagccaggtgagtgagtgacacgcctcgcctgagttgcagatgtggctgcacatcagcagtacaccctgggatgagatgccaccacgatgcatgacttgcatcctttggattgtagcaatgagaaaacgaaaaatgtagaaaaaacgcgagaatgattgtttaactgggccacagacaaaacgtaggaatcaaataataaaatagactgatttttttttcaatagattgaaattcttactaagttttcttcaaaatctttataagattattaatgtcataagaattttgaaggataagataggatttaatcattgtttcaaaggcttttctagtctttttctataagattaaaatcttttaaaattttatgtttgattaatcttttaaaattttatgtttttcctacaaattaaagataccttagtcgcagtcatgagtgatcggtaagcaagtatactttctaaccatttcgcaatacattcagtaagaactccacaagaacaattgagatgcttctaggggaaatgatataggtaatatgcttaactatttcttttctcctgaaacctatcgcattgcgaacaagtcatactagtatgttaactcatagtgcaaaatcttgtcatctgatcaacgagaccaacaactccgcaacgcctgattttgattctatggaaactcaaaaagggataagagtaatcgctatcatgcattcgttctccccgcacctaacaatcaagatggcaatgtaaaaccgtcaccacgcactaggaagagtctaacgatcccacgcaggtacatcactcaaccagtaaatggaccaggaaggccaattcaacatcaacacaaccaaaaggaaatgggaggattgcaattgactaatcttttcccgatgggacgatatgtaatacttgcacacatctatggacagaaaaaatggtatagagtatagacaacctttcattctgatgatatgcagggaataagcaaccgtggcctattcctccgaaacagtatggcgccatattggtgggtgcgccctcgcatttttcttttttctgatataagctggggtttagttgttttacatcccaatatacaacataacaaggaaatagaaaagaggggggtagggtacaccacatcttttacatacagaagttgagggtgtatttacctgcctaatttctaagttgacactgtcacattagtcatattagcttgctggctcaataaaaaaacaaaatcaaatgtgccgcacctctgagctgctgcatctaacatcagaaagcgatcgacaccaccaatatgaatgtgaacaaaacaaatcaagcctatccatgtcagtcatcaatatcttggacccactgtaagcctgcaaaaggataacataatgtttaccactctcataaataagaatatggtcttgatttgagatgatacatggcattggaggaatggaagtgaccagaatccacacagagtgttcaacatttaaagtgctggaaaaggagaaaaaaatactggcacattccacctctggtccttctgatttctccacaacgatttttttttctttttggcagagcccaatgaatgaaatcttactagaaaatgccatccacaaacaaatgagctgcccaagaagctccatgatataacagtagctcagtttaccgttgcacaattttatctccatagttcaactaccacaagccgtacctgattctccccattggacactaaccacaacaaataccatctgacaggaaattctgggaaatcataaccaacctgttaatactgactccacagctgaattcggaatgagtagtccaacgattcgctgattgtcagttgttgtctctaaacggacaacacgtactcgcttgtgactttgacgaacctgctcaataacagcagcaaggcacagaggcgttaaacatcaaacaatcatgcaccaattcagctaaagcataaaaatccagagagtaaatcattctgtaactttgttttattgtgagatactggacttctacttttagctttagacaaaatcatctagctcttgcttgatgggtagaaaggtcagagcctcagaggattcttttagggaaatatgtccagatcatcattattactatggtgtatgttctgtgttgatgaaggaatcattccctattaagtattggagattcaagttaacaccaaactttatccccttattttcgaatccaccaaatctctttctaactttagttaatgccctgagaagctctgtgctactgcccctgccatccagctacactcaagaccattttactgcctgtcctttaacttcttagctttgttcatcaaatagatttttttaaggtactttcaaggggatccctttaccttaccctaaagactaaagagtagagactccagagctttgagaagtttgtgtctacatggaaaaagcggatgacacaagagccaatacaagagacgcaatgccaagatcggaagatctaaaatcatatcaacccattgaatatatcggaacccaccattcaattaagatgaaaaagtagcaaccgtaagactttagaataagtggcataggagtgaacctgcttagctagggccttttctattgtaccccaaactggaagtatgagaccacccaagatgttaacctcttgcaaccttcttcccactgtacagtagcttcccactttgcatttcgatccatgcatacactgaaatgaagcaaaaagacactagataagttgtagacacagtaacagctcaaccgttcatcatcctaaagtaaattaggaggaactgtatgtggactatggaaaaatgagcttcatcctcaaagggaataaaacacaacagatccacaaacaaattgctattcacgatgaacagatgcacgtggccatgaaattacaaaatattcctgcttgaacaaaatattctatgcttcaacaatttttgcgtgtatataaaaaatcaacatcgtaaaaaggatgtgttatgtccctcagatcataatgggaaaacactgtcagcgccatataccttgctaagtactccaatgataattattatcttcaaatcttgcttaacttccaatgattacaatatgcccctttatataaagttcccccctaacaaatacagatcaaatttatctaagaataactttccctaccttataactactccattcatttcatattataagatgttttaggtttggactaagtcaaacatcttcaagtctgaccaagtttatagaaaaatgttgccgcatttccaacacaaaacaaacatactaaagaatatatattcaatggtgtatttaatgaaactaatttggtgctgtagatgttgctacatttttctataaacttgatcagacttgaagaagtttgacttaggacaaacccaaaacatattataatatggaatgaagggagtaagatacttgacaactaagggcccgtttggttgggattcttaggagcaattctagcaggaatcggttggagctgagccaaacgggcaatttcccctcagcttccaaagcgaatcaaccgggatcgattcccttttttacgaaggaagggagaatcggcggaaagcgagcttctgctgagaatcaaaccaaccaaatatgaaagtccccatatttttcccaaaaaattacccgcctgccactgggtatacccctctttccagccttccccatccacccgagcagatcgatcgacatcacgtgctagggttgcgggagccaggtgacggcgctccccatccagcgccgccatccccgccggcgctccgcatcgccgccgacctctcccgccgacgacatcgccgaccacagttcccgtgcccgagccttttcccaccatccagccaccttcgacaccactgccggtctccatcctgccactcccctattctccctcagccctgcagatccaggccgacaacgccaccagttgctagtgttgccattctccgtcgagctccctaaacaggacgaccagcactgactgggcaaggtaccatgtcctgaacttctccatttgattagctttgtatgttgtactgttgtgcaaaatagtagaactgaattgctcactgcgatgtggatttgtgtgtaaataatattgatgtggatttgcactctgatctgtgtatgtctaaatagttttgatgtgcatctgtgctctgatttgcatatgtgttatttcataagtactgcagatggcagcaacagtagtagaggaaaatcaaggtgcaaataatgctgaatggacagatgaaaacactaggatagtttgtgagttgttcgctgaacaagttaggataggaaatcgctcaaatacccatttgaacaaggtggggtatgataatgtgattgcaaaatttgaagaaaagactggcttacgctatcaaaagctgcagttcaagaacaaatggagcaagctgaggaatgagtataatctatggaagaaactgatagctagagagactggattaggttgggaccaagctagggctactattgttgcatctgatgattggtgggcaagagccaagaaggtatgctacatattaatgttgatgtttaagttgttaaccatgattttgcaaatatttgtgtcactcttctgattattcccttggtgttcctctaggatttgccaggttgtgcaaagtttaagttacgggggattcaaaatgaacatttgctccaacaaatatttgaagacctttgaaacacaggagatgaccactggaatcctactagtggaaatttaccgcagagttcaacccaaccttccagtactattaatgtagatacagaagctgtgaatgaaggtgatgatgatgatagtaacgatgatgatttctcacctcctcccaagagaggtaaggcagcagctggtaaggaagccaagaaacccaagaccagtggtggatattggttctatgaacaaatgagtcgttttgttgataaccaagagaaatcagccgcatctgttgagtctcttgtcaggagggaggacacttcagggtgtgccatcaaagatgtcatggctctagtgaaggaatgtggtgctgtatttggtaccaaagagcacttcattgctactgagattttcacaaagaaatctgagagagagatgttcatgaccttggataattcagaagaaagatttgcatggctcaccatgaaacatgaatccaagatggccaagtattccaagtagtggcctagcatggttgtgtttgttcaacaaatgtcttgctctgtatctttagacaattttatctccaagtagtgtttttatttttttttattgttgtaataattgttggatgtgttgactatcccctattttatttactggacatgtaatgcaaccaagttctcctttaattaatgtattgttgcatgcaattgtatttcaagtattgcctactgacttttattacctactgtattgctgctcgacatgtattgatgttgtcaattgtatgtgtacttctatacttgccttgatgcttgtcacttaacactttctttccatgtgccagatgtcttctagtgaaactgatggaaatgagactttttctgaaagtgatggtactgatctacatgaagatgatgaggtttccatacaatcagttattcgtcatcatcaagcattggaagccaatcttttttcagctgcctgcttacttggacaatattatatgacgtattatgataaaaataaaccaaggacgtcagtactaagtggatatgcatgggtacaagagactctgaggactccaggagagagtcaccacatgtttcgaatgaatacagacctcttctacaaattgcatgacttgctggtgagtacctataacctgaaagcaaccaaccacatgaactccatggaatcagttgctatctttcttttcatacttggaggtggtgagtccaatagaagggttcaaaataggttcaagcattccggtgaaacaattagtagaaaatttgaagaggtcttattgagtgtggttagtatgtgcaaggattacatgtcccaaagatcctaacttcccaagggctcatagtaggattaagaatgacaaaagattatggccacatttcaaaaagtgcattggagccattgatgggactcatatcacagcaaacccacctcgtgaagattatgttagatacattggtagaagcaagagtcctactcagaatgtgatggcagcagtcgactttgacatgcgatttacatattcttctattggacaaccagggtctatgcatgatactagcgtcctttatcatgtgttagatgttgataaagatatatttccacaccctccacaaggtatatactagctgaaatcatctacactttgctttatcttttatttgtaccatataacattgactcgatgcatatatcgtaggtaaatattatcttgttgatgctggctacccaaataggccagggtatatggcaccatacaaggggcaaaggtaccatattcctgaatggagaagaggtcctccaccaagtggtgagcaagagtattccaaccaatgtcactcaagtgcatgcaatgtcgttgaggcacctttggtgtgtggaagatgaaatggcggatccttttaaagatgcctacctatgcaatggacaagcaagaaatgatcgttgcagctaccatgtgtcttcacaactttataagacagaattcgacaactgacaagtattttcgtaggtgtgatcgagatccaaattatgtcccaactataccaacaagatatgcaagatatgttgtttcccaaaatgcatcagatacctctactccatagtctagtgataggtctatggacagatttcgtgatgacctagcaactgcattgtggcaatctagatgaatgttctcatataagtgctgttaggaatatattttggaagaactctccatagaaatatgtaactgtggtggttccactctccttagaaatatgtaaccatggtattttgcaataactgaatcaatttgagtggactattattataatggacattgtctttgatgccatgcaatgtacgtgacgtgtttttttaacttctcatatggaagcttggtatttttttacaagtattgtgctaaaatatttgtgcatattcagaagtacttctaacaaatattaggattgccatttcagctatatctcgttggtacagaggttatatagaccaaggacgtctttggcttcccccattaggatcttaatgtttctagccaaacacctaaattaactgattctgattctcttcagtatctgattcaggaagaatcagaattagaatcacagaatctgaaaccctaccaaa

SEQ ID NO: 70375 - DNA, 4774 bp, Oryza sativa
gggtggatgccattgacacaggttcttaaacatgtatttagagttgcgcaaagcgcaaccatgtggctagtatttttactaaaagaattacatcccgaatatttgtgaaaaaataaatagcatattttcaaatttaattctctccttcactttcttcctctcgatctcaccccctccctgcggtgctcgttgcctcctagggacggcccttcctcgcatggtgactgttgggatctgggttactgttcgatgctctttcgagccatccaaactgctacccctaagtaaatgaaattttagtttgccaccaaaaactgctatcatcaaaattttagtgagatttacaaaattattaaccaaacaaacaatttggtctactcaggaatatatcctttggagtacatgattccgaaaaatacagaaacatgaaaatgccatgagtaaaatatcatgcttcaacgaatccgacagaaaaatgaatctagaagattttgttttaaaaaaattgtttggtaataccactgaaaaggcatagaaattttgagcctcattcgttcgaaacaagccattctattgtaattttaaggactttgtaagattcatttgtaaggggttttggaatggagcccttagaatctgtttgatttaggttcttgaatctgtttgattttgatttagcaccaatggagttttgcatcgacagcgtactaggggtggccgcgactggtagacttccactcgtcaaatctggccgtttcaggagaatatggcgggacgcagagaagcatgatgtacgtgctgaggtcgtttggttttcttttcatttttttgttgtattctcctccttgttgaggtgtgagtttaagaactcttgtatcattttgttgtgtatatccttcgtggatatagaggctgaattactgaaaatccattattaaaaaaacaaactgatacacttgtatattactattatgatacacgggcaaaggaatcaaaatcacacaaataatgcataaatctagcacgatataagtacaaattaatgctacatctagatactcttgacgactccgacatatggcaattcaacatttcccatgtatattttgccatccttcctctccatcacttcagttggtctcaagctctttggtcctctcatctgttgcaccagctttccaccagcactaactctcattgcaaccaagtgattgtccggaccaaatggaagctcatacttctcacgatggagcgctacccagtaaccacctttctcatcaggcctcacattatcaggatagcctggcaagtcgacaaatggttcggacttaccaacctttggacctcgaatccaatacctcaacttacatgggccggtcaacgcaacgatcaaatgtgttcggtcagcgctaatggcgacaccgttcgggtaggttatgttggattgaagaacggtgacttggttagttcgtgggtcatacttcatgagccgtccggtcgaatccttggtcgccgtgacttgctcgtgctgagatcgttggtagttcatgctgctgtcagtgaaatacacatctccggtaacctgatcaatgtccaccccattggtgaagcgaagtggcacgccatcagccttcgtggctagcactgttgcctcaccacctcctggcccaactcgcatcaatcccatgtaggcgtcggcgatgtacaggttgccggttttgaagtgaaaccgtaggcccaacgaacggccgcatttgctctcggtctgaaccgtggggagagtcgatgccgcgcacttgttgttcgtgtagctggggctgtacgtgtaggtgctccagccagccgcctcgccgttccacctcatgacgcggccgtcggagacgccgctgtatgggccgtgtcccttgccgtcgaacgcgacgctctctggcccgaccagtgatccgccgaggtccagatgctggctccgtcgggcgtcgatggtcttgaacattctcgctgcggcagcggtgcgggggacggcgagaacaccaggacgaggatgagcgcgagcgccgtcgccgccgccgttggcctcgccgtggtcctcatggctagctgcaggggagggagagctcgttggtgcacgcgtctcgtctgcttgatctctgttgctgcacgtacggttggtgctcgtgcagtcgtgctcgttcgctgctggtggaggagcagcgtggtgattatatactgctgggttttggcgtgttgccaatggccagcttccgaatcggagaagacgagcggagcactcgatcgactcggactcgggtgtacttagccgatcgtgggcccggcctgtcatggaatataacgataaatgggcctggtgggcctaactgggcggcttctctctccattacaagcccagcccgtttagaactgaacttacacgactgagtcttctaacagaaaatcatcgatgggtttcaatgaagttcagtgttacaagtgcaatacaacaggtttttttttttttctaaacaaggattcagagtttcagacgttgagcaaatccaacgagcttggcgcgatcagataattacagtgaatgctgaaatgcaggatgcagcagctaacgagcccacaacgccacaaaagcctccggcatcggtcaatgcacgcaacgatcagatatgttgggtcagtgctaatggcaaattggcactgcaacaacgtctagacttcagcgggctcgcgtcaatgtcacccaaaggggaagaagatcctgcggcttggacctttcaggcttcaccagtatgaactgatctgatttgttacagtagtgcactagcttttcttttagaaacacagtacaaagttagaaacgtaggtgcttagaacacacgcaacacacgcacacccacccttaaaaacgcacgtacaccctatccctatgagcaccttcgaaggaatcggtcggcatatttttatattgatgaagtcaccatagacgtctcgctgtcgacgggtatgtcgcctaccactgaaagaataaataggagtaaatgtgagcacatgtgtgatttctcaaacttcgttattgagctcgcgccaaatgtgacagttgtcaaacgttgtggtaactgattggagagaacaatactgcaaagggcaaactgacatcttcaggccctatttgaaacaaatgatttgttgagaaattctacaagattcaaatcttatatgaatcctttcaaaaaaagagttgtagtttctcaaatcctatgaaatttctaaggaatggctcaatacacgtagattttaaagaagagttagcgtgagtttttacctattgaaaatttttcttttaagtctatctctcttatcctttcttgcatgtgaaaatttgtcatacctatttaatttaaatgacatacgagaaatgaggaatatttattggcatcaaaatgactttgctactatatataaggatactgagtaaacgttgttgactgtaaatgttactaaaaaaaatgacaaaaagttcaatgttcgtattatacattttggtaataacatatcaagcgctgttgttccaccgttgtattatgtctttttcttttcaatggtaaagacggacaacagacaccagccatataaaccatgtacaagcagtcaatcgtatcttattctagaatatctgcaacggtgctcatagatctgtgagcaccgttgcagatattcatttccaaacactaaacaatataaaaaaaatctcaacaacaagatcaagtaaaacactccagtactaaattattattggccacgggagcatatcctatgcacacaggccctcgcgtgtacacaccgtgtacaccaactaaaaattatcacaaaaaattctaggaaaattcatacatgtattttcaatagtattacatctacgtataaagtcgcatcttcaaattcattctacatagagaataacaaaaaagataaaattctgacaaaattgcaaccttaaaactgtcagattttttgtttttttttgttacggctaaaatataatgaatttgatgttaagattttaaccctaggtgtaatacaattgaaaatatatatatgattttttctagattttttggtgacattttttaattggtgtgcacgtgtgtacacgtgagggcctgtgtacataggatatgttgcctattggccacaccggaatatgagaacaatacaagatttgattatatattatggtgtttcggggagagaactgcacaaatacacaagtttttatgcttccatcctgcaaaatacgacctggaattttaatcttcgctcaatttcagcctggccaagatccttactcaatttttccagtcttatctttttcttatgcatatacttatctgaattgcttattatcaacttaaaaaataatttgtgaacgaaaattttatatgtgtgtcctttatggttcaaaagcaaatgttgtaaaaaaattatgatgaaaaaaaccaaaaggtcaaataaaataattaagttttaaaatttaaaatttagcttataagtatagtaagtcaaataaaattttaaaattttataataagctataaaatacatatattcatatagcaatgtaatatctgttctgctagtcagaaacaagaaatcgacacctcatggaatgaacaaacggatcagatagtggtggatataggaagagatagctgggaagtttaaacaaactagataaagttagagcccccttcctatctatatatagcaa

SEQ ID NO: 70376 - DNA, 16893 bp, Oryza sativa
atcagagatatgtctagatacaaatgaacaaaaagaattataagcatctgagttctcatccatatacgaatcatgttccttgccatccttggccccagcaagaatgctagagtgctagacattcccaacttccaaaatgagcaaccaactactacatacgaactaagctggtgggaacccttctccccagcacgcaaaacaaagcatatattattgtatgattaattaagtatttactaattttttttaaaaaaggattaatatgactttttaaagcaactttcgtatataaattttttgcaaaaaacacaccgtttagtagtttgaaagcgtacacttggaaaacaatggagagatgttggaaagggaggtaaccaactgagccagtgtatccatttgctaatcatgcgtagaaaaccattttcaccgaccaatttgtgttgaattctgaggcgggcttcggattctacaggcccatgtcacaacacccaaaccgagctgatccggcccaaccagcccattatcatctggcctacttggctacttgtccaaactagcctaggaaaagtttcactgggccttctaactcggcaaactctgacaaactctgggagccccgaatccgagtcgactgtcaagcgagccatgctgcctgcctactcggattctccgactcaaaacttgtccgactcggagcttggcattgttggcaatggcacaacgcgcgcgccgcggcctagctatataatccccacgcttctcctccaccaaagccaaccaaaaccaacaccaacagccaacgatcacgagctcgcgagctcgatcgtgcaaccatgaggaccacggcgaggccaacggcggcggcgacggcgctcgcgctcatcgtcgtcctggtgttctcgccgtcccccgccaccgccgccacagcgagaatgttcaagaccattgacgcccgacggagccagcatctggacctcaccggatcactcgtcgggccggagagcgtcgcgttcgacggcaagggacacggcccatacagcggcgtctccgacggccgcgtcatgaggtggaacggcgaggcggctggctggagcacctacacgtacagccccagctacacgaacaacaagtgcgcggcatcgactctccccacggttcagaccgagagcaaatgcggccgtccgttaggcctccggtttcacttcaaaaccggcaacctgtacatcgccgacgcctacatgggattgatgcgagttgggccaggaggaggggaggcaaccgtcttagccacgaaagctgatggcgtgccacttcgcttcaccaatggggtggacattgatcaggttaccggagatgtttatttcaccgatagcagcatgaactaccaacgatctcagcacgagcaagtcacggcgaccaaggactcgacgggacggcttatgaagtatgatccacgaaccaaccaagtcaccgtgcttcaatccaacataacctacccgaacggtgtcgccattggtgttgaccgaacacatctgattgttgcactgacggggccatgtaagttgatgaggtattggattcaaggctcaaaggctggtaagtccgaaccatttgccgagttgccaggctatcctgataatgtgaggcctgatgggaaaggtggttattgggtagccctccatcgtgagaagtatgagctcccctttggtccggacaatcacttggttgctatgagggttagtgctggtgggaagctggtgcaacagatgagaggaccaaagagcctgagaccaactgaagtgatgggagaggaaggatggtaaaatatacatgggaaatgttgagatgccgtatgtcggagtcgtgaagagtacctagatttatttaggatgtgcacttagggagtgtttgaggagaagtggattgaggagattgggaagatacgtaaaaagaggtgagccactagctcataattaattgagtattaactattttaaattttaaaaatggattaatatgattttttaaagcaactttcatatagaaatttttttgcaaaaaacgcaccgtttagtagtttgaaaagcgtgcgcgcggaaaaagagagccaatctcccctatcacccctaaacgaacgatgccttaggttttagcatgtgtaagatctatgcgtaatttgtgtacttttgattcctttgctgtgtactgtaatttgtaagcagattagtttggttacatgtgcattttagtgattttcattcctctggttatgcatccagattctcccgtaaggcctcatataaagcttatcacacaggtacatcaagtcactctcatgttcagggcataaatggcataattctcagcgcaaatccatcaccaaaagataattttatcttctactcccagctgctgccaaataggcagctcttacatacagatgttgccaaagaggccagatccaattaaggtcgatcaaaacaaacacctatgtagtagatctattaaactaagcctagaacccgatcaatgtgttggtaattccttcaattgtgttggtatatacacaggacaccatttgctcaatccaggacacctgcagctctataagattcaacactgtccctgagtgtttcctcaaatggcttgattttccatcctagcttctctagcttccccgagttgaattgcggctcatcgctcacttccacaaacctgtaattgaaatgtaggggtttcatagaattcatatggaaactttactaattcaaaatgcagcaaaagcataacgattgccgtgttctacagatgcaaagtgcaatacttcatacatacgaaggaaagatttcgctattctacatttcaacccaagagcagaggctcacttgtcggcaaatttgtaaccgggataccagctctttagtaagtcaatgatatgaggcatccttcttgcgtgtgaactgcagatgtatcgtccggagacccctggggtttcatacagtaaaagaagagcatcggcaacatccctgacatccacaaagttcctcagtttgatttttacctcacaatcacctgccgagagataataaaatggatctcaatctgaagcagccacagaaacaaagataatttatactccctccgtttcaaaatgtttgacaccgttgactttttaatacgtgtttgaccgttcgttttattcaaaaaatttaagtaattatttattcttttcatatcatttgattcattgttaaatatacttttcatgtacacatatagttttacatatttcataaaagtttttgaataagacgaacgatcaaatatgtttaaaaaagtcaacggtgtcgaatatttagggatggagggagtattatatagttggcaatggaggagatcgacaggcaccgatcactgttagtgtcaaccttcatctcaagatggccatgctccatctcagcacttttgccgcgacttgctggtctctcgcaaaaaagagagaaaaaaattgtaggagccatccaattcgatcagtagcttgattgagtgaaagcgataaatctctaaaccataccctcgataggaaaaacaacaaaaaaaagaaaaagaaaatcggtcggagaataaaagtccgaccccctcactcgtccaggtttgcaaaatcactgaatcccagagtctcaaatgaaatgtaaacagtttggaattgttgatgcttgcaacaatggcgataatgtagcaccgcagaagacaggaaaaaacagaggtgggcagcccgtctaggtcctcaccccttctaattatttaatatcagaccatttcataatattcatgttttttatttaattggagtggtttatgcaattttaccttttttctgaactagaaaaaaaagcccaaccattttgaaacggagggagtataatgaatcactggagcatagcaaagtgaggcaaaatgctcaacctttcagacatccaagtatgactgtactgctcgcattcacagttggttgcagcaaaggtccaatcaccaacgatgggcagagtgtcacaagatccaatccacttctcttcgcataatcaaaggcctcaatctccgcaagtgttttcccaagggtataccaattctgccaaaccgatgtatcaagcgaaattggaacatatgagaaccatatgcctacatgaccaagatatgtaaagaagaaaaaaggcaaagtattgcactattgctcacttgaattaatcatctcagactaaagtctcaaggcaccgaatatttaagcaacagcaaaaactagtgaactaacagaaacagtattccaactagcgttgactatcaagatgtttattcatgcaaatttgctttgtaatttctaatagtaagtttttttggatacttatctagtaaatccaacatcatgttgcaagcaaaatctgttactccctccgtttcacattgtaagtcattctagcatttctcatattcatattgatgttaacgaatctagacttatatatatgtctagattcgttaacatcaatatgaatgtggaaaatactagaatgacttacattgtgaaacgggggaagtacttgtcaagagttcaaggctcctttgatttgtaggaaaaatataggaattttggaaagattttaatcctataggaaaatttcctatgaaggcatttgaaacaaaggattgaatcatatcctatcatttgaaattcctatgaaacggataatcctatagaaattttgaaggaaacttagcaagagctccaacctcttagaatatttcctttgagtctatctctctaatccgattcgtgtgtttttcctgcggtctaatcaaacggtcattcctgtgtattgcaattctctattttacaattaaattcctatcaaaatcctatatttttccttttcctttgttttttcattcctacgattcgaaggggcccctcagtcatttatctcattgcatatagtacatgagcaataagccttgtgttggtttggttggtatcaccttagtggctctgcagtaatcgacatcagaccagcaatcttcatctatggccttgccctcagaccagttaggattcaccatcgcagcagagacagatgacaccaccacaaccctcccaaccttagcttctgaacaagccttcagcacattcgtcgtgcccgttacagcaggagcaagtatatcaacctacagcaacatcaattcattagctacaagaacatgacggtttacaactctctgcagacttcagctactactgcttgttgagaaatcaactgtttcaacaaatcatttctagtagaaactgttgattttgtcgattttcagtaactgcagtctacagtttgaacaagtcaatggagaagagaaggaattgttttgctgaaaaagagagagagaggtgtgcctctgggttgggggcggagaggagcacggggcaggccacatggaagacgtcgtcgcagccggcgatggccgccgccacgctgccgtagtcgagcaggtcggccttgaacagccgcagcctctccgcggcgccgtccagagacatcaggtgggcgttcttggcgtcgccttcgcacaaaatcgccagcacacgcgcaccaatcaatcaatcaagaacaagagcagaacgccgtaaatatcaaaatctctgagcagcatcagaaggaaatttctgaatggttcatccaagaactcagcaaggaggagatcgatttcgtcaaagatcccaggaagtgagggtatacctggatcacggacggtgccatggacggtgtagcagccgcgggagaggaggagcttaacgagccacgacgccacgaagcccccggcgccggtcacgcacaccgtcttcgttctcccgtcgccgcccaacattgctatggtacaactgctgctacagcacgacgtctagacttcggttagctcgtgtcagtgtcacccaagaggagaaatcctgtttcctgtctgtggcttgtagagttgtagtactaccgtctaccggtagtgtgctagttctactatattatgtcgcatggatatcaaaatttaagtcttatacaagttaattttgagattaattttaaaggttttgtttcattgtagttttcttttttaatattaacgcttaaataattaagaatatgtatgtaaaagtttaaattctaaattatcttttctgctaatacgttaaacgatatagtttcagcaattggccagccgatgtcacctttagtctacttcgagcagcactgattaattaactcaccagacaaactggttattgagcctgtgcagaacgtgagagttgacaaatgttgtagcagctgattgggactggatagtgatctttttttttttcaaaaactgaactggatagagacgagtataattatttgggacagaggataaggatagcactgcaggttcacatctcgagaacccctaattagaccatttttaattcgaagtaaaaacatatcatattggattttttttatatgatccttggaaataacaatttgttagatcatatgaaatttctaagaaatgccctctatccacataagttttgaaggattttttaacataagattcagtctcatgaaaagtttcgaatggatctatctctcttatccaattctaatgttttttttatggttcaatcaaacgattatttttttcttttctttttctgtattgcacaactatattttttttcttattccttcgttttcttaatcacgtgtttcgaagaaacctttaatatgtaaaggaccaatagtaaaaccatgaagtttatttggtttctagccacaaccaaacttgagacttaggctgagttcgtttctcatgattcctaacccctctccctcgttttccacgcacacacttttcaaacttttaaacggtacgttttttttcaaaaagtttctatataaaagttgtttaaaaaatcatattgatccactttatttaaaaaaatagctaataattaattaattatgcgctaatggaatatttcattttccgtgtttcttgtggaaacgaacacagccttaaaatttaacatgtggagtgtctgcacatcctattcacacagtcgccctttgcacatcccctcccaccataccgcgcacaaagggaaaaaacaaacataaaaaaccaaacatgcccaccttctcccataagtaattatttcctatttcttcggatcccattatagtgtacggcattattgttggcacataatgagaagtgtgggtcgtcataattattgtgttctagaaaaaaaaagagaataattatgggtagtcaccaaatgcataatactcctccgtctcataatataaaggattttgaatttttgcttttaatgtttgaccactcgtcttattcaaaaaattttgaaattattatttatttcatttgtgacttactttattatccacagtactttaagcacaacttttcgttttttatatttgcaaaaaaaaaattaaataaaacgagtggtcaaacattgcaagcaaaaactcaaaatcccttatattgtgggacggagggagtatcatggctaaagggagtgcctaggcccaaaaaataataatttcatttgaagctagtgcgctttgttggtcaatctgacgttgccgtaatgataaattttttaaccataagaaattgtctaacattataggttatcttcatgtgtttcaatttactccattcttgggtacgatgttttataggaataacatgatactatgcgcattggtgctacatgtttagaattggtagccaaggagcttttattccaatttggatggtacagtacctacagaatttcgtgctagaatctacgtaattttgaaaacgttatttcagttgacccttttattggcgggcgggagttggggggtttgtcccatcacatcttttttaagttcttctaagacttgttggatgtgtgtccatgagcagaggccggagatatagcccttttctattatgtaagaaaaaaaaccataatatcaaattgtagccaacattaaaaaatgggtccaggctagctatctcgttagctaaaagttgcagtcaactaaccaagtttagcaaggtgtggaggctagccatcccaagtccttcctcagtactccctccgtaaaaaaaacaaatttaaaactgaatatggtacttcttagtacaataaatctagacaaatatctatctagattcgttgtactaagatgtataaaatctagtgctagattgatttttttatcggacggaaagagtacaaatttgcaatctagtgtcaacgactgtaccatctctatgaatttgcagttttttacaacagctcaaatgaaatccaacagcttagggtattatttattaagtaggtgatagcctagtcggtgacctatttttccaacaacgctgttatagacaagagtattgtaaccgacaaccatgttgcataatattgtcagaccacacttttacaataatagatttgttatacatgagttcatggtacatgagttttgttatgtatgctaagaaaagttaacgagaaactatatacttccatagaaattggacttctgcaagactgcaacggattgtgctgaataactgaattctgagagatgggcttcggagtccgcaggtccatgttccaataaaccgagcccggtccggcccaacagtccattatcatctggcctgtcaaccctctgcaaccgggcctctcccgactcggaatctctcaaaactcggagtccgaatcgagcgaacataccttgcgatcgatcgagctcggatcgcaggtcaccccgcggccgagctccgattcggacctggctgacaaaacccagccgcatattactatataagcaccacgctgctcctccaatctctcaaccaaaccaaagcctgcagctgcagcgaacgagagcaccagcacgagagccaagcgtacgtgcagtgcagccaactgatcagactgagacagcgcgcgtacacggccgagctcctacaggctacagccatgagaagcacggcgaggcaagcggcgaccgcggcggcgttcgcgctcattgtcttcctcgtgctgctctcgccgtcccctactgccgccgccacagccacaacgagaatgttcaagaccattgacgcccggcggagccagcatctggacctcggcggatcactggtcggcccggagagcgtcgcgttcgacggcaaaggccgcggcccgtacagcggcgtctccgacggccgcatcatgaggtggaacggcgaggccgctggctggagcacctacacgtacagccccagctacacgaaaaacaagtgcgcggcatcgactctccccacggtccagaccgagagcaaatgcggccgcccgttaggcctacggtttcactacaaaaccggcaacctgtacatcgccgacgcctacatgggattgatgcgagttggtccaaaaggcggggaggcaaccgtgctagccatgaaggctgatggcgtgccacttcgcttcaccaatggggtggacattgatcaggttaccggagatgtttatttcaccgacagcagcatgaactaccaacgatctcagcacgagcaagtcacggcgaccaaggattcgaccggacggctcatgaagtatgacccacgaactaaccaagtcaccgttcttcaatccaacataacctacccgaacggtgtcgccatgagcgctgaccgaacacatctgatcgttgcattgaccgggccatgtaagttgatgaggcattggatccgaggcccgaagactggcaaatctgaaccatttgttgacctgccaggctatcctgataatgtgaggcctgatggaaaaggtggttattggatagcgcttcatcgcgagaagtatgagcttccctttggtccggatagtcacttggttgctatgagggttagtgctggtgggaagctggttcaacagatgagaggaccaaagagcttgaggccaaccgaagtgatggagaggaaggatggcaaaatatacatgggaaatgttgaattgccgtatgtcggagtcgtcaaaagcagctagattatttaggttgtgcacttagatttaggatatatgttagatttctgcattatctgtgtgcttttgattcttttgcaatgtacctatatagtttgtaagcagattagtttatttacatgtgtatcacttcttgaacttgcaaaaggcagaccgaagttgtaacttcaaggctcccattatttgtcctacaacttataaattgctactaaaaaggttaaaatttaaaacttaaatttattttgtgacttttcaccataccttattgtacaacattgataagtttttaaatctcatagaacacatatataagtatttcactaatggtttttctctagtaagccatatggcttataatctgcattaggggaaccgatggcgacccaggtctggaatgaatactcgtccagactctcggactaggtccccaaataaaactcatcacgcaagtacaccaagctaatactagtacatcaccaaagataccttgtcttgtgctcccagctaatgccaaatggccaactctgacagaggttgcaaaaggggccagatccacctaagatcgatcagagatcacctcacattgtcacacacacacacacacacacactggtcggcacaaaagccctgatggggcaccacttcaaccacagcttaattagctttcaatcacgcagcagatcaattaaactaatccaagaacaacaccccccaagctgtgacagcaacacaggatggattagggccctggaaaacgctttccgaggcggccatggccatgatgattttgtcgctaatctaatctctctctctcgatcgcatcgggctggctcgctcgcgcacatgggcgttcaccctcgcggcacggcacggcgccgctgccgcctactataatacacgcgattacacgacacgttggagggtttaggcgttagccatggggattaattaagggtttaatctcccctgcccgggggtgactcgatctgtttgtcgccgagttcgaagggctagggatgattggcatgttatgaggctgattaatttaaagattttggttgtgtgtgtacagctgtgtgagaagaaaggttaattaagagtggagttgtgaagtggtttagctgctagctgtgtgtgcatggtggtgacatggtgtggtgtgggtgaaagctgaaaagggcatgcttggcatggtccagattccaggatgcaggatggttcaatttgatcaagggttttttttttcctttttggaactcatgcattttaagatattaagcacatcataccagtttagcttttgcagtaattctctgtttcaaggaaggcatcaaagttctatgaaattaagcactttctaatatttttattttttttgggtgtggaattggtggttctcgtttcagcatatacagaaaaaaaaacttttctgttctgatttctaaatagggtctaaggcgcagtttgatttagattattgagtgcattattactacaaattatctagtcgatggtatagacaaattaaatattttttaaaaaaaacttaacaatattctatctgttttagaaaaaaaatattgaacttttgataagttcgactctggacatcgagaatgtctatattggactctaaaaatagttttgtctaagacaggggagtattatcatgataaaacaagtggtttaagaaattattttttaagaaagcatatttttttgaagatatctaaaccagtcataatctagatgctatatgttcagattttttaagtgttcgtactccataaatgttactattatcttgtggatgtttgcaacgtacggccttcctgatagggcaacaaactagggtcattatctatgagcagggatagatagactatacctgaagataatatggaaaagtcatatgatcagacgccgatattccggaccagttcttcaataaacacgcattgaacggtcaagcatagatcagtggcctgaatatctttaatttattttccatgaagtcattaagccattaacccagccagctgattacagtcgctgttaattttgtccaattccagcagcaggtagttattgattttgtaaccatcaactgaagactgcagggaacaaggcagctgaacattatgattgttgcagcggattgcattctgatagtaccattgaatcatagtactatcagatagactatcatctgattggtgcaagtaaaatcttgtcgctgtgtgtaaactacaaaatgattgatttattatattatggagtaataattctgtgaactcaattcgagtataacaaaattgcaatagctagatagagattggttgtcgcggcctgaatagtttgaaacctggatcaaccagttgactaagagccacttgcactcaataatagattaacgagaaggataatcatattttaggacctcgtattattataggccaagagatgcagaatgcaaggtcaggtacagaggattagcatcatttgcggtcagtttgacaggtttgtacgtattttagctccgtccatcccagacagatcactaaccatatccatcaaatcagatatatctgtcctactcaccctctaaaccaaggaactctctacactatggttaaatcacttaaatcgaactgttcagcgtaaaattcctgtaaaatatataatgtacaacaaagtgttaatctagctccagagatgtaggttttgtctgaacttcgttaataaaatcatgtgttcctatatcgtcatctgacgtgtctggggagcgatcgagaagtttaaccatcgttctgctatatcgtaacttttataacaatgagaatttggagtgagtgtatgtgttctgtactagcgtctacttcgaacggtactagattaatttattatgtgatggagggtacctccatatgatgttttgaaagaaaaaaatagagatctacctataaccattaatgcacaacaaggttgtttttttttctttttgaaaggaaaataaatgggctgtttagattatagccaaaataaaccttacaaaattttgttaatgtcaaaatcatggtaagttagcaatattactaaaattttgataggattacttatttatttaccaaagtttgacaacaaaccaaatatagatactctttagcaactttacccaaaaaataatatggtggaaaaatggtatcatggtctggatcccctagcaaaatttttcaccatgtcacattgaatgtttggacacatgctgcatgtaatattaaatatatgcaaaaaaaaaaactaattacacatattgcgtgtaaattgcgacatgaatcttttaagcctaattgctccataatctaacaatgtggtgctacagtatacatttgctaatgacagataaattaggcttaataaattcatcttaaaatttacaggcagattctataatttttttcattattaatctacgtttaatattttgaatgtgtgttcatatatctgatgttacacaccaaaactttttaccccctaatttaaacacagcctcaatcagaacagccccaaagttaactcgtcgatccgtataaagatgtaaaacgaacaattctcggcggtttctgcgtcgggtggtgaaaaagggtcgccggaaacgtacgcgggggggcggatggagacgacgtcgtttcgtttacaggttggcgccgagccgacgggacggtgtctgcctccggcgacacgtatccggtgtcccgcgactgcagcagcgaactgctgcactggacaccacaccgccctccacctgtccacgcccccgtcgcgaccctcccctcccctccatatgcttctctctctcatggttacaacttagcaagcaaaagggcaaccccaacccgaaacagccgcaccaaagcagcagcaacagcaaagccagccaagacgagacgacccaaccccatctcccatctctcactctttcttctctctctctctctctacactctatctctatagccatcgccttcgagatctgaccggcgacgccagagcagcgagagcgcgagaagctgatcgatacgtgcatggccgccagcaacaacaagtggtggcaagcggccctggacttcccgcctccgccgccgccggtgaccgttccgccggcggctccgccgggggccgcgtccccgaagagcaaccagcagccgccggcgggggccatcgtgccgctgcgccgcccaagggggaggccgctggggtcgaagaacaagccgaacccgccggtgatcatcacgcgggacagccccgacgcgctccactcccacatcatgaaggtggcgccgggggccgacgtgccggcgtgcgtcgcggagtacgcccgccggcgcgggcgcggggtgtgcctaatgggcgcgtcgggcgccgtcgcggacgtcaccgtgcgcggcgcggcggcgccgctcccgggaaggttcgagctcctctccgtaacgggcaccgtgctcccgccccccgcgccgcccggcgcgtccggcctctccgtgctgctctccgccggccagggccaggtcgtcggcggatgcgtcgtggggcccctcgtcgccgccggccccgtcaccctattcgccgccaccttcgccaacgccgtctacgagcgcctcccgctcgccgacgccgccgacgtcgccgacgtcaagcccgacctttcctccgccgccgccgccgccacgtccacctcggcgccgcaagaagtgcaacagcagcagctgccattgccgccatcctcgcaccaccctcaagccatgcccgcgacctaccccgaccaccgctcgccgccatacgcctgggcaggcggcgtatgatcatgatctgagctgaatcatccatggcgttcttcaacctaacaatctctagggaagctaggtttttcgcgagttcgtgcaattgattagcggaaaatgctcttcttgggctagtcttgtaattttgtttcaccttttcattgtgattttattgtggagaaaatatgggaaatggtgtgtgacctcaaggaagcaaattaagctcgagttaagatatcagtagaattcaaagggtggtgaggtgcatcgatcagttagcccaagcattttgtgtgataatttgaggctaatgttccaactttttctagtttcaaaatcttggttaatgcttgtgggttgtgttttgtttttatcttaagctaaattagggaaaaactcaattatcttctcttattccatttacttgcctcgtggcagtcatatccgattccaatttgcttttgtttatacttgttggacgttttagacagtttgtttacacatgctctcgtgtttgtatatgccattcaattagtcaaaaagaaatcctaaagaaagtgacaatgtagatttttatgtaaggataaattccatctagcatatgtagagagaaaacagatcagatgtatacactcgagattgtttttgtccgacaaagatggtatcttaaatttccctttgttctcgaataaatattactgtttactatagccgtctcactttgatcacaaatttcctttaatgatcacaaaatacctttagtaattacattaaagtgaatgaaagttgtttgattacatttacgacgctaaacaattcgataatgtagaatattttttttaagtatttctcttctctttttttcaaaaaagatgagtgatgaaagttcaaacatgaatgtgccagtgtcatttattcgagaacgttgaagtattaatgccttcactcttttttctaaaaagaattgatatatatttgctcgcatttgtaacgtacataaaagcatctccaacaacagtcaagctatcacgaatgccatccagaagatagcacgtctgagcgaaaaacccgcaaacatgccatctcgagcaccaaaagtagtgtctcctccatctgacatgatcgcacgccatattttgtgtttctctctcctcacaccatcccactattacccatctcaggattgaactctcgccctccattcgaatggtatgaaaattaaattcaaaggttatgtttgaaatacttttttttctatcttcaataagaactgaaataattcctccaaaaaccttgccccagctccttcagacgggactaggtgatgatctgcttgatttatcctttgtataatatggtgtacattaagttcaatttgctttgatcattggtcagttctacttgaatttcaattgaccatatcttgtgttttcatttccttctttggcctggttttatatggctatttttactagaaaacagaaaagttcgattcagcagcatcttgcttgcagcaaagcaccatagcctggatgttttctaaagaagcagcagcctgccattgtaacttccaaaggctaggcttttgcatgtgcatggaacccactgaacccagcatccttctcttctttcccttttcttttcacttttagcactggtcagactatcagagagaaaggatcacacacatgacagtgtgaaacttgatagactgctagcaaacttccaacttctatagaaggtgtttattgggtaaaggtttaaagggaaatgaactccgtgtatgtctatataatacaaaccaaagactatcttaagataaaaatattcgtctgggatttatccatgttattatgagtaaatttttactatgagtaactttcctacaacagtttctaggtatgcattacacac

SEQ ID NO: 70377 - DNA, 671 bp, Oryza sativa
tgttattgtataaacaatgcagatttgtgcataaaccacgcatacttgtacacagaaaatgtagtcaacaattggctataactacaatagctagctgtttgatttcatgggaattcaacaaaaattagcttaggcggatcatccatgagaccacaccgaatatattgatgccaagcacaagtttgtcagcatactgagcaattcaaaatgatcggcaagaaaagatttgttcatccatgtcgaaatagaagtatgaaacagaaaatgttgtcgatatgtcttacccgtgagtacggcagactcctgcatggctgtggcggcaccgacaggcctatccttcaacaagctctggcgcagcgccatgttctcagctgcgcagcactgaagcgcgtagctgaggcgacgacactcggcctctagatacttgctcttagtctctaggtccttaacatacatcttcttcctctccctcgatttcatggcagaatccctatttctcatctgcctgataattcataacacatactattagattattgtctaactagaacatctttgattacggaaaacatcttatagttgaaaagaccatacactcttataattgaagcctacaatttcttacatttcacaaaggattaacactaaaaagaccatgcatcttattacga

SEQ ID NO: 70378 - DNA, 4752 bp, Oryza sativa
  unsure (1)..(4752): unsure at all n locations
cgacatgtgggacccctacaccggcatcccccgccggccatctttcatgcgtcgaagaccacgccacatccaccggcaactcctcctcacacctaggtcgcctcctccactgccggccacgcctctcgcgccaagccagcctccatctccgctgcccgcgcctctcgcgccgagccggcctccgctaccatcgactgcgactctttgcgccaagccggtctccgacccctccaccgaacgatgccgcgcctgccagaagcagccgtctcccacgccctcggctagccgtccgagactgtcatgcctccggtgaccgcagtcgcagtcaccaccaccacagccactgttgtcgaacgcccagccactcgcacccgactccttccccgccgccgacgtcaccaccgcctccacagtcacggccgccgtcgccgctgccaccggcaccagtcatcgcctccgcagaccgctgctgcaccgtcgctctccgccaccaaggagccagcaacgccccgatgccgcctccatgccctccgccgtcgtcgccagccgacgccgccgctgctgctgtcgccagccgaccaccaaacccggccacccctcgaccgtcgtcgcagccaccgcacctccttctccagcgtctccgcgccgtcacgcccgtcgccgccggatccggccgcctcctcggcagtcgtcgtccggctccaccgccgccagttccggccgccgtggcaccggcaccgtcgtcgctatcgccctgaggacgccgacctcctccgccggcgccggacccccaccgggggccgccggaaacctccccgccagatccgcgccggatctggcggcctcttccaccgccgccagcgcctccaaagctccgccgccatccccgccaaaggccgcgcccgagcacactgccccaccgccggcttaactccccgcgaactccggctggccgacgcagatctgggcggtttctgcctcccgatgccggcagacctccccctgcccttgtgcggcgagacgaagcgaagccccgccgccgctgtccttgccgctgcgcggctttactggcggccggtcgggcggcggaggcagaggaggagggagggagggcgggcgacggcggcctgggcacctcccgtgccgcccgagaggagacgacgctagaggaaaagttgttagcagattctcgttttacttgcttagtaaaatgacatgccacgaacagatggtctcctgtttctggggcaagagtgctcaaagaactattaagccttcatggataactgatcctgccatattgcactgttacactgggtttaatgagcatcattttaattgtgcctatacctataagccaaattttaaatctcatgagttaattttatgatttttaatcatagtttattttactacattaacttttgaatttttaatcatggcatatatataaaagttttactcagaaattcagtattattaagtttttgataagctatatggataaacatgagcaaaagtgcaaaactacgtctgctatggtatttatctcagtatcaccgtgcaattaaaccataagaattctgcatatctgcaggggggaaaacttatcgcgttgatcataacgcccttgtaatttgcaagagatggatcagacgttcattatgactttgagtaactacatgcacaaaaacttaaatcaatcgtacagaaaaaaaatgacagcacatgaccaatttatggagaaattatgatacaaccgctaggagaccaaccaatcaaccgtgacatcctaacccaattagatgcggcgtggcccataaaagctgtgtacgcatgtttattaccaccttactagtttagcaaggtgaaacaacttataaggccttgtccctctaactatgccacttccaggttaacccttttacacgaagtgaggacgaatgtgtaagtggagtggtatgtgtaagtagaccagcctgtcggttgggctgggctatgcggttctggagatagggctattacaaatggtatcagagccgaccctcgcggttgcgcgggttagtgtgttatggtgcatggcgcatgtggcttctatgtgagacacatggcatgacatatagccccagcattggacgtgtgctaagagggggcgtgttgctggatatttgcctatatgcatgtgtggctacgtgggtgagtttatatgcatgtgtggctatgtgggtgagtttatatgcatgtgtggctatgtgggtgagatgtatgcatgtgttcctaaaagggggcatgtttctggacattatgcatgtgtggctatgtggtgagttggtccagtgctaaaagggggcatgtttctggacatttgcatgtgtggttatgtgggtgagttggtccagtgctaagagggggcatgtttctggacatttgcctatcttcttggtggttatgtgggtgagttggtccaatgctaagagggagcgtgttcctgtacatttgcctatatgcttgtgtggctatgtggtgagttggaccgacaggacataagtcctttgagggaggtgtacgtgacattctggtccaattaagatgcggcatgtgtggcccatgagagctgtgtgcgtatgtttattaacacattgctaatttagtaaaggtgaaaccaacttataagccttgtctcttcaaccatgccactctcgggttaacccttttacacgaagcgaggacgaaaatgtaagtgtgaaatggtatgtgtaattgggcccacccgtcggttgggctaggctacgcggttctatagggctgttacatcaactgatactaataaagcataagttgcaacgtgtgtggtgcatccaatgtgttcttccagaatcacaatcaagttatccttcaagaataaaaaataatttccttgatgaggaataaccgtgactaactttaatgagttgcacaatcattattcggttgaacagtgtgtggtgcatccaatgtgttaacatccgtaaatgcaccagcatgataaattggtaatacgatgttcgatttcctgtcttttaggaaaaacgagtccggtttaaaatggaacaaatatacannnnnnnnnnnnnnnnnnnnnnnnnnnnnnnnnnnnnagggccatgatgcaaaatgatcaacatatcacaacagctcatattaccctcggagagcttactaagggaaactggacgagcttgctgcagaatcagttgcatgaactcgattgccctgaatggaaatcctggtaagatcatccgccataagtacttctttggctatctctgcagtagattggaatcaataggagtcagtcaattgacgttttatttttgcaacaaagaaattgtagattcatcatcatcaaaattcaaatattatgtgcctgaatttcacagacagcaatccgaggatgggagatgtttaccttcgatatcttctattgatttatcagcaaagaaacaaaacggcaacacttcatacttctcccattcactaccatttttctggtcaaactgttcctccagcactggatggcatccagccaaatacaaacaattaagggacacaggaagaccatcttctggtaaagaaactacttcagggcagttttttatgatcaagactctgagggaagagaaactaatcatctgaggcaaagccattaacttcatacaatttctgaccaccagttttgagaggaaagaaaggtctcgcaggttcctcagtgatattagcgcgttgcagtgttccacaaccagtgcagttaatgttgttaggttaccattttcaggtagttccttgagctcagggcaattctttatgatcaagttctggagggctggaagacacctaaagtctggcactgacgttaacttggggcaacttgcaatttctattgtgcttaaccttaagaatgtttctaggcccatgaaagctgtcaacccatcacagcttaaaatacacagcttctcaagtactccagtcactgactttggcatggccaacacacgttcaggagttgaataagtgatgttgcaatcgtttatccacaatgaaaggaaactaatgttctgaaacacactaagaaaaatgtccactgtcaggttgcagccaatcattttgagacattgaatagatgccgaagaaaagacattcccatcctcttcccgctgtttactagctgcaaaagcatgctgcagatcagaacatcccctgataaccaactcttcaagggatggcagatttgttgttacatctttaagtccatcttccagagtgtttgctccttcaaagatgatatttacacatttcacaggttccagacgacgaagatgcaacatatccaagagtgtgcttaagctcacctcctgagtaaaacatgtctccaggcgattatgatttcgcagcctgcaaacttcggtagatacatatatactcattcttacaggtgggagaacaactggtggcaattgtttcagcttggggcatcctctgatgcacacctcaagaagagcaggaaaaaaacagtccacagaagaccattctgccaattctggcaactctatcatttccagaatctccagtgagggaaagccagcagtcccataaaactcggggcctatacaaaccactgcattcagtctagcaatacgaagtgtcctgagagattgtatttggcctaaagatggaagcaacttccaacacttgcaatcagaaatgctaatgtgt

SEQ ID NO: 70379 - DNA, 711 bp, Oryza sativa
attcctgcagcccgggtgcttagggttcttctggtttagcggtgtagactgtagaggggagagagaccctcacctcggtagtcgacgccggagttgagcttgacgacgacggggcgtcccctgatcgacttgaggaagtccgagggcgtcttcaccgcccctccgccgccgccgccggacttgtccgcgccgccgccggtgctcatctctctcgctgtcgccgcgtgcgtgtagagttggggttgggtgagaaagagagagggacgccgcaaggagggaggggtttgctttggttaggttttgttgctttgggcctctccttgcctttcagtgatgggccgggccttgggggctgggtttctcgctcgtttgctcccttcatctgatcctgaccgtttgcttgcgcccgatccaacggttgagatgtgctcctattataaagactttcaccgtgatatattatacatgctccctccgtacttgtaaaggaagttgtttaggacaatgtttaagtcaaaccttgggaatataaatcatgataactctcaagttgttgagtttgaaaatataaattttatataaatagatttgtcttgaaaaatactttcataaaagtacacatatatcacttttcaataaatatttttatagaaacaagaagttaaagttgtgtcttggagatcgtgtcgctatccaaaacgacttctttta

SEQ ID NO: 70380 - DNA, 3135 bp, Oryza sativa
aatccatacaattttcatttcacgccacgacttcacaccatgcatcaagttccatcaaaataatcacaaccttaaatttcaaccttgcatattgccaaaataattgcaaccttcgccgcatacccaagtgagcactaaaaatggaattcctaccacctagcttgtatcccccaaacatgttcttaccgacacattttaccatcctaccaacaagtcaatatgtcatattctaaatctataattcctgaaaaattaggagattccaattgcattggaaactgaagactaagctgattaaggaacaacattgaattaggatattctaattgcattgggaaggcggggatttggagagtaggaatcgcaactcacaggcgacgtcggtggactcggctacgatccgctcgacggtgtcgaagacgagcttgctgtccaccaggtacttgacgaacccctccatgctcggcatccactccccctccaaccccgctccctcctcctcctcctcaaccacgtcgtcgtcgtcctcctcctcctcctcctcctctgacgccgacgcatcctcactgacgccatcgcccacctcctcctcggcccccgtatcgtccatcttgagggtggtccgcttggggttccggaggcgcatggcgacgaaccgcatctcctcggcgacgcccaccgcctcgccggggtactgcctcgggtaccgccgcggccgcggcttcgctggcggcgcctcatccaccgccaccgcctccgcctccgcctccgccgcgggggcaggaggggagggagcgcagcgggccaccgttagggctgctaggtccctcgttagtattagtccagtaaaggagcgcaagggccgcgctctccgcggcggcggaggaggcggccgcggcggcacgaccgccgaggcggcgacggcggcggcgagcggcatcggggggtttaacgggttatccactcgggcatcctgcacggcactgtgttgtgttagctgcgaaagcggattatcggttttccgccttcgcgtgacgtttacgtatgtcgactgttgcactacttctggtacgcgaaagcgtaacgggttctacgcgttccagggggaatgcagattggggaatccaagagatatgatgggccaatatgttttgggcttggccatttttagttttcctttctcaagaggaataagttcatttcgtctcccacaactatagtgctaaccgcaatatcttgcgactagtaataatattttgcctcctccaactagtaatacctgttcaatttatcttggaattccaagtagttttgatagcggtttttatcctacacggtattacatcaacccaaaaaagtgtaaaaaaatgcagcgtgtcccatatcacaatcgacacactggctttcttcttcccctttaccgcgcctaaggctgtgtttgcaaccccttgtttccaacccttctccctcgttttccgcacgcacgcttttcaaactgtaacagtgtgttttttgcaaaaaaaattttatatgaaagttgcttaaaaaacaaattgatctatttttttaaaaaaattagctaatacttaattaatcacgcgctaatggaccgttccgttttccgtgcgtaggtgataggttcccaacacccaccaccgaacacacccttatttgtctccatagccagtattacatatgctgatacgtgtggaggcgagctcaagcttgcttggaaaagctccctccgccggcttgccgaccaccgccccatcctcctaattgaaggaggttgtatgtttgctttaagtttgggggatgaaatgtagacttgcccctatagttgagggaggcaaatggacttttccctctcaaaaaagatataatggttttaatacgctctgtcccaaagtcccgatttgaagcccatgtatatattaaagatcaaacaacgattgcctgtttggcacatagcattctagagctggagctcaactaaacaatttcaactcaacctaaaagggagatgaaatgggttggagtgatgtgaaaaaataaactagagtggtgcacaagagttcggaccgctccgtagctctactgactccactcgtggagttatttaggagttgaaatcctgccaaacaaatcccatatagtctagtaaaacatattgaaaggaaacattttttaagctatctcaggctttacaggattgaatgattttcacgagaatttggaagcttcggatcctttggaaactttttctaactaggctttttggaacatataggaatataggttcataacttttcttttagaatgctttcctatgtagtaccaattccggaggaaatttgtatatcagcctcaaatctagttttttgtttttccttgtgtatctttttctcgcttctttaagcaattacaagttccaatgtgtaataagtcatttgacttttttttcctagtcaagcttctttaaatttaatcaagtttatagaaaaatatagtagcattttcaataaaaaacatattatcaaaatatattcaattttagatttagtgaactaatttgataatttagatgttaccattttttctacaaacttgattaaatttaatgaaatttaactagcagaaaagtcaaacgacttataatattaaacataggaataataacagttgtgtcaatgggacatcatcacatgtataattttggatgcttgtacacattatttgattgagagacacaaacggcagtttgctatagtctgcaatgctgccaaagttatacaagatcctagatgatgggcaaatcaacactataatcagatagattccaatgaatgtgcaaacagtgattatattactttattagtctatttaattatatattgttttttggtttgtattcctctttgccctctcaaagtggtctatatatacttacatagcatgcaaaatagaaatatttgcctgtgcacagcactttacgtgcgtattttatagcacaaaatgatttgtgattgtcgcctttttacaatgtcatgtactcccttcgtcccataatataagggattttgacattttgcttgcactgtttgaccactcgtcttatttaaaaaatttgtgcaa

SEQ ID NO: 70381 - DNA, 19682 bp, Oryza sativa
cgtgtgctaggtattagtttcaggattacgtgtgctagtaattttgtatatgttgattactttaaaaaagcaaggttttaatcgatcgatgcatttcatattattcagatccacttagtattattcggagttccttttgaagatggcggtcggatcttgatagtggatgttatcgtaaactctgcagcaaatagcacttttgatgaggtattacattaaatctatagtcgaagtatctttagatcggatggccatcgtcaagtgagattttctaaataccatgtgtgatgataaatcgaagtgattaatcaattttgcatacgaactcatgataaaactgtagaatgcacaacttgttattacatataaaactgaaaagatagaattttagtttttgaaagtactaatacaatcaattagtcgtacctcaatgcgaatgatgtattcaaaacaaattctctagccaagtaacttactatcatgatatgtgtgtgtgtgtgtatgtatatatatatatatatgtatatatatgtgtatatatgtatacatatatatatatatgtatatatatgtgtatatatgtatatatatgtgtatatatgtatatatgtatgtatatatatatatatatatatatatatatatatatatatatatatatatatatatatatatatatatatatgtatgtatatatatatatatatatgtatgtatgtatgtatgtatatatatgtatgtatgtatgtatatatatatatatatgtatatatatatatatatatatatatatatatatatatatatatatgtatgtatatatttcttataattgtgaaataaagcaggattaagaatttaagatctattctatttgtgcatattgattataagagaataattatcaacagttaatgataaccattagatgaaacatagctatatgatgcaaggagcagcacttgatggaatttactcaactagcaacgaaaaaataggaaataagttagagattgttattactcaaaaacgacagttaagttatttctatctctaaagcgccctttatgagatcaattttggatgctttgtaacttaagaagtacaaagcaccataaaagccctcattaaaaacatgtgtagcacatttatgtatttgctatcaaatccggtagtctatatacgaaacatttacaacgcggcatatattaggtttcatcaactaattaactacgacaaagttgtaatatccccatatccaacttacgaatcgttccctcctaattatggactacaaacaaagaaatcaccagcctttggataatacatagtaactgaactattgattgttcggtgaaaactttaagttgatttaattttgaagctgttaaccactacatattaagccgagctatttctaatctaacagtttcatattggcatggagtagcctatttgcctcttgcatatgtgttgttaccattctcatcccttgggagagatattgttcatccactttgaacactcaatcctgaatcctaaagtccaagaaatctacgagaaactaaagacaaacaagactagatattatccgtcagtcccatttgccatgcacttcactcttgaacattatgttcgcattctaagaataaagatgattcaagtaggtagcaactaggattgtgtttggcacaacattgtatgcatcaccaatatgaatacaacattgtaattgccaagaaccgaatatttttttatcaagcaacgccactggtttttttatattccatttttcctggcacaaccacatggggcccaacaatgtgcacacacactggtcaatgccatttgtatgatcaatatgtatttgtcagtggacgctagcaaaagctagtagttcttggtgcacacaaaatacaagtggaaactagaaaagaaaaactcgagtcccccttgacttggcttttaagaaagagggtgagggctcaaatgcaacacccatgataaaaggtatatagtttgaaatatttgggatgaataatatctggttttgaatcttatagatgaatgttagatttccgtgatatgttaaggatgcaaaatggacttaatgcataaaagcacattaatttcctaacttaaaacaagtaaactaacaagaaattacaacacttatgtaacggaaataaccatcaatattgaggaaaacgtcatagatgggcgatttcctactagtgaattcacaattgatcctaatagttcattatatacacacacatatttaattagtatatgtattaatgatgattgggattaagaaacaaccctttaattagcacatattaattaatggtaacatatgtacgtaagagttcatagcagaatgaactgtcgttgtacatgccgtaattataatacaatatagctgataagcatattaattaaatctaattacaagtgataagggtctcaaaattaaactatatttgaaacatgtgttaccccgcaagcacctaatgtgagcataataattagttctcacctggagacatttgtctttatagtttccctctattgtgcatgaattagttaacttgactacatacgacgctaatttttttatattttagcccttttggaagcttcttttacaaatagaaatctggaaaaacttattctagctaggaatagatttttttctcaactctagggttattggcgctaaggctcaatatgatactccttgccgccaccccaccccccccccccctcctccccggtggtaggcaagtcgctgacgttgaagggtcagcaccaacctctttagcactaaggacctattcggtgctctttggcactatggatctatttgtaagaaaaatatttatattttgacccttttcataaatttatgttaaaacataggccctcgatacaaggatcattggcgccgagggtccattccgagaataagtttgtccaaggatctatttgtaaaataaattttaaaaagaaccaaatgtaaaatctagacctacaacaaacaatagcgagcatatacttagcgcaacgtcatcaagaaaggcacttatgcaagaacagggataataccaaatgttgttaagtgtattctccatgttcttgagtaagtgtattctccctgtggttacttacagaagaatgagatcgacctaagtaacttttagttctagattattatgagtcaacttctgatggtatgtctctgatggtatgtcatatttattgggcctgttcggctgcactcatttagccgtggtgcagccagcctaaacagtgttttgtgtcatcagctgcgacaatgacgtcgcaacacagtggcttcaccttgcagccgaacaggcccattgaatatgacttgtgcatgactaggttgccagaggccaggatctaccaccatgtcagttgatcaagatgtttttgttggacctatagtatagaactagtgtgttgtgtatggaatatgaccaaccattactagtatatgttgtgtatggcatactagcagggacatactagagaagtctcaaataaaactagaattgaaatagagaacaaagatacaacactgatgtttctactttggtgcacagccgaaagaagaaaatctcatttaatgaacagaaaatgttttttcgcttcctcattgagccacgtatacttatatagcttgagacattgaatttggtcaggatggttggattgatggagattaggggaagagtcagaaaacttccatgggaaggatcaatgagtgacatggtggttataaatatcctagtcgtcggtagtaactttgggtagggaaaggaacaaacaatgcaatcaaaataaaagtttctaaatgacagtaaaaggagcaactataataactcaaaatgcataatcgtattctttgatcacctaaagctcttaaatatctttcacatactgtgataacatcttagttcccaacattatcatagctcttgttggtcgtttagtacaaaataccatgcaaacctcactcttttgaaaaacataaattatactcactccagattagaaataattatcgttttagacaaggacatggtctctaaaaaataattttaaccactattttctattacaatatatatagaaatatcaacaaatgtattattttattgaagagctcttaaagattaatccatacatatggtctctatgtttctaaggtaaatattttagaagttatatatagttcaagttttaaaattttgacatcagtattgtcctaaatgacaattatttttaacctgaagcctgaaggaataccaattatagctgtcattatacccaactaaattttaacatatataattattataaattacactttgcacataaatatgcaagtcatagccttgcaattgcatgacttaattggctagttataggtgattgccaaacaattgaatagtgctgctattatggggtagaaggctatggaatggacaaggccattcttgccatgattttttccattctttttcctttcacttatctttacagcttcattctgttggcagagaagtgtttctcaactaaatttcagctcaaagaatatggaaaggaaataaaagaatgaacaaaaaatatatcccaataaatgcttgcagcgtgctaaattttccaggttttgcaaaagtgtctcaatcttgctaggttccattcgttgaggtccttaaatttccctatgcatgctcaatagagtaattatttagtcaattgaaatgttggagaaccaaagaggatttaagtgtcgattaattaagaaaaatgggacagcacatctggagttgaaagctagcagggtgggtgcatgagagcttccccagaaaactattctaccacagctctctatttagtcacttaagcgataatattaaatccagttggagtgtatgaaactaaagtataagtcatttacgttagtaacatgaacaagaaaaatactatggtttagattgatgtagtgacacaaacaatatggggaagattttactcgagatgatacacttatatgggttttcttgcttacccttaccatgacctttttttatcacatcttatcttgacgatgggaactatatggtatgcatttttcatattccaattttaattacattgagtttatatttggatacataacaatagataagtatctcaatatgtgcatagttactagtggtctcaatagtacataaactcatttgtttagttttattgcattgaatgccacctaattaataccctccaaacatataaaaatctagagatgtttgcatcaatgtaaatccatgcttctagttatatcttttccacaacaccatattatacccatcatttaagaaaaatatgtcaaacaatcacaccttatccaataagaaaaatttacctcttgcatatgttttgttcccattctcattcctccggcgaaatattttttttgagggaataatgttcatctacttcaaacactcaatcctgaatcctaagctccaacaaatctgctcgaccaaagacaaacaagactagatattgtctagcaaatcttccatgcacttctcttttgaacattatatacatttggcaatagtgtggttgactgtttgcataatattttttactcccccgagtcaaaaaaaacaatattttgcactccctccattccacattaaaaaatgttttggcggtttggcctctccatccctcgtctagattcactaacatccatatgaatttagacacatatatgatatcatgtattaatctattcatactcaaacatcttataatgtgaaacaaaaggaagtactcaacaacagttgccaagaaccgaacaagtttactcaacaagccattaacgtatgcatactccccttctctcatgttggcatggatgccagggctcactcactttgcgagggtgctatccacattgttgatagcggattaatcacaccaattgtaccatgcataagcacctactgtgcccccaccccagcatgatgtgcacgttcccgatcttccgagaagttctgataaacaacgatttgggcggagtcgcgacacaaatcgatccggcttcttgaacgcgcacgctcttgagctccgcaatcacagcaccacgtctcctctggttatcacctgtgtcgaaacgcggatgacctcgccgagaaggctaatccctgtttgccaatcgaagaacactaacaagaacgagatagaatacaaccaaaattgcatatgaatgattaagctcacaagttggggtcttacaaaccgatctagcggcgaaactgttctcgacagaataatctaagcaaaacccaaaccctaaagatgacggcgactactgatatatagagtttagggtcgtgcaaccaacccttgacgcaaccctaataggttccaacacgatacacggcccaaaggcccaaatacgatgacacagcgccggaacagattatggacgtcaacttgttcggtcgattcccattgactcggaaagaatttggacgtgggaccaaaaccaatggaaatcttcttagctttccatccatataaagaacaccccaatacaagcacgtatgcgacctgggcgcccgttttagtgcagactagtcctggactccgagttgcactcgaggtcgacttggtttaggcctccaccttgacttggacgtattcgatgatattccatgactctaagtccttctccaagtgtctccttgtcccctccattgttcctaatcacaatataataattaggtagcaatctattctcaaattcatacaaagaagaacataggaacgagctcacctctgaattcaattgtcgcgcgcgagctcgtgttatcggtccttgaatgaccgttggaggattgttgtgtgtatccgaaggagtgatgtccgcaacacagcatacacgtgcactccggtcactcatttgtatgatcactatgtacggtgaaattattattgcaggtctgacccaagcaggctaggaaaaatcattctcggtgcacacaaaaatacaagtggaaactataaaaaaaacttgatcccccttgacttagctttaaataaggggccaccaaaaccttgcgctcgaatgtgggcacaaatgcaaaacccacaataaaaagtaaatgctacgaaaagtttagggacgaataatacctggttttatctccaagaaagtcattttattgcaaaagaggagtaagacaaggggaccctttatctcctcttccttttgttttgggagaagacttgttgcaatttcattaacaaggccaatcagaacaaccttatatccatgcctatcctaacactagagaatgaattcccaattgtacagtacgctaatgacacactgcttttcctgacagcatcttcaaaggaactcttttgtctaaaggctattctaaatacttcttcctcttcaacaggtttaaaaataaattttagtaagtcttgtatgattcctctgaatgtgcagccagacaaagttgagcatttatccaagatgtttggctgtttggtaggagacctacctttcacttattggggctgccaatgggtataagtagacctaaggtaattgatttcagccctcttgtggatagaattgaaacaagattgcctgctacttcttccctactctcttatggtgacagattgactatggttaattcagtgctttcttctttgccgatattttacacgtgcactctttccttgccaaaatctgtcatcctttctattaatagagcaaggaggcattgtttatggagaggttcagacataaattccagtaggaaatccttgatcctttgggatagagtttgccaacccaagtctaaagggggtttaggagtaattgatcttagacttcaaaacaatgccttgctaatgaaaaatcttcataaattttataataggcatcttgttccttgggttaaattgacatggtcctcttattatagtgataaagtcccacatgctttatctctaaaaggttctttttggtggaaagatgctctacagtttgttgatatctttagaggtcttttaaagtgcacaattggtgatggcagaacctgtttgttttggtctgatctatggaatgataagattaggcaaaggagttatcctagagctttctcttttgcaaggaaccaaaaagactcgagaaaatcccttgtatacccctgaattttaagctaatcccttctatgcctctgaattttgcttacttccttgtatacctccaaaatttaattttgatccctttcatacccctgccatcagttgaccgtctaatttctaaaaatgattattttaccctctggatgaacatagaaatttattaattatattactaaaaatgtaaaagtttgtcgcatgagactattatagttatgagtttgttgtgtgatgcattatttatcacaaaatttatttttagatatgaaataaaaaatatgtatttatttttgaaacaaagtcatcaaaaagaggagcattcctacaaacataggactaccaatgctcacaataatttttttatgaatgctcccgataaaaaaatccattatcctattaaaatttcaaatagaaattttaatttattacatttgtttttattttcaaaatttagtctcattagtttcataaaatgcacatattgtgcactcaaacaaaaatttcaatttttttcaagcttatattcaaacctaaagcatcaagggcaaaaaagacatttgcaatcaaacgtaatagtgaaatgaatgaaaatgtagcggtaggggcataaaagggatcaagttgaaatttcaggggtatataagggatcgggtaaatttcaggggcatgaaagggatagagtgagttttcagggggtacatagggaatttactcaaaagactcagttcatctgacttccttaatggacttgtcttagacttttaccctccctttgtctaaacaggcttttcaagagtatctttcaatgctttctacagataccttagatcagctgtcggatgaatttgataaatggtcttatgtttggggtaatgataagtattcatcccagaaagtttgtgctacaaatttcatgcatgtgcaggcacctgcctacttaaagtggagctggaagagtaactatactatgaaagtttaggtttttggttggctttttatgattgataggttaaacacttgggatatgcttgacaaaaagttttgtgcccttgttggaagtaatttaaattgtgtgttatgttcatctggagaaagggaaaccccttatcatcttttttcaagtgctctttcagtacagagtgttgggtgcagtttggtattgtatgggatctctctttgtcctttaaaaatatgttgaaccatgcaaatacatcttatcgatcttcacattttctggagaaggttttatatgcggcctagaacatttggaagcaacgaaatggatttatttgttataatgtttcgccctttgttccttcttggatgacattctttaggaacgatctatcccttctagtttttcgcttaaattagatgagagatcaactttactctcctggttgaaccagttgtaatctatttatttatttttaataaaactatataactgtgggggcttcccctacagtgctttccctcaaaaaaaaataatacctggttttgaaatttatagatgaattttacattttattttgtgataggttaagaatgtaaattaaatggacttttcgctttcatgaaacacgtctaatctagctagcatcacgtctagtcacggaaatgggtcattttggatattagtatcgtgtattatattagtgttcgcctagaacatggtatagatggtctagaccacatctagacattagaccatgggttaccatctagttagggcctaaaccgtgaattagactgtttgatcgtctactcggtcaaagattggtctagaccgtctagaccaggcaattagacaacacaaagacgagtagatcataaaattgttgtttagaccatggtctaggaaataaaccaatgcgctatcacatgtcaggagataaaacctggtggcctgcccaaggaccatatagcaaagggttttgatcccaactaaaacacttctctactattcttagacacgtcattgccatgaagtcacgtcacctctcctcagttagttgccaacatggaccttgctcccacctttctctggctcatgacgatgccggttgcttcccttattagcgtcgctagttcttcgatattttatggaacatgttaagtctatctacataagtatcaaaaaaaatgctgattgtatatagtacattatatcatctagacttggattttcttgttccctttcttgttttctttgtgttcctcagttttaaggatttacagtctacgaactcatgtaaccttttagctgtgtatatccacatgtggatatagtggtcgaattttcatccattattaaaagaatatatagtctgcaattttcttgtccgtgtgaaattatagtattgtcaaaagataaatcactaatagaaacccctggcattacattaacacatatgaaatactgcgaactaaatgaagaggtggatacaacaaatatgttaagggaaaacatagtattattgtttgactactactacggtagaggatagataacatgggtttagacacctacaatgtgagccatataaactaaaaaaacacatgctacaatggtttgacattcgcaaggttggtgtgcttcagagcgaagcctaacatgtcttaggcagttcaccaggttgtgcattattagatcctacctgagtacaacatgtataattccccttgcaaatagcttatggtccaagtgtccaacatgcttagcacgtacggcatgtctgcccccacggtcacgcttcctgtctttatcagcgtcatgaatccccgtggcctgacattccttgtcctctttcatctggattgttgttcctctagaaacatttctcctcctgctcttcctcgtagttgttcatacccacctcgtttataatgtattattggccctcgtttgattgctcaatcacgagaagaaatcgatcacacgaatgtgggagactgttccagtaattttaaggctatgatagtttaaaacctatgtgagcacaaataagatcttaagctactatactgacgtgttgtagcaaattaaattgtgagtgtttgacttcctagaacgcacttggcccgcatcttggatgctaccctttttttttttttggagaagggtacaacataggacgcacactaacacacaccacattcacaccacaacacacgcacacacacgcgtgcgcgtccctaacacacgctagaaatgagattggaggcactaggcctcagtgcacgggaaacgtgcagtcccactgaacgcgcacgcgtatgtgtaccctattacctagacgggaccaaccgaagtcagtcccgggtaaagaggggaaaaatccccccggacgagggacgagcgtcaagtttgggactcgaacgctggtcggcacggagcgagccactggctcctgccacccgcgctacgcacggtcctcgcatcttggatgctaccaacaacccttttggtcgcctggacgtgtctccgagccaggcccatggaatgcaaaacagcccacggaaacaagacgaatcgagctttgatgcttgtcctggctcgatgcacgccacgacgatgcatccgggtgtgcaaacaccacacccccgagtgcaaaagcggggatgacgggtcaacaccctcccccctcctcttctcgtcattcctcctctcctccatcttccgttggtcatcctccctctcttcgctagtcgtgctcgctctatgtgtcagacccctctattctactggctctcaccatcaccctgcactattacaaaaactctaaagggtgccggttgggaaacccccttcggtgccggtttttccaactggcaaccaggaggcggcactgatcacccaatgtcaaaggtgctggttccaaaaccggcacctttgaggtgcccatgagctaaaaaaaatcggctcaatgcatcgagccgatgcattgagccgtcaagccgatccaatatagtacccaaatcccaaaatttcctcaaattcatgaacacaaacatagtctataatcctttaaaaaacaacatatcaacatcacattcatcaagaacacacattatcaagaatcaaacacattcatcaaaaacagacattcatcaagactaaatcggatcgaggaggaggcttgccttcatcaccaccccgccaccgccggatggagaggacgagggcgccgccaccaccgttgccgctgccaaggaagctgtcgttgccacctcccgccgccgacccgccaccgccacttccccttccgccagatctggcggaggggagggcgcagccgccgggccgtcggaccaccgccgcctcccctcctgccaccgatccgccgccgtcgggccgccgaagccacctcccctcccgccagatctggcggaggagggtgtcgcccgccgccgccgcctcttctcccgccgccgcctgttgctgccgccgcgtccctcccgccacctccttggggtgccgagagagagagagaagtcatggctgagagagaggataatgtttcccctcacctcccacgcgagtggataaggccgtctctcggctcggctcgttgtcggttttctaagaaaaccgacacctttaatatattataggtgtcggttaatttgacacctataatatattataggttccggttttttttaaaaaaagatacaaaatataatagatgccagtttttatttagaaccaatacctataattatttaaagatgccatttttttatgatttcagcccgcggaggtgggaaaaagcctataggtgccggtttactaccggcacctatagtggcgactcctatttgatgttttgcagtagtgccgtctcttccacttacaatctctattgagcaaggtaaaggggccggctaatgggcgggtgatcgcccgatcaccccccatcccccctatacagtatacactactctcttccttcctcctcttcttctcaccctactacaccataaatttttaaaaaataaaaaacacaaagttgaaaaaatttatgtatagaaatactatataaaaaaattgaattcaaattcaaatttaaaacgggtatgtaaacttttgacttataaactttgggtctataaagtaatatttaaattcaaaatcaaatttgaatcgagtatgtaaacttttgacttataagctttgggtctataaactttagatgtatagaaatactataaataaaaaatatttgaattcaaattcaaatttgaatcggatatataaacttttgatttataaactttgggtctctaaattttagatgtgtaaacttaaggtgtacaaactttaggtgcataaatttactaaaataggaaagtaatacggtgccaaaaaaggaaaccacgtggaagagagggagggcgctaggggcgatcgatcgccccttagcaatctcgttaggtaaatgcatggatggttgtctgccgcccattggaaggttgggcatccaaacgtgcccatagtttgttaaatatgtgatccgaattttgggcccacaatatattcggattagtttcatagtaggagtttctattaggtgtctttcttttatccaatatatatactcttgtaagccgtacgggaaggggtgacattcccattgttattctcctacgtttgtaataaactcctctatagtgattatagtgattattgccggtcggcgcccatggttttttcccgcaagggttttccacgtaaaatttgtgtctccgttgtgcatctattttcataacatagttattatagaggagctacgtcctcctgtaggttaatctgcaggcttgactaacctacaaagatcacaacataacacatgtggattttcacccccttcggtcagagtacacaatcatgttctttgacctagaggaagacatagttgcttcatatagggaaaaaaaactgcaaaactatggtacgattgaagatgatcgatagggaaattatcttctcgttgagcatcccctttgtcgctaaacttaaatagaaaaattgggccggtgcatgggtcaggttcactaacctagttgtcttaggacttaggagtgcatccccagggggtgtgctgggtatgcaccggcatacccagaaattctgaaaaaagtttaacatgtagtttgcaaaaacttatctaaatgatggataagtgcttacatcaaagctcgagaggcctaggtggctagcaaggccccagcaaacagcaagtcaccacccagctcgtgtgcgtgtgcgtcgatacagtattacttgcctccttctcactggtggagaaaccatctttgatcggtccgctagatttcacaatagtctcggttgtattaaaaatcgggactaaaaatatctttagtcccggtttgaaagctcagaggaattttttgatcttcttttttttttgagaatctatgattcagatctgagacgatttgtgtgtgatgtgaatatgtgatgtatttgatttgtgtatgatgtgaatatgtgatgtatttgtgatgaattttgtagaagttatgatgtaatttttttaagattttgtgatgtatttagagatattgatttgagaatttggagactattctgggacgattgatttgggattttgggatgagatagagtgaatcaatatattaaaaacaatgaagaaaagaatataataaagtagcaatcggagctagcttctttagtcccagttggtactctatcttgattaaaaatgggtttttactcccggtttttttatccgggactaaagataatgatctttagtcccgtattcgtagttccggtttttcaactgggactaagggggttacgaaccgggagtaaaaactccttatccaccagtgtcttttcatgttggccgtgcggcgtgggcaaagcagcaagtgcgacggcggccggcaagtctgtcattgcccactagcccagagaagctgagcccctgcagcctgcctgcccctagccagaacggaggcatgccggccattgagtcattggcagcagcaacgaccagccaggactagcaacgagagattttggagtttgctaaaagactagttttcacctctttacaattctacttccttcaaatatgcgatctcttttctctgaatgatattaaattgaatcaatcaactattagtattaggatgaacatggatcttatttttgtctttaacatgcatggcaccaaaaaataaaataaaataaaataaaaatgcatggcaccaaacaattatgggattcacattctgtatggtgctagatacgtttcagaagccagagatgctctcggaataattgtatcacttgataaaatttactgagattaataaagcttccattatcttaaaaaagaagatacattccagaacaaaactggttttagaaaaataaaaaggaacattatcaaacaagagtactaaagggagtagaaattagtcgtaattggtgttgttttgtactccatttatagataaaaacatcatatatccctacatgaagaatttagttttcctctttagatttgcatgggcacaaccagggtaaaaaccataggtacaccattgggtatggtgttcgattgtgaagtcagcaagtatgtagtcttatcgaggagatcatcgatgtcattatgttatattaacagtatgatgaattaaaatattgaagatataactgagagtaaggtcaataatatagcttgctactggcgctaaaattgcatacgtcagctattacagccagcacaaaatagcctattcatacaacaattatttacaactttcaaccttacatggctatgcagttttcctatttttctaaagacgaaaccatcaatccgtttctctcaggagatcgcttgaacagtgaacacactagtactccaaatctccaatcgaccattgatttgcttgtagtggctgcgaaagttgtggacagcggccacccttacggcgaagcttgttctgggccgtagctgtggcgaagcgctgcaccgttgtgaggagacgaggcgaccttgcgtcgttgcgcggccgacgcaccatcgccactgtccaagctaaagagcatcggttcctatttcctcctggtttatttttatctttagagcaggtacaataatagactataagtcagctataagcttatataaaggagataagaaaggaaagagaagagaaacagactacagatatgtaacggctgtatcacacggactccaaaacgttgtgtgtgtatgacaggtgggaccaattattaatgatatagcatatatttatatttgtagttatctattgtatgaattagctaccagatcgactacagatgatttggagcgagtaattggctatacttattaaactcgacgttctgattctggctcgatgttcccgttttgagatggtcacgccgccacttctctaggggtcgcgccgcatcgacagttgaacgggcccacaaaccgcctggggtgctgctggcatcggctgcgggccggcgacaggaaagcttcaacgctcttggagcacgcgtgcagcgagtgacaatttagtcgccggctcgccatctctctcctcgcctctatgctccagtctagctttcgaacctacgtgtcttaccttgttgctagctaatccctctctatcgtactcgctctaatagtgcttcaagttgtcaatcatgaagcacatattatcacaccatctataatgaacacattggtcatgattttctatattaaaagtaacgcaagtcctggcaatcacaataacaatcacaataagtaaaagttttactttcttcgtcccaaaataactttatttttaatcttagatatacaaaacgaggtaacaaaagaatcacatataccgaaaagtagtattagtgaatggataattgaggttggtaaggggtattgatagaacaaagctcaacgatttacatatcgaagataagaaagatataaatttttagaacagacaggtaccgttatagggtcatgttactttggagaagcgctgtaaaacccgcgagtcaaatcggacgttatcgacaagcattaaggtactacagtaaactcagtaaacggcagcatatcataaacaggtgtggactgggcggcacaatcgtaaaggagtttgttattgatttgataatcacaattgaacattaatgtcattttaaactatatcgttgtattgtttggtattgataaatatatgactttggtattgataaatatatgataatatttagtttgttactaaattgatcatgcctagagaatatggcaaatattaagtctatcctaccaaaatttgacaatgctaccaatttgccagaagtttggtaattccttcttgtgctggtgcagttgccaactccttttttttcttttttgagaaccatgcagttgccaactcgaatctacagggcataagaatatgtatgtatgagcaacgaaagcatcatctatttggaagtgaaattcccagaactcaaaaactccgccgcccaaaactccacaaataggaagcaaaggtgcccatctaacaaaaagatacaccccagatcctacaatcttgtggaacaaatttcaaactcgtcgcgaaacgttccttaaaatttcggacctaactactctcctgctcattggctgtctgtaaaatcagcatcgatgacatcaccttcctcgcctcctggcttctcggatgggccagcagagccagcggcagcatcagctcctggggtaggtcctgctcctggggcaccctgctggctgtagagggcctgccccagctgcatcacttcctggttcagagcagcgagagcatccttcatcgtctgtgtcgagccacctgcaacagcgtccttgagctccgtcagcttcgcctcaaccttacccttcacatcgcctgggaccttgtcaccgagctccttcaattgtttctcagtctggtagatgacagactctgcctggttcttggtgtcgattgcgtccctcttctctttgtcctccttggcaaacttctctgcttcttcaaccatcttctccacctgaacagtttttgatggatataagtcaatataagatcctagcaggtattagtcaataagacagtgactgcgagtttgctcgagacatacctcatccttcggcaatgtgctggcaccagttatcgtaatgtcctgcttctttccagtacccttgtctacggcgctgacagaaaggatgccattggcatcgatgtcaaacttaacttcgatttgtggaacaccccgtggggcaggaggaattccatcaagccgaaagctaccaagagatttgttgtccctgacaaactctctctctccttggaggacattgatctccacgctagtctggccatcagcagcggttgagaagacctctgacttggaggtgggcaaagttgtgttccttgggataatcttggtcatcacaccacccagtgtctccaaacccagagaaagtggtgttacatcaagaagaacaatgtcgctcacatcaccagacaacactcctgcctgttgtcaaaattttgccagtcagatattctgtagttcagtagagtacatttgctttctgactctagaagataatcaatcctagaacaccagtgagacacacactgattgctccctatagctaaaatttagataccatgcatatgatgtactaaattccatcgagtcttgcctgacattatttatctagagcaacatattgaacttcagtttttatgacaacatatttttcccaaccaatatctccagaacctgacaaaaggagttggttgtgatgacaaggcctttacccatcgcatccatttcaaaccatttttttaaggatcatttgtatatcgtcacattctccgcagatttcatattactagtgtgaacaatgttgcaagttttccacatgtaaggatagaacaaaatagcacatttattttaaaatccattgcaaagcttttggtgatatgatatcacaagtatctaagtagtatggtagactcatttaggcagcagttaacttgggctatgattaactcacctgaacagctgctccaagtgcaacaacctcatcagggttgacagtcacattggggtcctttccagtcattttcttcacaagatcctgcacagctggaattctggtggagccaccgacaaggatcacctcatctatgtctttaaatgacaactttgcatctctgagggcattgtccacaggggtcctcaacctagaagacagttgataaaacattagcagtgtatcattttttttctatttttgagttatcttaatagaactaatttatcatacatacagtagttgtca

SEQ ID NO: 70382 - DNA, 803 bp, Oryza sativa
cgaagttttaagtttcttgaaacgaaggagaaaacgatgaacttaactacaaggcagcggcgaatgcaggcagaaatgacaacaaaggataaagtttgcaaggattcgtccttgaagctagcaaggaaaggtgggtggaacactggaactgaagcaaaaaacagtggagaaaaaaaatgagaaaaataaaaaggaaaaagaaaatctcaccttgttgccgaactggtagcaccaccaatcctcgccgccgccgccgccgccggcgggcttctcctccgccttggaaccccccatctcctccggcaggaaacgtagctccccgccttgaacacgccaccgcccacgccccaaccacccgcacaaaagactcgctctccctctccctctctccgccgacgccgacgcggccgcctcttcacgggcgcattaactccggaaacccccgccgccgccgccgcgcgcgcgggggaggaggaggaggagggcaccgcactctccgctgcagcagcgtcggctctagcgccggtggcggcggaggaggcaaggcgaggcggcggcgggcggcgcggcgcggcgcgagggcgaatgggcgatgagctgtctctcgctttggagactgggcgagttttggaggctttagctcctcggctcggctcaggctcgggatcgggatcggctcggctcgcgtacggtggagagaagtactagtaggagtggaactgactactgctgctgacttcgctttaaaagagttctctagtccgttttgtgcattcgggtccttgtgcaaatagcattttcta

SEQ ID NO: 70383 - DNA, 566 bp, Oryza sativa
tctacgagagcgaccaatgccactggggcggggcaccttacctccccctccgacggcaaagacgccgcccctcctcctccgccgccgggcgccaccattgctccgccgtcggcgatccacccgcgccgcgccgccgctgcacgtgcggcccgcgaatgagtgtgccttttgcctgccttctgccccagcgtgccgcttgcacctcctgtatttattcctccgcgccgcacgatatgacgtggcacgtttgtttacaggctttgtacgtgtcagggtaacaagtactctgttttttttcgcgggcacccagcaaacgcatatgcggatattgcgcaccactacaccactgcacacgtaacaccgaacttatattcgtggatattaaaaatttgtatcctgttgaatagggtcatgcatccatgactccggtactacactaagttgtaatctttatattttgatttgaggcatattgtatatggtgaacgtagttttttctcatgtctcttactagtgtattaactactttatattacatatgggtaccgagctcgaattcgccctat

SEQ ID NO: 70384 - DNA, 38562 bp, Oryza sativa
ccgagaaacctacgagaatttcgactggggacgcccagagcagataaggtcttgtcagattctaagagccgaacgaccatgtaagacctagtcatgtaagagttctcaaaaggtgtattaactaagccgtgtaatcggaaattgatttttccaacttcacggctaggggctaggtaaattgcattttcagctaggcaggttacgggtcatcgagccttcccctccgagaacaggtttccccgaggacaaggcttagggctagggagagtacctcactcgacaacgggccaaaggcagcctgtaaaaagagtagtactcgctcacaacacaacctgtttaagcatttactagatagatttctactttgattacaagttcttaatagagataacaatgtattataaacccccttttagatatttttctatagggaatgaagcctaccacgacggccactgccagttcatggaagcgaaaacgtcctcggctaaaggagcaagggatcacgccaactggtcgatctcatccgccgataaccgagaacggcgaaaacccccgcgcaagaatctgaggtacatttgcgagcggcgatcttggatgcaggcgaggacgtgacctccggcgtaacggctggcgcggcgacactcctcttttaggctgatgtcgatccactgtccaatgccttcaagctgagcacactgttgatagtcgttatcaatcagtttcgaccgtcaatattaccaaaatagaggagaactagtgatggttgcaatgcatatgcttgttagaataataatattccactagtattaggtttactaaccttttgcagagaataacaataaagtgaaggagaatcgagatcaactccaatgataaatcaatcggacgatgtcgagaaccaaacttgtgtatgaatgggccaagaactcagaattgacacgacaaactgggccaaaattcacaagtctgcggagaagaacaacagaggaggctgccagccaaaccttgggcttattgggccggccccaggatcggccgaacctggtggttcggccgaacctggtggttcggccgaacccccctcttcgccgctggatgcagggtttcttctggacagtgtggattagctcccaatgacggttggagggtatttccgaccattccaaccgtcacaaccgtcattgggaggctatataaacccctcaccttctcacttcactcacacacctcaagcaagagctctctcgttcctctcaagtttagtttagtagtatatagctggtggaatagaattagaataggaatcaggagtccggaagccttcggaagagttcgggtatggctctagtagctttcctttcctcttttgtaagctttgtacttttattagaatactcttctaaatacatttctggtattgaaatactttccgagtatatgagtaccaactttacattatgttcttgttatactgaatatattgctagcttgtctgggagatgcatgctttggtgcgggtatagtgtttgcttatgcaattactctatgtcatgacgatgatattagagtagtatctggtagtttagacgtggtgtctagattacaggatatcattatttggggttatatattgcggatgagaggtgggcctctgatggtgacagctcagtacgggtattcctccacgcctatatataatcctaagttaatttcctggggagggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcaggcatatcgcccaaagagggcaagtcgatcatcgcgacatcgggacatccgcattgctggacatcctcggaatccacacagctatgaagaataaaagacgctacagattaacaagtgacgtgaagagaaggaagtcactccgcctaggagattaacagaagtacttgtacaaaaactacaatacaaggtaaaaaaaagtttactcctcataaagggggaggacgcactccccgagatccatcacactagagacatgtcctcgcgcgtggcatctgctgcccccttcgacaagatctccttgagatcggtgacagggagagccagcttcacgcacgcgaggacgtgacacgccctgtgtgaatcccgttggagatttccttcgagaccttggcagtatgccgcgacgggatgacctccatctcgcccgccagctccgacaacgccaacgtcaaggacgtctcgtcgaggtgcgtcgggatagaagacatcacaccacacgccaaggctagctggtgaaggcctatgaagctcttgcggagggagtcgcggagggagaagaggtggtcctgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaacggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggcttcctctgggtcccgctgcctcctgcgatggctggaacggaggggatgttggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtacgtcgtgcgttgtactatcgcgtgagtgctaacgagcgcacatccaaaaaatagaaactgatgcagttctcccgtacgcgtcttttcaagaaaaaaaagaatcgcgcaacgcaactgcgatcctacccttgtgcgtgagtttttcttgctagcactctctccgtaaaaaaaatcaaactcgtagtacgatgtgacatatcatatactccctccatcgaaaaaaaaggcaaatactgggttttcgtatccaacgtttgactatccgtcttatatgaaatttttttataattagtattttcattgttgttagatgataaaacatgattaatactttatgcgtgacttgtctttttaatttttttcataatttttttcaaataatacggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcctgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgcctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgctttcaccatcgaccaccttcgtcgctgccgactggtgtctttactgttattgatggacgactttgttcccacattggccacctctgccatcaccaaggggaatattacaaagctaagtcatcattaattttctttatatgatattttccttttcctctgcctcactacatcaactggttcgccgttgactagtgagtcgggggactatagatgtcatatcatattttttaacaatttttcataatatttatcttgattgcttgcgaaataatccgagtaacaataaagttcctatcgagttatggagttctattttcctatgctttccatttggtttgtcgatggatagttgcctttgggccgattcctagcacccgggggctcgttggatggaccgagtaacgcaaggtcctaagtattattcggaataaatcaaaagcatagagataagataaatttattttctgctcttacaattgcaaaagtacccgagtagtaaattttgattcgtgaaactttgttccattaatgacgaactcatgtcactcatatgcatgtttgggaagtgcctaaaccaactcccgatgcttgggggctatgactagtcgggcagagtgtttaaacgtacggagtcatctgctcggggaaatcaaaattgacaagaggagaaatacatatttataaatattttaaaatacttgaatttttctcaagtactgtgcttgcatcagatactactcattctatatgtttgttctgcaggatccagatccagatatgcataatagggatttatagctttaagcttatctcctacgcttcaggaatggattagtcagaatatcaccattggcttgctgtcgtcgtcgccgactggtgtcctcgcctatacggttgggtggtcacatcaccgttgttggacgtcatcgtcttcaccgccgacttgccttcgccgatgtcgactggtgtctccgcctgcacggctggcctattatgccaccgttgttgggcgtctacgtcttcaccgaccagcttgccttcgtcgccgccgactggtgtctccgcctgcaccgctggcctattatgccgccgttgttgggcgtctacgtcttcaccgcctgcttgccttcgccgccgccgactggtgtctctgcctgcacggctggcctattatgccgccgttgttgggcatctatatcttcaccgaccggcttgccttcgccgccgccgactagtgtctctgcctgcacggctggcctattatgccgccgttgctgggcgtctatgtcttcaccatcggcttgccttcattgccaccgactagtgtcctcgcctgcatggctggcctattatgccgtcgttactgggcgtctacatcttcaccgaccggccacctcgtatgacaccgactggagctatcgtattcacggctggccatatcgccgccgctaataggcgtcatcatcttcaacgtaagctgtctacgtctgctgctgactggtctcttcacttacatggctgcatgattctgatactgttgattggccttatcgtcttcaccgccggtcgtctcgtctgctgggattcgagcccaggtctccacgaccacaacgtggaattctcaccactaaactactgccgactggtttgttcgcctccatggctgcgcgtcttcgtcatcattaactggcgtcatcatcgccggtttgccttcgccgccgtccatagtgttttcactttaatagctggcctattttgccaccgttcatggacatcttcgttttcatcatcatactacttcttccgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcaacgagttggacaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgcttacgtcattgccgacttgttatttcgccttcacggttgacctactacgcaaacgctgatgagcgtcttcgtcattatcattagctgctacactgctattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaggcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacaccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcagaggctcggcgcagccgctcccttcctccgcaagccgacgccggtgcagatccctccatccgtttcccaccaccgccgctccttcccttcacaagcgtgtgccagcgaggatcccctccacgcgcttcccatcaccgcggcccctgcctccacgagcgggcgccgccgcggatcccctccgcgtgcttcccgccggcgccgcccccttcctcccttcagacaccgagtgccaccaccgcaactcgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctctcgcaccccgcacacccacccatccactttagctggacctttggccgctctaccctctatcaaagtaggaaataacagcagcaacaacagctcacagccgtaaaagctcacacacctcctcctcctcctcttccacgcgcgtcagtgggccgcgctgcaccgcgcattgcttcacctctgcacacctgaaaccgaaaaactcaatttggagtgaagcagggagagagagagagagagagagagaggagagaggtgtcgtggagggaagtttttgaacaaaaaatttccccaacccgttgggcacgatgccgtcatgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccgccgcccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtaggaaggtgactgggtaagggggtgtgactgtggaacggtgaacttgagctggcacacggctggctcaggctcaacaacacgagcaccgctccatgcacacgaactcccagtctaccacaaacgccacactccctaacgacattaccgattgggagggtgagggagagatgagaaagaggctaacatgtggccctatcctcgtcttggatccagatcaagtccatgagggatccatgtggcatatgcccacgttgtctcatggagcggatcaggggctagtttttgaccagtgatgatgcacagtatacaactcatacttgaagggttgatgcataaaaaaataattttcatgatgtcattcagagttcaattttgatcccttctactccaatgaaaaaaaaagatcggttgaaatgggacaggagagacatgttttttttgtggcgtacatatgattgtaaggatgttcggtgcagggccgtccctagcaatttggggcctgtgccaaatataaattaagaccttatctttagaaaatactattatataatagattagaattatatattatttataatacattggggtgggtatctaataccacttcttttttcttgatctgcattgcaatcaatggccttctatccacatcaagaaagctagctttaatctaatgctactttctttagctatatccacaataagcatgaattgtttttaaccaatgataactatatctatgtcaaagaagttcaccaacctacatctgtaaatgttatggcaatccggctaaatagaagaagaatttatgggatctgaaagtgcattttgagaattcagggacttcgatgacatatacgaacaagtttagggactagtcgtgtactttactaaaaaatactagtaatttggtactacagctgcgtccaatacaaatttccatccaccctacttaagaaggtggacaattggacggtttggaggccctcacacacctcgtgtatcatgaggaggaagagcaaacggtgggatctactaataagcctctcacatcctacatgcccatctgctctaaactgatctttggctgcctaccaccttgtcaaagtaagaaatatgcatcaacaacaaaagggatgtttagatccaggggtgtaaagttttggcgtgtcacatcaggtattatatagtgtgttgcatggagtgtttgggcactaacaaaaaaataataattacagaatccgtcagtaaaccgcgagaagaatttattaaacctaattaatctgtcattagcaaatgtttactgtagaaccacattgtcaaatcatagagcaattaggcttaaaagattcatctcgcaaattagccgcaatctatgtaattagttattttttagcctatatttaatacttcatgcatgtgtttaaacgtttgatgtgacagggtgaaaaattttgaggtgggatctaaacagggccaaaaacacattcccaaaatcgaggaaacctagtggctagggcctaaggtagcatatttacattaattattgattaggtggtacaatgaagacaatagcaaaagggagaggcagtacaactccctattaaactcatgttaatatctattcgactaacttagtaatatctttgttctatagtcgatgcatcctaaagtaaaccagtgattcatatattgaatatatttttttagttgattcaaatataaagtctctactagtaatttgaaactacatatgaatccaaaataatttttcatctaatcatttaagaaagggcgaaaagtggatggctgattggttatgccccctcatagctcatgagtcatgaggaggaagagcggatggtgggtcccaatcatatgattctcacaactagcataccccctcatctactctaaacgaacctttggctgcctattgcattcttaaagtaagaaacaacaataacaaacaccttgccttgaattgagtggacctagtagccagagccttaggtggtacaaagaagcccatgatgaggaggtagtccaatccctatattgaacctatggcccgtttggttggagggagtttttaggagggattgggagtttagagggatgaggctattaagtgttttgtttggttggaagacatgtgaattttgatgggatggagatgggtaattgaggaaggaactccctccttttcaatacctgggtaggggcaggtaattgggagggaattcctcctttactttgtctaagcaaatatcagccatccgtttttattaatgacataatctccaactaaactccctatcaatttccatcacctctaccaaacaagatattgggattaaaaatcaaattcccatcttaatctcatcatcaattccctcgtgtaaactcccaatccccttccctcgagttaccaaacaagttgctatgttattagttttttttaaagaaaggaagaaacatatgctattaactattagatgtactcacctattttacctttgtattaatatatttgccgtatagttgacgcatttcaatgtaaaccagcgattcaaatattgatttttttttgaaagatccaaatatataaacgttactaccaatctgtcgttgaagataagtcaaaaacaaattcccatccacctatttaagaaggcggacaagtggacggttggtaggctcatcgatgtgcccccctcacacctcatgagacatgatgataaagagcgaacgatggggcccactcgtatgcctctcgcaccctgcactcccacccatctgttttagctggacctttggccgctatactattaaaatggagaagtagtgcaacccctattataacccatgttattaaatactatatctattcaaccacattaatgttgtatttatatttttctctatagtcgttgtattccaaagtaaacgcgtgattcttatattgaatataattaaacgcgtgattcttatattgaatataatttttcaatagatcaaaatataaagtctaacaataatttttcactacatatgaatccaaaacaaaatttccatccacccatttaaggtgggaaagcggatggctggttgtcccaccaatatagcccttcacacctcatgagtcaatgaggaagagtggacggttgatcccagtcatatgcctctgacaactaattacccactcatgtagtctagacaaacctttggctgcctagcaatctcaaataaagaaacaatgttaacaaacactttccccgaatagagtagcccgagacttatgtggtataaggaagtccatggtaagaagtagttcaattcctttattcaaacctatggtatattcatatatcttattctttgtgttaattttttttatagttaattctaaagtaaaccaactattcactaacagaattttttaaagatccaaatatataaaggttactagcaatttgtttctaaagattagtccaaaattcatttctatccacctacttaagaaggtgaaaaagtggacgattggtaggaccaccgatgcacccctcaaacctcatgaatcagagcgaacggtggggtccactcatatgcttctcacaccctgcacacccgccccgtatgttttagccggaatttttgtcattctgctattaaaagaaatagtaaatattccatgacgtgtcatgagcaggatatcatgtcttgatcatatgcctattataactagcatacccacttatctagtctagaaaaacctttggctgcctaatatattctaaattaagaaataacaatactccctccgtcccaaaaaaagtgcagttttgtactattcatctccaacgtttgaccgttcgtcttatttgaaaaaaacttatgattactatttttattgttattagatgataaaacatgaatagtactttatgtgtgactaattttttaaaaaaaatttataaatttttcaaataagacggatggtcaaacgttggacacggattttcacggctgcacttattttgtgacggaggtagtagtaaacaccttcccctgaatcgagtggacctagagtattaataagggggtagtccaacccctctcgttgaaacctatgttatttaacaattagatatactcatctactttatctttgtattaatatctttgctgtataattgatgcaatatcttcacatattatatatatatattttttcaaatggtcccgatatataaaaacaataattcttcactaaagataagtcaaaaataaatttctatctacctactttaaataagtagatagttggtaggcccactgacgcacaccccctcacacctcatgagtcatgacgaggaagagcaaacggtgggacccactcatatacctctcgcaccccgcacacccacccatccgctttagctggacctttggccgctctaccgtcaaaccaagcaagctgtcaaaggaaatagtaggaaataacagcagcaacaacagctcacacagacacacacctcctccccctttgacaattgacaccccctcctcttccttccacgcgcgttagcgggccgcgcggcgccgcgcattgcttcacctccgctccgcgcggctgaaaccgaaaaaaacccaatttggatcgaagcggggagagaggacttgaggagacgcgtcgtggagggaagtttttgaaaaaaattttccccaacccgctgggcgcgatgccgtcatgatcccccccctcgcctcgctgcccaaaaatttttcaatctctctcgcccacattaatcaccttcctcacgaggccaacgagcagaaatcccatttcatcatcattcataccaatcctctcggtttcttccgcgtccccggattcagtttcctcctcctctccccccctctcgatccctcctcctcttcccctcgttccagcgcgctcgccgtcgcccgccgccgtccgccgaccatggaagcagctggagtggaggtgaacggaggaggaggaggcgacgtcgtggtggtggtgccgcagcagcatgaggtggcggcgaagcaggcggcggcggcggcggcggcgaaggggaagtccgtcgaatccaagggggtccgcgtcgtcggcggccggatctatgatccggagaacggcaagacctgccaccaggtaacccctcctcctcctcccacctacctgcctgcctaccatctgttcgacaccgtgtctagccggtgtcctatgaggagtcgtgcgtccctgttcttcctccccggtggttgggtcgggttggatctgaggaattcttgctcgcccccccttgtttttgcggggaattcttgctcacccttgggtttagcggttgctctgtttcttgctccctcgcagtgccgtcagaagacgatggacttcgccgcgtcatgccacaagatcaagaagaacaacaagcagtgcacgatccagtactgccgcaagtgtctctttaacaggtgaggggggaatttcttctcgtcttctttcttagcttcaggaggcagagcaaggctggctgaccatgtgatttctgagtgattcgtggcgcaggtacggccaggaagccgagaaggtggccaatgacggcacctggacttgccccaagtgcaaggatatctgcaattgcagcttctgcatgtgagctgaccaaacctgatgctctaccggtcatgctgattatctgtggctcgcgttttgttgtcagaagtgatggatggactttgatttgtttggcaggaagaagaaggggctgccgcccaccggaatacttgcccatgctgctaaggcttcaggttgtgcttcggtccatcatttactgaaaaaggggaaagaagcggtggctgccgcgcagaggagcacccagaaagtgagatctacacctgtgaaggtgtgtggtgttcaggattggcacgatcctttgtcacattacaattcgctgttgcatggtacgattgttcactatgtttgatatgttttgctgatcctttttttatgaacaagcagaagagcccaaagagggccatacagccagatgctgctgctgatgaacctttggctgaaggggatgagaatgtatgcattgatttcaatgctgctccagtgaagaagcagaagagaagcaggaaggtgggtaatggtgtggctctgacgaaggatgaaagccctgatgctcccaaggaacaagttgttctgcccaagggcactccagtcactagtgttgccggtgcagagtgggagcctgaagatgttggtcttgcacttcagttcttcgaattctgccgcacatttgctgaggtagttacgaaagaaagatcaaggatatttaatagtatgattgcacatgccttgtcagagtaatatcttactagcatttgcaagagaataatagatcgagttttttttttctatttacatgtctgatgcatgttatgttttggtatgaagtatgacaatgtaaaaaatgcttttactggtaagcaccgaagtgttgatattagagcttcctacaagtttggaatcatatctatgtgtttatgtaggtaaggcatgcaatgccatgatgggatacaaatcataaagggaataggtattcggattagaatttggagagggagatggtggggtgaccgggtgacagcaaatgggcaaaaggaaatatatgactacctgttgagttcattgtacgcattaaatggatgcgatttctctgcgtgcaacatgctaacacctagatacaggctatctgttaattgccctttaatgtgtacaatattcgagttcctatttgtaattatgaggtttcttttttattgcatggcacttcttgtccatatgatatacatgttaacattgataaactggtcgaaaccttccaattatatttcttggtttgtaatttaagccatgtagtagctttcatataacccaaattaaatgttattatgttctgtcgaatttttttatttgtgataggctgcgtgttcaactgaactaccaaagctatgttttaaagttttttttttaaggaaactaccaaagttatgtttcatcctatacaatatctcttgcaaaaggtatgtataaagctccattgttttacacatagtttgagcaaagttcaaacttctgagcaaaacaactatctattccatctgttccaaaatataagcatttctgactatttacctgaacggaaatgcttatattttggaacgagggagtaagtgatagcgaagcttattcttttctgtgcgagtttataatttatttcttctgttatagaccaaacatccaagtccttaaggcataattttggtaaccagcaaaacattgtaacagttgttttattaggcgatgtgatagttatcttaatcttttatgtttatttctaacaagtgtcatggaacaattagtgtaaaatttttgcaactaccgtgagtcctgttccattacaattgttgcatcatacttcctccgtttcataatgtaagactttctagcattgtctacattcatatagatgttaatgaatctagacatatatgtgtgtttagattcattaacatctatatgaatgtggacaaacctagaaagtcttacattatgaaacggagggagtaacttcttagtgttttttagagttttccttttgaattcgggcttaggatcgctttgcgttataatctgaagtatttagtcattgccgcaagtgatcgctgcgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaatttgtagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcctgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactctgagttaccttctagttccttgcacgacaccttgtgcgcacggtggccccttgaggtgcttgcgggtcccgtcttcattggaccctatttgtcgttgtcaaccccatatcttacaagaactgactagatctagtagcctcaagtttggagcaaccaaatctgacactacaatgcctctcgctttgccactcatccttgtcacccaagaccatggttgttttgttgcttgttcctaggccaatcgccatcatcaccatcacctgcgctcagagcacccagatctggcaattagatctagcagccgtaatattgcaacaatcaaatcaatcaacccggagctctggctagatagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaaaaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgtgtactctctctctctctcgctctctctctctctctctcttcctttgtgggcaagaaaagaaccaccgggtgggctcaagactgtagcatggagctgccggccgagctcaacttaagtgcaatgccggagctgttggggctaaggccgagagctgagctggctgctgactgggctcaaggctgagcatgacactgagccaccaatgactctcgaggccgagcatggtgtaagccctgacagggctcgaggtcatggtcaagtgcgtagtctgcttcgagcggatgccaacagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatggcg

SEQ ID NO: 70385 - DNA, 1161 bp, Oryza sativa
cgctagctctacaacttattattaagatgttttgtcaattttactcgtacatggagtccttatatgccatggagtcctttctcatggttcatgaatatcatgatgcctcttcccctctcgatctctataaaacccgtatgggcatgagagaaaggtgtgttatctaagcagccgatcaatgataaaaaaaataattattgttcaggaaaaaatattattttaacttgtccgggtgtataattaattagaaataagttttaattttgacttaaaaaacttgaggcagatactccctttctttaaagagaaaaaaggaatagaggttggtagtacgcgtaaggggaaaggaaaactcaactctgacgcatccgtcctagttaattaaaccagagaaattccacatcaattgggatattttgtgtgaactggatgaatataattaacaagttggtcggcaacaaagagctggtggtaatgtcatggtctcatggagtagctagcagaaagtgcatgccagaaagctgagaagaatattaccctagtagctgatcaaagatgaaaaattcagatgatgtgtttcactgatatcatttgacatcaattcgatgtgtgcgctgctgctttttctccacgactttgcgttattctcaagtagatcccatacactcacatagcaaaagtgcgatgatgcgtttcgttataaactagtatatataacgaaactaaaagggtataggataatggaagcgtgcacaaagcagtataggagctttagagtatttaacctcgacaaccactaagacgacaaccactaagaccctgtttagctcccataacaaaaattttcacactgtgacatcgaatgtttggacacatacatatagtattaaatgtaggaaaaaaacaattacatgtaaattgcgagacaaatcttttttaagcttaattgcgccatgatttaacaatgtggtgctacactaaatatttactaataacagattaattaggattaataaattcgtctcgcagtttcctgacggaatctatagcttgttttgttattagacgatgtttaatactttaaatatgtatccgtatatccgatgtaatacccaagcccaaaatttttttccagctaaacaaggcccaaggggctgcagg

SEQ ID NO: 70386 - DNA, 4783 bp, Oryza sativa
ttgagtcagggttcataccaagctataattgttggacatcccacggagagcaaggtgttgaaatggaagaagatgaagtggaagacgacaatattccggactttgctcagtacttggatttgaaggaaatcaaacgggcgaggaggaaagggatgctgatggtaactacgttgcggatgatcttggtcagatattgcaggacgccaaggaggactgcgaaagtgaaaagggggcccataaattggacaagatgttagaggaccacagaacttcgttgtacccaggttgcgagcaggggcacaaaaagttagataccactctggagttcttgcagtgggaggcaaaaaatggggttagtgacaaggcatttggcgatttattgaaactcgtcaagaacattcttccggagggaaacaaattgcccgagacaacgtacgaggctaagaagatagtctgcccgctaggactggaagttcagaagattcacgcatgtccgaatgattgtatcttatatcgcggtgaggagtatgagaacctagaagcatgccctgtttgcaaagcactacgatacaagattatacgagacgatccaggagaagttgacgggcagctaacaaagaagagaattcctgctaaggtgatgtggtatttccctataataccacggctaaggcatttgttcaggaacaaggggaatgctagaatgatgcgatggcacgctgaagagcgtcaacaggacgggatgctgaaacaccccgccgatggttcgcagtggtgaaacatcgacagaaaatttaaagaatttggaaaggacgcacgaaacatacggtttggtttgagtacggatggtatgaatccttttggagagatgagcagcggccatagcacttggcccgttacaatgtgtatctacaacctcccctctggctatgcatgaagaggaagtacataatgatgccgattattattcaaggccccaagcaacttggtaacgacatcgatgtgtacctaagaccactggtcgaagatcttaaactgttgtggaagaaggaaggtgtctccgtgtgggacgaggacaaacaggaggagtttaacctacgagtactgctgttcataaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgtagcaaaccacccggtacggaagaaaggcaagcacttcgaacataaggctgaccaccgtacgaagcctaaacatcgcagcgggaaaacagtgtttgctatggttaaagatcttaaagtagtgttcggaaaggggcctggaagccagcctatagagagcaaagatggtcacgcggcgatgtggaaaaagaactctatattttgggagttaccctattgggaattcttggacgtacgcaacgcaatcgacgtgatgcacctcactaagaacctttgcgtaaaccttcttggcttcctaggtgtatacggaaagtcgaaagatacactggaaacacgtaatgatctgaagcatatggaacaacgcggcgaccttcacccggaaccaaaggagaaaggaagccattacttgagtccagccagttacactcttagcaaggcagagaaggaaagtatgtttgaatgcttggagagtataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgtagaaggtcatcgatccggatagattagaagcccttcagaatgatgtggtgcaatgtttcgtcagttttgagttgatatttccaccttcatttttcaatataatgacacatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattccgtaaagcccatttcatggttctgcaacaatcttcattggtagctccttacatcgaggagcacttggctctagttcgcgccaggaacatcggtaagtccgatgcatggattacacgacatcacattgatactttccccgcgtggctacgacaacatcttatgggtaacaagtcgatcaaccaacaacttaccttcctggcgaggggatcgtctgggtcgatcgcaacattccagggatatgagatcaatgggtacacattctacacgagagcccaagacatgaagagcacgaaccaaaacagcgctgttcgtgtcgatgccatgggacacgatggaacaactggcacgtattacggtgccatcgaggacatatgggaacttgactatggtcctctcaaggtccctctgttccggtgccaatggtttaggttgactggtggaggcgtaatgattggtgacagtgggatgacaacggttgaccttaacaaggttggatactcggacgaaccttttgtcattgccaatgatgtaacgcaagtctttttcgtgaaggacatatctagcaaaggaaagaagagcagagggcctgacgagcctaagcgtcacgtggttctcccaggcaaaagaaaaatcgtcggagttgaggacaagactgacgaggattacgatcagttggatgggcaacccactttcacggtgacgattgaccctagcatcctcctatcaaatgaagacaccccttactcacgtagcgatcacaaggagggaacaatagtgaggagaaagtacgtgcggtcaaccgtcaccgcgatctattgctgtaattattatgtacacgatgtaaactattttggatgtattgattatccatgtaaatcaattgatgtatggatatgttacttacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattatatatgactatttgaatttttaaaatttttaaatcatgcatgtggcatttacatatgttaattagagtttttaacaattaatttaatataattcctatgctaagtatatatgatgattacaatttttattaattttaaatcatgccgtatgtatttgagttttaatataagattgttaaaacataaatgtctcatgacttagcagatgtttcctgtatgaacagatggctgatcgcgatgaggaacagatattgtacgatacaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaccaggaggaggaggctagtggaagtcaaccctccgttggacagaagagggcacgcgggcaacgaggtgccgcgaagaagcttgagggtcggcacatcataacggaagtggaagaagatggacgacctagtgccccggcagaagccgccaagaactatgtacgtcacagcggttgggttgtgtgggataacgtgcctgtcagtacggtgtactagcgaagaacaagggcacgcggagatcatgagagctttgtcccagatttggagaaagagatgctgtggaccacaatgctcgagacattcacccttcccgcgggtacagaggacaaagtgaaaaggtggactctgaagaaaatggcagaacagtttcagaacttcaagggagatctgtaccagatatatatcctgaaggggcagacaccgaacttcgacacattcccaaaactaagggatcaatgggacgagttcgttgcatataagacaggtgaacaagggcaggcgatgatggaaagaaacaaagaaaatgctgccaagaagaagtaccatcaccacttggggtcaggcggctatagcgtcgtgatgccgaagtgggaggagatggatgctagcttgcttgagagtggtatcgaaccggccaccgctaattggccggaacgatcgaagttctggtactatgctcacggtggaacgctcaacccagctgatggctcactggacttcggcgatcagatacgagatgctgcgcgtcgactaacagacgcagtggaagcctcttctcagggcacgttccgaccagacagagagagggacgagctgtcactcgccctgcagactccagagcatccaggacgaacacgagggaaaggggtgattccttggaagattgggttcaaggaggacatgcacatgtacaggagtcggatgaggagcaagagagataccgagtcgaagattgcagatctagagttcagggtatcgagctacgagcgca

SEQ ID NO: 70387 - DNA, 798 bp, Oryza sativa
ttgtaatattcttggtgccctaatgtactctccggaattttccgtgaattttcggagctcgagaaatagttttaaagtcacaaagatcatttaaccaattaaaataaaaagaaaacaaataaaatcctccctcctctctttgggcccctttcggcccaattccccccccttctctccctctcgggctggccttctcccacggcccgctcggctctctctctccctcaagtctgctttacctccctcgcccgttttccccactctctctccccgacaggtgggacccgaggccccacctgtcagctcctcctcctacctctggctggccggctgcaaccgccagggccgcccgagccaccccacgacgccgccgtttccgacctcctccaccccgcgcgcgagcccgccggtcgtgggaccccgtcgccccacgtcctccacccttttccccactctccccacgaaaatcgccgccggttaacctctccaccacccccaagatgccccgcctatctcgtcggccggttgccacctctctcgagcacgatcccatcgctccaagcccataaaaagcatccccggcctcccctttccatttcccccaattttcccgagcttctcgcgccctgtactgctctcccctcgctgctcccatcgccgccgctcaccggcgactctccatccgctcgccaccgctgctacagccgtcgccgtactgttccgccgccacctgcggcttcgccgtgccttgccgcacctcggccccgctccgttttccccattccatcgttggaaccc

SEQ ID NO: 70388 - DNA, 7366 bp, Oryza sativa
atttgagctccgtatgtgacaaatggttggtctgcgttctttatttgctttagatgacaccgaaggaggcatttcgggatctttcacacaaattccatggcaaggcacctggtaaaatgaagcaggaacggcgccaaaaaaagtatcgggatgagttgaaaaccaagcgaatgatatcttctgacacaccattaatgtctgcggagaagatgagagaggctcaagctctcagcaaaacaccataccttgttttaagtggcaatgcaaaatcagggtatgtccacagtatacttctacatccaagttcttattttaattttccttccgatgctgctttttaaattattttgatgtcttccaaggccttaatggaagtccaaaacacttgctctggatttataggtgttaaggacttaatagttaatattgcacaacagtacttttttttcacgagatattatttttgtttagtttgtgttgagcacaattatttcatctgtattatcactgatggcttatatttaattgaggatatacaatgaaatccattttcgaatggttaatatgatagcatgtgagctcccaatgtagttggatatttatttacaatttagagggattgaggttcacatttatgcctctgtttttttcattactccatctggttgagagattgtacaaggcacgtctagattacatttgactgctggggaatttatcaaaaattgcttatagcttgtgcagttatctttgcatactatgtatgtgattcctattaatatcatagttttcctgatgaagtgcctaaaccagttctgtttaatgtgattttagtcaaacgagcgatgccagtggctttgctacagtggagaaagagcaccctgggagtctgacgcccatgcttggggccaaaaaggtatggcattccctgttccattaagtaattactttatgaataaattatttgttgggtgttaggtaatgtataagctgtacatatgtaatccaacttaccatattcagaatcctgtctttgcctttcttttggcaggtcgagcactttctgggcatcaaacgaagcgcccagggtggaggattgcctccaccacctccaaagaagccaaagaactgaacctgcagtggacttggctgagtagaaatcaggtgttttttagtgcatttgctactgtaggtttggagcagatttcgagggacctacaccagcagataccaacgacccatgaagcagccccaaatgagttaacatgtaagaacctgtgaatttttattccaagttgattatgttaacattctgacatgggcgatgtaacttttgtaaccagctgtacttacaaggctgcaccacaaatgcagtcagaactacagaggtggatttaaaatgttgtcgtgtctccacaaatctacattggttgtttaagctggacatacaagttacgattgctgagtgctgacaaactttatagtgtttttcacgtactctgtcccataaaaaacaaatctagtatatgatgtgatacattctagtaccataaatttggacatgagtattaaaatgtgtaacattctgcctcccaaaaacatgtgtaacattctgtactagatttgttttctgggacagaaggagtatgttggggaaagagggagtacgttgacaaacaagcatgtagtagtcaggtacatcaaaggaggcaaaggcaatgcacaccgtgatgtttgttagtcatgtagcacatcgaaggaggtaaggcaatgcactctacggccgaggttttcctttcatttgctgccattcttggagtgtcctgaaagatgccaaagtgtattactagcataatttgagatagctcctgcgaggctctgaatctgtgatctagtacggcagtactagagttaccaccaatgctttgacgaggcactcctgaactgcttggaaggctagtttttggcccaaaaactggtttggttggagtaaactgtaatgaatccgggctgcgatatgtttggcacggttttagctccagctccacctctcctgtagctggagtttagccaaatagtttcagctccatctaaaaaaggagtgtagctggctgaccttctcataaaatagactagcgatatggagttgggtttaggtctaaatttaagagttggagctttatcaatagataaatgtttatgttaggatcaaaaagctgcttggatgggcggtgtcatctgattaaaatctgttcgcataggtccattatacctggaaaataatagactgctttcgagccgaaaaaaataaggcatatttgttgttggtggctagattggatggccgtgtacctcaccaccttttgtacttgtatactgtgttcgagctatccttctcaccatttttctttttagattggatcgatgccactacaaatatatcatttgagataaatatcactactattcacaatatcggctatatttatgttactagaatttgaaaaaattgaaactgtgctactccatctcgttttccataaaaatctccgttagtctgaattgcacgtgaaacctagccgtcagttccatctttaccttcctcccctctcttctctttccccttcctctatccaccaccgtcataatcaccgtcatcgaccacgtccctggtgggaggcatcgagagccaccaccgtcgacgtctgcgacctcttccacaggccacatcgggtgttctgggagttggcgttgccgtcctcgactccatatgaggcgggagggctcgggagccgccgctgctgtctctatcctcgtagcggacacggggatggaggaagagatgggagagaaagaaaagggaggatggaggaagatagaactgacatatgtgttccacgtctaaggccgtgttcttttctcctctttcccagctcacttccctcgttttccgcgtgcggctttttaaactgttaaacggtatatttattacaaaagttttctatatgaaagttcctttaaaaattatattagtccatttttcaaatttttaggctaatacttaattaatttcactataatcgcgtgctttgtttttcgtatcgatcccgaatgcagacatggtctaacggaaaatgtgatgagtggcacggttttaatttccccaaatttcagtgccatgttgcccatatcatgaatagccgttgcatttatcttaaatgatatatttgtagtggtatggatccaattaaaccttttctttttggaagatccctaattcactaccgtaaattaagtttcacttggtactactagtatcaatcaattttattacaggattgaatccgaaaggctaaaaatgcaacgtatgtacgtatgtgcggctcgcaaacccttcctgcattgcagtaggtacgccgcggcggcatcgtcagcggcgccgtagccttcttcgccgtcgcaatattcctcgtcctctgtcttgatggctgggttgcggcggagagcctccgggaagaggcgcttcatgccggtggcctccatgatcctcttcccgagcggcggtcgtgcccccttcctggtgccgtacagcgcgcggcaggcccagtccagcaccccgggggcgaggcaggctaccagctgcagcggccggaacagcgacggccacgtgacgtaccagtcgccggcccggatgccgtccatggccacctcgcccagctccgccacgcggcccaccgggaacacgccgatctgctcctgcacacgtgcaactccatccgaacgaacagcgttaatttggaggctaaatctctgtaaaaggagcaatctatcctctctctgatgctgttagaatgaaacaataccacctctgttttatagaacaggtcacattgacttttttataataaatatttttaagtttgattaagtctatagaaaaatgcaacgacattttcaacacaaaataaacaccttattaaaatatattaaatattagttccaatgaaactcatttaggtttgtagacatctattaacttattaaagtaatagaaaaagaagcctccacgttcgctctcacagcctagaaattcttatattaatcggagaaaaagaaaaatagagtcaatatagaaatacaatttagaaatagttaaaattagaaattaaaaaaataaggaatatttgaagaggagactagagttctatagaaatacaattgagaaataaaagaaattcggaattaatcggaattaaaaataaggaatattataattagagtatagagtccatatagaaatacaattaagaaataatagaaatttgaaattaaaaataaggaatattagaagtagagtatagagtccatataggaatttaaaactaactaaaattcagaataaacataataaagttaaaagttgagtttagagttcgtataaaaaatacaagttacaaataactaaaattcgaaattaaaaaaaacatgggaagaagagtctaaagtcaatatagaaatacaatttagaagtaactgaaattaaaaattcaaaattaaagatattaaaagatgagtttagagtccacatagaaatacaattagaaataataaaaaatcagaactaaaaataaataatattggaagaagagcctagagtctatatagaaatacaatttacagataacaaaaattaggaattaaaaaaagaaatattgaaagacgagtctagagtctatataggaatataatttataaataactaaaatttgatattaaaaataattaataaatagcacgtatataaaatacaatatgaatattacacattagtagtttcgtaaagttagtacaaaatttaaaattatgttgtcattttaatatatttgaataatacattgagaaaacatatatgctattatacgagggaaaatataatgatgctagtcgcgtaatctgcgcgggccaccatgctagttactatataaataaaaacttggttaaatttaaagaaagtttaactataatatagaatggaagggggtatcaaagtcgtgaactttcggagctataaaaccatttttaaaattttcatttaattgatatcttacatctctggcttcctcgttgacagcgacatcgccgccgctctggatgcccttgcccttggtaatctcggattcgacgtagccaggggtgagaactgtgatcccgacctccgacccgagctcggctcgcaatgtttcgtagaacctcagttgcgccgctttggttgcctgataccgtgacgcacataaagaggtcttatgaacacatggaagaggcgaaaaaaattttagagaactgacgactcatttgtggtggtaacacgtacattgtagaagctcattcttgaagtgccgactgttcctgccgcggagcacgacacgacgagtttccctttgctggccttgaggtgtggtagggcatagtaggtcgggtacacggatccccagaagttcacgtcctgtgtaaatgtttcaaccaaaggatgaatggatagactatcaatatgcaataatagggcatgcatgtaggtgatgtatatcgtcataaacaactattttgtgttattctaacacttgtgtagctatatccatattttttttagcaaaggtgttgcatatatatgactctgtttggatccggagggcccttcggaattttgctatttaggagtattaaacgtagattactaacaaaactcattccataacctctagactattttacgagacgaatctaacgagatatattaattcatgatttgctatagtgatgctacagtaatcagctgctaatcatggattaatacacataattagattcgtctcgcaaaatagcctaagggttatggaatcgattttgtcgttaatctacgtttaattcgtcgaaatagcaaaatttcagagggatatttaatagtccagaggatccaaacaaggccataggccagtgagtgttcaccagcgtttaaattaagttggtgctcgagatcattgatgtaaaagagggccgtggtaatctgagcaacaacaaagtttaaaacacctaatccaaatttaaaaaggattggtttgaaatggttttgtgaagtagaacttcagcgatagaagagtattcaaaccgcaattcacttctctttccaagtcattattatttttctaaaatcggactgctgagtaactaaaccaccccggtctaaaccgcgggttgaaccgttggagtaaacgatttagaatctaatggtaaataatgtccacatacatgtaagtttggataaacatgatagttaaatagaatataatagacttaaactttatagttgaaaaacattcagacatatagaaaaaacatatttgaaaagatttatgaatttgttttaccatcatcttggtgaaagcggttatgttggtgacttcatcgaaggagcaagaggaccagataccggcattggcaaccagatggttcactgcacgcagcatcagcaagagacagaacaacaacaaatcgttaataatgcctcctctataattgcagacttgcagttagggagagagagagagatcggttcgcgcatgcaaggatgaaagtgcactacatttgccgaagtgcgcgactgtctcctcgacggcgcgtctcgactggtcggcgtcggagacgtcggccggcaggacgaggacgtccggcgagccgcgctccagggcggcggcggcgacgccctcgagagccttcttcctccgcgccaccagcgccaggcacgcaccttgcgctgcgtactggtaggccagttcctgcacaatgacaagagcagctagccacgttaagcaccaccacgtgtattgtcagtatagtgacacatgatagagaaaatataattcgagtaacgccacgtaaactagtataaataaaatagaaaaaatacgaattacccccaactatcgcggtcgtccgaattaccccctgaatcacaaaaccggacattcttcacctcccaattatgtaaaccggacgaattacccccctcgacccaatccgcggtggtttttagtctacgtggcatatacgtggtatcccagtcagcgttttctaataaaaaattatgggacccgcatgtaatagtcttcactttcccctctctcccactcttcctctcttctctctcactctatctcactcttcattgattcactctatcggcggcggtgggaaacacggaggagcgagcggcgggcaacggcgcacgggggcggacggcggacgacggcatcgtggcgaaggccgagcggaggcggctgcgggcgcggcgcacgggggcgggcggcggacg

SEQ ID NO: 70389 - DNA, 4486 bp, Oryza sativa
atcacctgtccgccgcctcccgcttcttcgccgccgttcgcctcgcccgcctcgtccacctgtccgttgccgcccgcctacctttccgcctcgtcgacgctgtcgacctcgccacgggacgcgcggagcggtacacggtgaggtacctcgtcgcccacccccgtgcgcgtggccgcgacgccgccgtccgccgtccgcccccgtgcgccgcctccgctcggcctttgccgcgacggcgccgtccaccgtccgccgtccgcccccgtgccccgccttccgccggccgccggcccgctcctccagtggtctcccgccgccgccgatagagtgaatcagtgaagagtgagatagagtgagagagaagagaggaagagtgagagaggggggaaagtgaagactgacatacgggtcccacaatttttttattagaaaacgctaactgggatacgacttagatcaaaactactgcggattagatcgagggggttaattcgtccggtttacatagtttgaggtgaagaatgtccggttttgtggttcaggaggtaattcggacgaccgtgatagttcgggggtaattcgtactttttctaataaaatattatattatgtttatattattaatagaaatgtagaagactctatcctgttcagacgagacaattaataaccatataaacatctattgtactttatgcgcattctccatcctctccccctttccctcccacccacatggctctctctccccgaaatgacttgtgtgcgcatgttcgcgggcgcggctgctagcgaacaggtcattgcttacatttttgccaagcatgtttccttttggaggcattttccttttttttcttttatgggcttggagctaattcaagtgacggctctctaagcagagacaagaaatcatggcccatgcggcccaaaatacgcattcatgctttttttccctatttttattatatctctatatgaagttgtataccaattattttgcatgtataaatttatataccaaatatttatgtgtaaaatcgctacaccaaatttttctacgatataaagcttatatgtataaagttgcgtgtataaatttttatactaaatgtttctgtataaaatgcctacaccgaaattttctatggtgcaaagtttatatgtataaaacttgtatggtataaagtttagatgtgcaagtttatatgtatatattatatgtatataaactttatacgtacaaattatttgggataaaatacaatgggccgcatttagtgggtcaaaagtgactaagccagctagcggctaaaaggggaaaggcacccacgctcgagggctggacttgtcagtatttgtcctgctaatgcgttcgtgctacgtgaatattcgtgtactagatccactcctctgtcccaccctcatgagctctctctcccaaactcaaggagtgctctctctcccaccctcatagctcaatggccgagaacactatgcagccgtcaatctatggtcaatagccaccaactccgtgttgttatggaaggccgccttcattcgaggtggagggataattcgtgaggctttttggattcgcagtagcttcgtttgctgactcattgtgatccacaacgagcttctttgattagaggtggtgaatcgaatgatgtgttttttttttgttttgaagcattttgagaaatgattttcaggataattttgctcgttaatttgagttatctagctttattgaaggattttgggcacttttttctaatcatttgttgcttgttttatggggcaatggaacatgcagtaacttttttttttgccatggggtaatttattgttgttcgggtgttgtttcgattaaattttttaaattgattattttttgtttttcttgagttttctcatgaaacacaaatttgtggatatcccagcaatactttcgtaatatctaatgtatcacgttagtggtaccatgatattgaggttttgtaactacaggcggacctatttatctctgtacatataatatcatacctgatatctatatgtattactccttctgtctaaaaaagccaaccttggcatggatgagatactttctaggacacgaatctggacactccgtccaaaaaaagccaaccttggtatggatggagctatgtccagattcttgtcctacaaagtgtcctattcatgttaaggttcgcttttactttttttgggatggagggagtagacctggtgctcggtactagggtatgatacctttggaaggtttctcgcatgctgatatcagcatgacgcaaatacataaagtatcccttccacttgtgtttctttcgagtctttgttcacttattatattgttaacaacaataaaaatatattgtatggtataatataacaaaacataattcttttggtactactaataatttgaccaattaatcttatagagtttatataagatatggctcgaacagggagcagacaacttggatatgatttcccacgcttatagcaagaacattttctttcttagagcactttagtatgaaattcatgatgtcgatatttattcaacgaaataggcgtaaccatgtttcttaaatgcaagactgtcaaaaacattaaagcaaactattaattaatataaacttccgatcgagagcgtttaagaacaatttaatattgttcatgcagtcgtaaaaagatttttctcgacaatactcccacttttatctaaaagtgtaaggcatagcatttcttttatcaacaagactaagaaaaaattatctaacaaatcaacaatcaggttccgatcaacaatttaagtttaacacgataaaacataaaagataattttttcatttaagtcttgaatatatgaagactacaaatatacctatctcattaaaaaaacagaaaatgaaataatgaaatagtttgtataggactttttgacagagggagtaagacggtaatggtccagcactacggtaaaacgagttactgcaggtgggcacagatccagatcggatcactttgtcgttagttaatcattgaccgggtcgcagccatgcatgcacgattttgtgagtgtagaagacgtcatcagcaattaattaatcgcatgtgttcaacccatactaccgatgagagaccagatgtctaattagaaggagatagcattacagtttacgagatacagtagctttacttgattctacaactaaaggcaattgggccggttcgcgcccatgtgccctgggaactacgcaagaatggaaccgaaatgacggtcaatacgtgtcataccaaaaactactgcttcatatgttttaaaatatatcaaactagtaaacgattaaacaacgacgaatatatatatataaagagtatatctacatttatactacttgtgaactcaattgttactctccctgttttatattaatcatcatatcattttctcattaagatcaataaaatcttaacttctctgtattttagggtctatatgatatagctccagctctaaactctacattcttgagagttaaagcccaaccaaacagttttaactccacctaaaatgggtgtggagttgtgtgaggcgtgtagctctaccaaacacccttatttattataagtttgtagtaggggaaaaatcaattttcatatagactttaactcttcttatgcctaagaaacaagagagctttactacccggccaaaagcttgcatgcatacatataagctcaatttgcatgtacaaatataataatactaccgtcaaatgaatgagccaaggttacacgatgattaatttagagtttttgatatttttatacgacgatcattacaagatggaggaagtatattttaaacgtatagtgtttactactacctccatcccaaattacttatcttttaaggtcgtttagtatatcataaggtttgaaacaaaagacttcaatacccttataaaataatttatgtttaaggatagaagggtggttgaggggtaaaataggaagaaatttaaatgtgatgtgattgatgggacaagtattactaggagtgataagtattggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagccattgtgggacaaaatttgaatggtagaaggataactaatttgggacggaggaagtatcaaagtggcaagataagagcaggtacaatagcagactataagccaactataaccacatatcgagaagaaaagagaaagagagagagaaagcgggctatagatttggtagccaagctgccacacgggactccaaaatgtatttgtgtataagatgtgggaccgggtattaatggtgcag

SEQ ID NO: 70390 - DNA, 3101 bp, Oryza sativa
  unsure (1)..(3101): unsure at all n locations
tgcgacgaagcggcttggcaagcgcggccgatgggttgaaatctaaaccaaggagacaaggatagacgtctcaccgatccaaaatgatcggagagggagggatgatgacaacgttccgatagcaacacatggagacgacaacgacgctagggccaaaccagattagattaaattggatcaagacccgatggataaactacaccatgaacgacatcggagagaggaaagctcactgagggacggcgtgacgatggatgatgacggcagacggccggcagcgaggtagaggcggcgacggggtcgggtcagcgatggcggcgacgtttcagcgatcttcggtgaagaaaaaccggtggccgggcttcaccttgctcctgcgaacccaaggattcgacggcgaccgagggcgacgacggacgacaacgaacggcgcgactgaagatggaacagatcggcttcacggggacgacggtgctccgatggcttgcgtcttcgcggaggtggctgccagcttctcctcactgctgcgatgccgacagtggatacggcgaggtccggcgaccacggagtcgacggcaaagcttggttggagatcaaaacatggcaacggttcggccttcacggtgacggcgacttccggcggggttcagcgcaaaagaacgggtggccggggtagagctcgacttggcggggccgagggaagtggcggcgctgaccggcgacggccggggcgacggcgcacggcagctggagcggctgccggaggtggagagagagggagctcgcggggagagcgtttccggcgatggcggcggacgggacttgaggggatgggtagaggacgactagggggtcctttatatagccatgggaggccgggatcgagcccacatcgacgggaaaaactcgggaaagtttatatttgccggaaaaaggaaaggatcttcgccgcctcaacaaacataacaataggggacggaaacacggtgcgattttgggagtccgcatggattggtgggcaaagacccaaagacctcatgccgcttgtctttgcgatctcaaaaaacagaggaaaatcccttcggcaaggaaaggaggaggacgcctaggtgcaagattttaagcttgattcacaatcatctatcgcagtcgacctcgtcgaacagctagtcgcactgtgggaagcggtccgaaatgtgcacttagatgttggagaaccggatcagattacttggaagttcacaaacaacgggcactacacggcctcctcggcttaccatgcgcagtgctgcggggcgccgagtacaaacttcaattccttgatttggaaaccctgggcgccggggaaatgcaaatttcatgcttggctcatcatcagaacagagtctggactttagaccggcttgcgaccaggggatggcagaacaatggttgttgccctctttgccgccgcgagactgagacggcattgcaccacgttgccacttgtagatacaccaagaggatctggcacctcgtctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctgggaaatttggaaagagaggaatcggcgatttttgatcacaaagaggtggcaacgaacttcctactaatgaaaatcaaagaggaggcgagcctttgggctttagcaggagctaagcggttgcgtgagttaatcccacactctgtatagtgtacagctatagtggttctccgtttttcttttcccctaagggtttgtatttctcctgctctattcgatgaaaaggcactctagtgctgttttccgttcanaaaaaaaaagaaaaaggaaaggatttgatccgcgaaatggaaaagaattccatatanacttttggggatttctttgggaaaaagaaaaggagattgagaggattcccattcccgcactaatttggaaaaaggagcaacggggaggccggattggtgggaggaggcggcggcactgtgcacgagcacggctggctcggctctgtctggaggaggaagatggagtactgtagcgatagggaggtaaatcagactttggctgggctgagaggaagggagagaatgggctgaattcggcccaagctgaggaggaggatttttattacttttccaataaattaaccaatgagatgatctttcaattgttaaaaatactttcaatgctcaaataattccaagaaaaatcttgaacatacttggacactcaaagtatttaacaatattaaaaccagaccatttaatgattaatttgttaattaaataattgctaaactattctttgtattattaaaattaaaattgagctctgagaaattcgagaaaattccaaagagtataattaatcatggagaatttaatacaaattaaatccatccatgctttatatttaggaaattttatttcccacatttaacttcacttgtaaattaatgaacatttaatatatattctattaataatttattaaataatttttaaatcctgaaacaaaaattcaggctgtgacagtgtaggctttggtggcaaggaaggagaacgtatggattgtggattccggttgttcgcggcacatgaccggtgataaagattggttctcctccctcaaaaaggcatccaagactgaatcaattgtctttgctgatgcttctactagtgccgttgtcgctacaggtttggttatggtaaatgaaaattttgaattgaagaatgtagctttggttaaggatttaaagtacaatttgctttcggtttcacaattgttgatgaagagtttgaagttcactttaagaaaactagaagtaaaatttttgattcttgtggtgattctgtgctgaatatttctcgttatggaagagtgtttaaagctgattttgaaaattctgtttcacctgtgataacttgtttggttgctaagtttgataaagatgtgatgttttggcatcgtagacttggacatgttggttttgatcatctcac

SEQ ID NO: 70391 - DNA, 753 bp, Oryza sativa
ctgcagccccaattcgacctgtggaatttgtacataaagcatcactatcttgcgctgcctgatatgtagatgctggggggggtaattcatctacttcagaccattctgagatgaaaaaaaaatatggtattatatgggatatgaattgatcaaccgctaggacaagggctaggctacattccaactgtctatttggactctgcagatgtaaattctcactgacgcgtgaacatactggttagcttacatgttaactgacatgtttcggtcaacatgggcaggggctgagaagactagggtgaacagcaatgcaatactaatggaaccttatgcgcccaaggatgccaatgggaatgtaatatgagaacaaactttctccttcccagaactctcgaccgccaccatgaatttaatgccaaagtgcttcctgtacgaacgaggctttgggcgcgatcataagggccgactagatagcactggccacttaacttatttgacaaatgggtatatgcttcattcttgccttcacctgcggagagctgaacaaccggataattgcactgttgcaaaatcttcactgaacactattgattggctaagatacacgtacggaactgtttacatgactgacaaatgaccatgcttaacacctgtttatctcatcatggttgttcatgcataataatactatgcttataccactcgtcgaaatacattgtaatcttggcctggaccgccttctttctgtttaaa
